United States Patent 9,675,668 (MODIFIED POLYNUCLEOTIDES ENCODING HEPATITIS A VIRUS CELLULAR RECEPTOR 2) - sequence listing, part 9

SEQ ID NO: 14454 - protein, 619 aa, Artificial Sequence
  Description of Artificial Sequence: Synthetic coding sequence
MPWQAFRRFGQKLVRRRTLESGMAETRLARCLSTLDLVALGVGSTLGAGVYVLAGEVAKDKAGPSIVICFLVAALSSVLAGLCYAEFGARVPRSGSAYLYSYVTVGELWAFTTGWNLILSYVIGTASVARAWSSAFDNLIGNHISKTLQGSIALHVPHVLAEYPDFFALGLVLLLTGLLALGASESALVTKVFTGVNLLVLGFVMISGFVKGDVHNWKLTEEDYELAMAELNDTYSLGPLGSGGFVPFGFEGILRGAATCFYAFVGFDCIATTGEEAQNPQRSIPMGIVISLSVCFLAYFAVSSALTLMMPYYQLQPESPLPEAFLYIGWAPARYVVAVGSLCALSTSLLGSMFPMPRVIYAMAEDGLLFRVLARIHTGTRTPIIATVVSGIIAAFMAFLFKLTDLVDLMSIGTLLAYSLVSICVLILRYQPDQETKTGEEVELQEEAITTESEKLTLWGLFFPLNSIPTPLSGQIVYVCSSLLAVLLTALCLVLAQWSVPLLSGDLLWTAVVVLLLLLIIGIIVVIWRQPQSSTPLHFKVPALPLLPLMSIFVNIYLMMQMTAGTWARFGVWMLIGFAIYFGYGIQHSLEEIKSNQPSRKSRAKTVDLDPGTLYVHSV

SEQ ID NO: 14455 - protein, 619 aa, Artificial Sequence; identical to SEQ ID NO: 14454
  Description of Artificial Sequence: Synthetic coding sequence

SEQ ID NO: 14456 - protein, 523 aa, Artificial Sequence
  Description of Artificial Sequence: Synthetic coding sequence
MAGHTQQPSGRGNPRPAPSPSPVPGTVPGASERVALKKEIGLLSACTIIIGNIIGSGIFISPKGVLEHSGSVGLALFVWVLGGGVTALGSLCYAELGVAIPKSGGDYAYVTEIFGGLAGFLLLWSAVLIMYPTSLAVISMTFSNYVLQPVFPNCIPPTTASRVLSMACLMLLTWVNSSSVRWATRIQDMFTGGKLLALSLIIGVGLLQIFQGHFEELRPSNAFAFWMTPSVGHLALAFLQGSFAFSGWNFLNYVTEEMVDARKNLPRAIFISIPLVTFVYTFTNIAYFTAMSPQELLSSNAVAVTFGEKLLGYFSWVMPVSVALSTFGGINGYLFTYSRLCFSGAREGHLPSLLAMIHVRHCTPIPALLVCCGATAVIMLVGDTYTLINYVSFINYLCYGVTILGLLLLRWRRPALHRPIKVNLLIPVAYLVFWAFLLVFSFISEPMVCGVGVIIILTGVPIFFLGVFWRSKPKCVHRLTESMTHWGQELCFVVYPQDAPEEEENGPCPPSLLPATDKPSKPQ

SEQ ID NO: 14457 - protein, 771 aa, Artificial Sequence
  Description of Artificial Sequence: Synthetic coding sequence
MSGFFTSLDPRRVQWGAAWYAMHSRILRTKPVESMLEGTGTTTAHGTKLAQVLTTVDLISLGVGSCVGTGMYVVSGLVAKEMAGPGVIVSFIIAAVASILSGVCYAEFGVRVPKTTGSAYTYSYVTVGEFVAFFIGWNLILEYLIGTAAGASALSSMFDSLANHTISRWMADSVGTLNGLGKGEESYPDLLALLIAVIVTIIVALGVKNSIGFNNVLNVLNLAVWVFIMIAGLFFINGKYWAEGQFLPHGWSGVLQGAATCFYAFIGFDIIATTGEEAKNPNTSIPYAITASLVICLTAYVSVSVILTLMVPYYTIDTESPLMEMFVAHGFYAAKFVVAIGSVAGLTVSLLGSLFPMPRVIYAMAGDGLLFRFLAHVSSYTETPVVACIVSGFLAALLALLVSLRDLIEMMSIGTLLAYTLVSVCVLLLRYQPESDIDGFVKFLSEEHTKKKEGILADCEKEACSPVSEGDEFSGPATNTCGAKNLPSLGDNEMLIGKSDKSTYNVNHPNYGTVDMTTGIEADESENIYLIKLKKLIGPHYYTMRIRLGLPGKMDRPTAATGHTVTICVLLLFILMFIFCSFIIFGSDYISEQSWWAILLVVLMVLLISTLVFVILQQPENPKKLPYMAPCLPFVPAFAMLVNIYLMLKLSTITWIRFAVWCFVGLLIYFGYGIWNSTLEISAREEALHQSTYQRYDVDDPFSVEEGFSYATEGESQEDWGGPTEDKGFYYQQMSDAKANGRTSSKAKSKSKHKQNSEALIANDELDYSPE

SEQ ID NO: 14458 - protein, 298 aa, Artificial Sequence
  Description of Artificial Sequence: Synthetic coding sequence
MERGISDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 14459 - protein, 921 aa, Artificial Sequence
  Description of Artificial Sequence: Synthetic coding sequence
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 14460 - protein, 925 aa, Artificial Sequence
  Description of Artificial Sequence: Synthetic coding sequence
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIHIKVIDDEAYEKNKNYFIEMMGPRMVDMSFQKALLLSPDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 14461 - protein, 927 aa, Artificial Sequence
  Description of Artificial Sequence: Synthetic coding sequence
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISALLLSPDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 14462 - protein, 284 aa, Artificial Sequence
  Description of Artificial Sequence: Synthetic coding sequence
MEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 14463 - protein, 620 aa, Artificial Sequence
  Description of Artificial Sequence: Synthetic coding sequence
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVCDRQEADYGRRGGQEDSRDGKASIG

SEQ ID NO: 14464 - protein, 925 aa, Artificial Sequence; identical to SEQ ID NO: 14460
  Description of Artificial Sequence: Synthetic coding sequence

SEQ ID NO: 14465 - protein, 924 aa, Artificial Sequence
  Description of Artificial Sequence: Synthetic coding sequence
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISALLLSPDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 14466 - protein, 1124 aa, Artificial Sequence
  Description of Artificial Sequence: Synthetic coding sequence
MSSYFWAQNESNRPDLLCGQPADYLVEEKHFTTLVCFIVVLGGLLKMCLKNCEVIVLTILSLSGFVIGHMAYNSVEVHQIVYPLLRTSSFSLYSYFSPLIIFMVALDVEFYTLKKMFWQVLLTGLISFSTASIIIGYVVIKFNKDSWDLQSCLLFSITLGIIDPLRSVNSLKTIGISKIYIDLIRGESLIICSIASIFFGNFRGNRIHFSIFRDLHVGIELSYDILGSIIFGYWCAKIIQCILADVFSNMLTNIILCFSMVYMTFYIVEFLGMSGTLALAAVGLNLDSLTFKPKIELVITKFLRIFSSVYEHLIYAFFGIVIGCGELSHYEFHTIPFIFILFTTVNLVRLLTILLVSPILMHSNYEYNWRWGVVITWSGIKGVFNLLWAPDVYNLAERKVEVPQMFILYVQVISLLTMGINSYVMTQSARKLDLCVLSLPRQMILQNATQHIQEIVQNTITLFKTEKILTNVNWTLVEDKTRIEYIPFSHVSHNDMKTESTTDEALMEEARLHVAAIQMSSFEKQRNNGILEIEAARILIGAAKCYYSIQGKFMSIYDVSTYMRTRSWLIKFKNVLTFLEYCIEKIHFIPPESNTFLTFIFHIVFSEEFEYTGQIINLIYIYPMIIHLWPMARGLNVSALISINYYFMFLYVLESTLKIIILKRKYFQQCWNTLEFFILVIGIIDIFCVYFVKLRPDNLALIQLTVIMGYLRIIRFLPLFKIIVPILIRIADVQIKKRLSLMYSITKGYIKSQEDAKLLIKQIAVCESIYQKLCEILETNKQDAVKELVLMEHEGRDVVIALKTKQAIRNVIAKALKNLTFLCSRGIIDKHEVIEINKVLLKKLKALNNFPKAIPPPTPDIYLHNIIWLEGKDVLIDFFKERAKLACFDSGDTICKGGEMPQGIYLIISGMAILHSLSPTFGIESNQRCDRGSRDMFTEFCTTGDIIGELSCLLKREIEYTVICETSLQACFISLEDLYEGFDAFWPSLEYKIWLKLALSTAYQYFESSLIDEDLRFQNCVMFNQAYVETLSSYSDMIIDNMTMKFVIIVYGSVIDTKTEEPYFAPCIIPTTCEQVQGTSDLSKLLIIQASELTQRNSNTNVMASVNTVFEQPGKNINGRQKMS

SEQ ID NO: 14467 - protein, 450 aa, Artificial Sequence
  Description of Artificial Sequence: Synthetic coding sequence
MVALDVEFYTLKKMFWQVLLTGLISFSTASIIIGYVVIKFNKDSWDLQSCLLFSITLGIIDPLRSVNSLKTIGISKIYIDLIRGESLIICSIASIFFGNFRGNRIHFSIFRDLHVGIELSYDILGSIIFGYWCAKIIQCILADVFSNMLTNIILCFSMVYMTFYIVEFLGMSGTLALAAVGLNLDSLTFKPKIELVITKFLRIFSSVYEHLIYAFFGIVIGCGELSHYEFHTIPFIFILFTTVNLVRLLTILLVSPILMHSNYEYNWRWGVVITWSGIKGVFNLLWAPDVYNLAERKVEVPQMFILYVQVISLLTMGINSYVMTQSARKLDLCVLSLPRQMILQNATQHIQEIVQNTITLFKTEKILTNVNWTLVEDKTRIEYIPFSHVSHNDMKTESTTDEALMEEARLHVAAIQMSSFEKQRNNGILEIEAARILIGAAKCYYSIQGK

SEQ ID NO: 14468 - protein, 515 aa, Artificial Sequence
  Description of Artificial Sequence: Synthetic coding sequence
MHTTESKNEHLEDENFQTSTTPQSLIDPNNTAQEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQALRHLKVVCFRLAVGPCLMEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGISVATLSLALCVRILTTYLLMCFAGFSFKEKIFIALAWMPKATVQAVLGPLALETARVSAPHLEPYAKDVMTVAFLAILITAPNGALLMGILGPKMLTRHYDPSKIKLQLSTLEHH

SEQ ID NO: 14469 - protein, 475 aa, Artificial Sequence
  Description of Artificial Sequence: Synthetic coding sequence
MHTTESKNEHLEDENFQTSTTPQSLIDPNNTAQEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQALRHLKVVCFRLAVGPCLMEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGISVATLSLALCVRILTTYLLMCFAGFSFKEKIFIALAWMPKATVQINQAILLLFLLREEWTNCKVAKKCEYTKERQ

SEQ ID NO: 14470 - protein, 220 aa, Artificial Sequence
  Description of Artificial Sequence: Synthetic coding sequence
MHTTESKNEHLEDENFQTSTTPQSLIDPNNTAQEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQALRHLKVVCFRLAVGPCLMEASAAAVFSHFIMKFPWQWAFLLGLF

SEQ ID NO: 14471 - protein, 50 aa, Artificial Sequence
  Description of Artificial Sequence: Synthetic coding sequence
MHTTESKNEHLEDENFQTSTTPQSLIDPNNTAQEETKTVLSDTEEIKPQT

SEQ ID NO: 14472 - protein, 454 aa, Artificial Sequence
  Description of Artificial Sequence: Synthetic coding sequence
MGDEDKRITYEDSEPSTGMNYTPSMHQEAQEETVMKLKGIDANEPTEGSILLKSSEKKLQETPTEANHVQRLRQMLACPPHGLLDRVITNVTIIVLLWAVVWSITGSECLPGGNLFGIIILFYCAIIGGKLLGLIKLPTLPPLPSLLGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSRDQDKLVCKRTFLVLGLSVLAVFSSVHFGFPGSGGLCTLVMAFLAGMGWTSEKAEVEKIIAVAWDIFQPLLFGLIGAEVSIASLRPETVGSADSITGNFGTERPKLLGPPSTQLRFHFFHIQLST

SEQ ID NO: 14473 - protein, 537 aa, Artificial Sequence
  Description of Artificial Sequence: Synthetic coding sequence
MGDEDKRITYEDSEPSTGMNYTPSMHQEAQEETVMKLKGIDANEPTEGSILLKSSEKKLQETPTEANHVQRLRQMLACPPHGLLDRVITNVTIIVLLWAVVWSITGSECLPGGNLFGIIILFYCAIIGGKLLGLIKLPTLPPLPSLLGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSRDQDKLVCKRTFLVLGLSVLAVFSSVHFGFPGSGGLCTLVMAFLAGMGWTSEKAEVEKIIAVAWDIFQPLLFGLIGAEVSIASLRPETVGLCVATVGIAVLIRILTTFLMVCFAGFNLKEKIFISFAWLPKATVQAAIGSVALDTARSHGEKQLEDYGMDVLTVAFLSILITAPIGSLLIGLLGPRLLQKVEHQNKDEEVQGETSVQV

SEQ ID NO: 14474 - protein, 537 aa, Artificial Sequence; identical to SEQ ID NO: 14473
  Description of Artificial Sequence: Synthetic coding sequence

SEQ ID NO: 14475 - protein, 417 aa, Artificial Sequence
  Description of Artificial Sequence: Synthetic coding sequence
MGDEDKRITYEDSEPSTGMNYTPSMHQEAQEETVMKLKGIDANEPTEGSILLKSSEKKLQETPTEANHVQRLRQMLACPPHGLLDRVITNGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSRDQDKLVCKRTFLVLGLSVLAVFSSVHFGFPGSGGLCTLVMAFLAGMGWTSEKAEVEKIIAVAWDIFQPLLFGLIGAEVSIASLRPETVGCNRICGFGHSKVTWRETIRRLWNGCVDSGIFVHPHHSPNWKSAYWFTGPQASAES

SEQ ID NO: 14476 - protein, 480 aa, Artificial Sequence
  Description of Artificial Sequence: Synthetic coding sequence
MGDEDKRITYEDSEPSTGMNYTPSMHQEAQEETVMKLKGIDANEPTEGSILLKSSEKKLQETPTEANHVQRLRQMLACPPHGLLDRVITNGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSRDQDKLVCKRTFLVLGLSVLAVFSSVHFGFPGSGGLCTLVMAFLAGMGWTSEKAEVEKIIAVAWDIFQPLLFGLIGAEVSIASLRPETVGLCVATVGIAVLIRILTTFLMVCFAGFNLKEKIFISFAWLPKATVQAAIGSVALDTARSHGEKQLEDYGMDVLTVAFLSILITAPIGSLLIGLLGPRLLQKVEHQNKDEEVQGETSVQV

SEQ ID NO: 14477 - protein, 143 aa, Artificial Sequence
  Description of Artificial Sequence: Synthetic coding sequence
MGDEDKRITYEDSEPSTGMNYTPSMHQEAQEETVMKLKGIDANEPTEGSILLKSSEKKLQETPTEANHVQRLRQMLACPPHGLLDRVITNVTIIVLLWAVVWSITGSECLPGGNLFGIIILFYCAIIGGKLLGLIKLPTLPPL

SEQ ID NO: 14478 - protein, 687 aa, Artificial Sequence
  Description of Artificial Sequence: Synthetic coding sequence
MDEGTGLQPGAGEQLEAPATAEAVQERCEPETLRSKSLPVLSSASCRPSLSPTSGDANPAFGCVDSSGHQELKQGPNPLAPSPSAPSTSAGLGDCNHRVDLSKTFSVSSALAMLQERRCLYVVLTDSRCFLVCMCFLTFIQALMVSGYLSSVITTIERRYSLKSSESGLLVSCFDIGNLVVVVFVSYFGGRGRRPLWLAVGGLLIAFGAALFALPHFISPPYQIQELNASAPNDGLCQGGNSTATLEPPACPKDSGGNNHWVYVALFICAQILIGMGSTPIYTLGPTYLDDNVKKENSSLYLAIMYVMGALGPAVGYLLGGLLIGFYVDPRNPVHLDQNDPRFIGNWWSGFLLCAIAMFLVIFPMFTFPKKLPPRHKKKKKKKFSVDAVSDDDVLKEKSNNSEQADKKVSSMGFGKDVRDLPRAAVRILSNMTFLFVSLSYTAESAIVTAFITFIPKFIESQFGIPASNASIYTGVIIVPSAGVGIVLGGYIIKKLKLGARESAKLAMICSGVSLLCFSTLFIVGCESINLGGINIPYTTGPSLTMPHRNLTGSCNVNCGCKIHEYEPVCGSDGITYFNPCLAGCVNSGNLSTGIRNYTECTCVQSRQVITPPTVGQRSQLRVVIVKTYLNENGYAVSGKCKRTCNTLIPFLVFLFIVTFITACAQPSAIIVTLSIHSYSNLLWSSH

SEQ ID NO: 14479 - protein, 670 aa, Artificial Sequence
  Description of Artificial Sequence: Synthetic coding sequence
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 14480 - protein, 579 aa, Artificial Sequence
  Description of Artificial Sequence: Synthetic coding sequence
MFLTKNCKQEQERVESAKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFGKNSYFFPHPIRTILLLLFFITL

SEQ ID NO: 14481 - protein, 13 aa, Artificial Sequence
  Description of Artificial Sequence: Synthetic coding sequence
MGETEKRIETHRI

SEQ ID NO: 14482 - protein, 51 aa, Artificial Sequence
  Description of Artificial Sequence: Synthetic coding sequence
MGETEKRIETHRIRCLSKLKMFLLAITCAFVSKTLSGSYMNSMLTQIERQF

SEQ ID NO: 14483 - protein, 99 aa, Artificial Sequence
  Description of Artificial Sequence: Synthetic coding sequence
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLG

SEQ ID NO: 14484 - protein, 147 aa, Artificial Sequence
  Description of Artificial Sequence: Synthetic coding sequence
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPS

SEQ ID NO: 14485 - protein, 2 aa, Artificial Sequence
  Description of Artificial Sequence: Synthetic coding sequence
MG

SEQ ID NO: 14486 - protein, 88 aa, Artificial Sequence
  Description of Artificial Sequence: Synthetic coding sequence
MGETEKRIETHRIRCLSKLKMFLLAITCAFVSKTLSGSYMNSMLTQIERQFNIPTSLVGFINGSFEIGNLLLIIFVSYFGTKLHRPIM

SEQ ID NO: 14487 - protein, 91 aa, Artificial Sequence
  Description of Artificial Sequence: Synthetic coding sequence
MGETEKRIETHRIRCLSKLKMFLLAITCAFVSKTLSGSYMNSMLTQIERQFNIPTSLVGFINGSFEIGNLLLIIFVSYFGTKLHRPIMIGI

SEQ ID NO: 14488 - protein, 670 aa, Artificial Sequence; identical to SEQ ID NO: 14479
  Description of Artificial Sequence: Synthetic coding sequence

SEQ ID NO: 14489 - protein, 137 aa, Artificial Sequence
  Description of Artificial Sequence: Synthetic coding sequence
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGT

SEQ ID NO: 14490 - protein, 538 aa, Artificial Sequence
  Description of Artificial Sequence: Synthetic coding sequence
MENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 14491 - protein, 538 aa, Artificial Sequence; identical to SEQ ID NO: 14490
  Description of Artificial Sequence: Synthetic coding sequence

SEQ ID NO: 14492 - protein, 567 aa, Artificial Sequence
  Description of Artificial Sequence: Synthetic coding sequence
MGLLPKLGASQGSDTSTSRAGRCARSVFGNIKVFVLCQGLLQLCQLLYSAYFKSSLTTIEKRFGLSSSSSGLISSLNEISNAILIIFVSYFGSRVHRPRLIGIGGLFLAAGAFILTLPHFLSEPYQYTLASTAILFAISVFGPAFGYLLGSVMLQIFVDYGRVNTAAVNLVPGDPRWIGAWWLGLLISSALLVLTSFPFFFFPRAMPIGAKRAPATADEARKLEEAKSRGSLVDFIKRFPCIFLRLLMNSLFVLVVLAQCTFSSVIAGLSTFLNKFLEKQYGTSAAYANFLIGAVNLPAAALGMLFGGILMKRFVFSLQAIPRIATTIITISMILCVPLFFMGCSTPTVAEVYPPSTSSSIHPQSPACRRDCSCPDSIFHPVCGDNGIEYLSPCHAGCSNINMSSATSKQLIYLNCSCVTGGSASAKTGSCPVPCAHFLLPAIFLISFVSLIACISHNPLYMMVLRVVNQEEKSFAIGVQFLLMRLLAWLPSPALYGLTIDHSCIRWNSLCLGRRGACAYYDNDALRDRYLGLQMGYKALGMLLLCFISWRVKKNKEYNVQKAAGLI

SEQ ID NO: 14493 - protein, 709 aa, Artificial Sequence
  Description of Artificial Sequence: Synthetic coding sequence
MGPRIGPAGEVPQVPDKETKATMGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMAIFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 14494 - protein, 482 aa, Artificial Sequence
  Description of Artificial Sequence: Synthetic coding sequence
MIGYGAILVALAGLLMTLPHFISEPYRYDNTSPGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMAIFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 14495 - protein, 687 aa, Artificial Sequence
  Description of Artificial Sequence: Synthetic coding sequence
MGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMAIFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 14496 - protein, 482 aa, Artificial Sequence; identical to SEQ ID NO: 14494
  Description of Artificial Sequence: Synthetic coding sequence

SEQ ID NO: 14497 - protein, 565 aa, Artificial Sequence
  Description of Artificial Sequence: Synthetic coding sequence
MGPRIEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMAIFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 14498 - protein, 44 aa, Artificial Sequence
  Description of Artificial Sequence: Synthetic coding sequence
MGTENTPGGKASPDPQDVRPSVFHNIKLFVLCHSLLQLAQLMIS

SEQ ID NO: 14499 - protein, 150 aa, Artificial Sequence
  Description of Artificial Sequence: Synthetic coding sequence
MGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAP

SEQ ID NO: 14500 - protein, 44 aa, Artificial Sequence; identical to SEQ ID NO: 14498
  Description of Artificial Sequence: Synthetic coding sequence

SEQ ID NO: 14501 - protein, 87 aa, Artificial Sequence
  Description of Artificial Sequence: Synthetic coding sequence
MGTENTPGGKASPDPQDVRPSVFHNIKLFVLCHSLLQLAQLMISGYLKSSISTVEKRFGLSSQTSGLLASFNEVGNTALIVFVSYFG

SEQ ID NO: 14502 - protein, 593 aa, Artificial Sequence
  Description of Artificial Sequence: Synthetic coding sequence
MIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMAIFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 14503 - protein, 44 aa, Artificial Sequence; identical to SEQ ID NO: 14498
  Description of Artificial Sequence: Synthetic coding sequence

SEQ ID NO: 14504 - protein, 127 aa, Artificial Sequence
  Description of Artificial Sequence: Synthetic coding sequence
MGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSP

SEQ ID NO: 14505 - protein, 724 aa, Artificial Sequence
  Description of Artificial Sequence: Synthetic coding sequence
MKSAKGIENLAFVPSSPDILRRLSASPSQIEVSALSSDPQRENSQPQELQKPQEPQKSPEPSLPSAPPNVSEEKLRSLSLSEFEEGSYGWRNFHPQCLQRCNTPGGFLLHYCLLAVTQGIVVNGLVNISISTVEKRYEMKSSLTGLISSSYDISFCLLSLFVSFFGERGHKPRWLAFAAFMIGLGALVFSLPQFFSGEYKLGSLFEDTCVTTRNSTSCTSSTSSLSNYLYVFILGQLLLGAGGTPLYTLGTAFLDDSVPTHKSSLYIGTGYAMSILGPAIGYVLGGQLLTIYIDVAMGESTDVTEDDPRWLGAWWIGFLLSWIFAWSLIIPFSCFPKHLPGTAEIQAGKTSQAHQSNSNADVKFGKSIKDFPAALKNLMKNAVFMCLVLSTSSEALITTGFATFLPKFIENQFGLTSSFAATLGGAVLIPGAALGQILGGFLVSKFRMTCKNTMKFALFTSGVALTLSFVFMYAKCENEPFAGVSESYNGTGELGNLIAPCNANCNCSRSYYYPVCGDGVQYFSPCFAGCSNPVAHRKPKVYYNCSCIERKTEITSTAETFGFEAKAGKCETHCAKLPIFLCIFFIVIIFTFMAGTPITVSILRCVNHRQRSLALGIQFMVLRLLGTIPGPIIFGFTIDSTCILWDINDCGIKGACWIYDNIKMAHMLVAISVTCKVITMFFNGFAIFLYKPPPSATDVSFHKENAVVTNVLAEQDLNKIVKEG

SEQ ID NO: 14506 - protein, 848 aa, Artificial Sequence
  Description of Artificial Sequence: Synthetic coding sequence
MDEGTGLQPGAGEQLEAPATAEAVQERCEPETLRSKSLPVLSSASCRPSLSPTSGDANPAFGCVDSSGHQELKQGPNPLAPSPSAPSTSAGLGDCNHRVDLSKTFSVSSALAMLQERRCLYVVLTDSRCFLVCMCFLTFIQALMVSGYLSSVITTIERRYSLKSSESGLLVSCFDIGNLVVVVFVSYFGGRGRRPLWLAVGGLLIAFGAALFALPHFISPPYQIQELNASAPNDGLCQGGNSTATLEPPACPKDSGGNNHWVYVALFICAQILIGMGSTPIYTLGPTYLDDNVKKENSSLYLAIMYVMGALGPAVGYLLGGLLIGFYVDPRNPVHLDQNDPRFIGNWWSGFLLCAIAMFLVIFPMFTFPKKLPPRHKKKKKKKFSVDAVSDDDVLKEKSNNSEQADKKVSSMGFGKDVRDLPRAAVRILSNMTFLFVSLSYTAESAIVTAFITFIPKFIESQFGIPASNASIYTGVIIVPSAGVGIVLGGYIIKKLKLGARESAKLAMICSGVSLLCFSTLFIVGCESINLGGINIPYTTGPSLTMPHRNLTGSCNVNCGCKIHEYEPVCGSDGITYFNPCLAGCVNSGNLSTGIRNYTECTCVQSRQVITPPTVGQRSQLRVVIVKTYLNENGYAVSGKCKRTCNTLIPFLVFLFIVTFITACAQPSAIIVTLRSVEDEERPFALGMQFVLLRTLAYIPTPIYFGAVIDTTCMLWQQECGVQGSCWEYNVTSFRFVYFGLAAGLKFVGFIFIFLAWYSIKYKEDGLQRRRQREFPLSTVSERVGHPDNARTRSCPAFSTQGEFHEETGLQKGIQCAAQTYPGPFPEAISSSADPGLEESPAALEPPS

SEQ ID NO: 14507 - protein, 793 aa, Artificial Sequence
  Description of Artificial Sequence: Synthetic coding sequence
MDEGTGLQPGAGEQLEAPATAEAVQERCEPETLRSKSLPVLSSASCRPSLSPTSGDANPAFGCVDSSGHQELKQGPNPLAPSPSAPSTSAGLGDCNHRVDLSKTFSVSSALAMLQERRCLYVVLTDSRCFLVCMCFLTFIQALMVSGYLSSVITTIERRYSLKSSESGLLVSCFDIGNLVVVVFVSYFGGRGRRPLWLAVGGLLIAFGAALFALPHFISPPYQIQELNASAPNDGLCQGGNSTATLEPPACPKDSGGNNHWVYVALFICAQILIGMGSTPIYTLGPTYLDDNVKKENSSLYLAIMYVMGALGPAVGYLLGGLLIGFYVDPRNPVHLDQNDPRFIGNWWSGFLLCAIAMFLVIFPMFTFPKKLPPRHKKKKKKKFSVDAVSDDDVLKEKSNNSEQADKKVSSMGFGKDVRGVIIVPSAGVGIVLGGYIIKKLKLGARESAKLAMICSGVSLLCFSTLFIVGCESINLGGINIPYTTGPSLTMPHRNLTGSCNVNCGCKIHEYEPVCGSDGITYFNPCLAGCVNSGNLSTGIRNYTECTCVQSRQVITPPTVGQRSQLRVVIVKTYLNENGYAVSGKCKRTCNTLIPFLVFLFIVTFITACAQPSAIIVTLRSVEDEERPFALGMQFVLLRTLAYIPTPIYFGAVIDTTCMLWQQECGVQGSCWEYNVTSFRFVYFGLAAGLKFVGFIFIFLAWYSIKYKEDGLQRRRQREFPLSTVSERVGHPDNARTRSCPAFSTQGEFHEETGLQKGIQCAAQTYPGPFPEAISSSADPGLEESPAALEPPS

SEQ ID NO: 14508 - protein, 201 aa, Artificial Sequence
  Description of Artificial Sequence: Synthetic coding sequence
MFPEQQKEEFVSVWVRDPRIQKEDFWHSYIDYEICIHTNSMCFTMKTSCVRRRYREFVWLRQRLQSNALLVQLPELPSKNLFFNMNNRQHVDQRRQGLEDFLRKVLQNALLLSDSSLHLFLQSHLNSEDIEACVSGQTKYSVEEAIHKFALMNRRFPEEDEEGKKENDIDYDSESSSSGLGHSSDDSSSHGCKVNTAPQES

SEQ ID NO: 14509 - protein, 201 aa, Artificial Sequence; identical to SEQ ID NO: 14508
  Description of Artificial Sequence: Synthetic coding sequence

SEQ ID NO: 14510 - protein, 227 aa, Artificial Sequence
  Description of Artificial Sequence: Synthetic coding sequence
MILMEGIGCMRHSSLTRQPKLPYRSLASARGGLQEFVSVWVRDPRIQKEDFWHSYIDYEICIHTNSMCFTMKTSCVRRRYREFVWLRQRLQSNALLVQLPELPSKNLFFNMNNRQHVDQRRQGLEDFLRKVLQNALLLSDSSLHLFLQSHLNSEDIEACVSGQTKYSVEEAIHKFALMNRRFPEEDEEGKKENDIDYDSESSSSGLGHSSDDSSSHGCKVNTAPQES

SEQ ID NO: 14511 - protein, 117 aa, Artificial Sequence
  Description of Artificial Sequence: Synthetic coding sequence
MNNRQHVDQRRQGLEDFLRKVLQNALLLSDSSLHLFLQSHLNSEDIEACVSGQTKYSVEEAIHKFALMNRRFPEEDEEGKKENDIDYDSESSSSGLGHSSDDSSSHGCKVNTAPQES

SEQ ID NO: 14512 - protein, 946 aa, Artificial Sequence
  Description of Artificial Sequence: Synthetic coding sequence
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 14513 - protein, 893 aa, Artificial Sequence
  Description of Artificial Sequence: Synthetic coding sequence
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 14514 - protein, 937 aa, Artificial Sequence
  Description of Artificial Sequence: Synthetic coding sequence
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 14515 - protein, 348 aa, Artificial Sequence
  Description of Artificial Sequence: Synthetic coding sequence
MEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 14516 - protein, 894 aa, Artificial Sequence
  Description of Artificial Sequence: Synthetic coding sequence
MIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 14517 - protein, 344 aa, Artificial Sequence
  Description of Artificial Sequence: Synthetic coding sequence
MATPYVPVPMPIGNSASSFTTNRNQRSSSFGSVSTSSNSSKGQLEDSNMGNFKQTSVPDQMDNTSSVCSSPLIRTKFTGTASSIEYSTRPRDTEEQNPETVNWEDRPSTPTILGYEVMEERAKFTVYKILVKKTPEESWVVFRRYTDFSRLNDKLKEMFPGFRLALPPKRWFKDNYNADFLEDRQLGLQAFLQNLVAHKDIANCLAVREFLCLDDPPGPFDSLEESRAFCETLEETNYRLQKELLEKQKEMESLKKLLSEKQLHIDTLENRIRTLSLEPEESLDVSETEGEQILKVESSALEVDQDVLDEESRADNKPCLSFSEPENAVSEIEVAEVAYDAEED

SEQ ID NO: 14518 - protein, 315 aa, Artificial Sequence
  Description of Artificial Sequence: Synthetic coding sequence
MATPYVPVPMPIGNSASSFTTNRNQRSSSFGSVSTSSNSSKGQLEDSNMGNFKQTSVPDQMDNTSSVCSSPLIRTKFTGTASSIEYSTRPRDTEEQNPETVNWEDRPSTPTILGYEVMEERAKFTLKEMFPGFRLALPPKRWFKDNYNADFLEDRQLGLQAFLQNLVAHKDIANCLAVREFLCLDDPPGPFDSLEESRAFCETLEETNYRLQKELLEKQKEMESLKKLLSEKQLHIDTLENRIRTLSLEPEESLDVSETEGEQILKVESSALEVDQDVLDEESRADNKPCLSFSEPENAVSEIEVAEVAYDAEED

SEQ ID NO: 14519 - protein, 344 aa, Artificial Sequence; identical to SEQ ID NO: 14517
  Description of Artificial Sequence: Synthetic coding sequence

SEQ ID NO: 14520 - protein, 84 aa, Artificial Sequence
  Description of Artificial Sequence: Synthetic coding sequence
MATPYVPVPMPIGNSASSFTTNRNQRSSSFGSVSTSSNSSKGQLEDSNMGNFKQTSVPDQMDNTSSVCSSPLIRTKFTGTASSI

SEQ ID NO: 14521 - protein, 92 aa, Artificial Sequence
  Description of Artificial Sequence: Synthetic coding sequence
MATPYVPVPMPIGNSASSFTTNRNQRSSSFGSVSTSSNSSKGQLEDSNMGNFKQTSVPDQMDNTSSVCSSPLIRTKFTGTASSIEYSTRPRD

SEQ ID NO: 14522 - protein, 36 aa, Artificial Sequence
  Description of Artificial Sequence: Synthetic coding sequence
MATPYVPVPMPIGNSASSFTTNRNQRSSSFGSVSTS

SEQ ID NO: 14523 - protein, 203 aa, Artificial Sequence
  Description of Artificial Sequence: Synthetic coding sequence
MATPYVPVPMPIGNSASSFTTNRNQRSSSFGSVSTSSNSSKGQLEDSNMGNFKQTSVPDQMDNTSSVCSSPLIRTKFTGTASSIEYSTRPRDTEEQNPETVNWEDRPSTPTILGYEVMEERAKFTVYKILVKKTPEESWVVFRRYTDFSRLNDKLKEMFPGFRLALPPKRWFKDNYNADFLEDRQLGLQAFLQNLVAHKDIAN

SEQ ID NO: 14524 - protein, 628 aa, Artificial Sequence
  Description of Artificial Sequence: Synthetic coding sequence
MALRARALYDFRSENPGEISLREHEVLSLCSEQDIEGWLEGVNSRGDRGLFPASYVQVIRAPEPGPAGDGGPGAPARYANVPPGGFEPLPVAPPASFKPPPDAFQALLQPQQAPPPSTFQPPGAGFPYGGGALQPSPQQLYGGYQASQGSDDDWDDEWDDSSTVADEPGALGSGAYPDLDGSSSAGVGAAGRYRLSTRSDLSLGSRGGSVPPQHHPSGPKSSATVSRNLNRFSTFVKSGGEAFVLGEASGFVKDGDKLCVVLGPYGPEWQENPYPFQCTIDDPTKQTKFKGMKSYISYKLVPTHTQVPVHRRYKHFDWLYARLAEKFPVISVPHLPEKQATGRFEEDFISKRRKGLIWWMNHMASHPVLAQCDVFQHFLTCPSSTDEKAWKQGKRKAEKDEMVGANFFLTLSTPPAAALDLQEVESKIDGFKCFTKKMDDSALQLNHTANEFARKQVTGFKKEYQKVGQSFRGLSQAFELDQQAFSVGLNQAIAFTGDAYDAIGELFAEQPRQDLDPVMDLLALYQGHLANFPDIIHVQKGKAWPLEQVIWSVLCRLKGATLTAVPLWVSESYSTGEEASRDVDAWVFSLECKLDCSTGSFLLEYLALGNEYSFSKVQRVPLMTVLSF

SEQ ID NO: 14525 - protein, 591 aa, Artificial Sequence
  Description of Artificial Sequence: Synthetic coding sequence
MALRARALYDFRSENPGEISLREHEVLSLCSEQDIEGWLEGVNSRGDRGLFPASYVQVIRAPEPGPAGDGGPGAPARYANVPPGGFEPLPVAPPASFKPPPDAFQALLQPQQAPPPSTFQPPGAGFPYGGGALQPSPQQLYGGYQASQGSDDDWDDEWDDSSTVADEPGALGSGAYPDLDGSSSAGVGAAGRYRLSTRSDLSLGSRGGSVPPQHHPSGPKSSATVSRNLNRFSTFVKSGGEAFVLGEASGFVKDGDKLCVVLGPYGPEWQENPYPFQCTIDDPTKQTKFKGMKSYISYKLVPTHTQVPVHRRYKHFDWLYARLAEKFPVISVPHLPEKQATGRFEEDFISKRRKGLIWWMNHMASHPVLAQCDVFQHFLTCPSSTDEKAWKQGKRKAEKDEMVGANFFLTLSTPPAAALDLQEVESKIDGFKCFTKKMDDSALQLNHTANEFARKQVTGFKKEYQKVGQSFRGLSQAFELDQQAFSVGLNQAIAFTGDAYDAIGELFAEQPRQDLDPVMDLLALYQGHLANFPDIIHVQKGKAWPLEQVIWSVLCRLKGATLTAVPLWVSESYSTGEEASRDVDAWVFSLE

SEQ ID NO: 14526 - protein, 624 aa, Artificial Sequence
  Description of Artificial Sequence: Synthetic coding sequence
MALRARALYDFRSENPGEISLREHEVLSLCSEQDIEGWLEGVNSRGDRGLFPASYVQVIRAPEPGPAGDGGPGAPARYANVPPGGFEPLPVAPPASFKPPPDAFQALLQPQQAPPPSTFQPPGAGFPYGGGALQPSPQQLYGGYQASQGSDDDWDDEWDDSSTVADEPGALGSGAYPDLDGSSSAGVGAAGRYRLSTRSDLSLGSRGGSVPPQHHPSGPKSSATVSRNLNRFSTFVKSGGEAFVLGEASGFVKDGDKLCVVLGPYGPEWQENPYPFQCTIDDPTKQTKFKGMKSYISYKLVPTHTQVPVHRRYKHFDWLYARLAEKFPVISVPHLPEKQATGRFEEDFISKRRKGLIWWMNHMASHPVLAQCDVFQHFLTCPSSTDEKAWKQGKRKAEKDEMVGANFFLTLSTPPAAALDLQEVESKIDGFKCFTKKMDDSALQLNHTANEFARKQVTGFKKEYQKVGQSFRGLSQAFELDQQAFSVGLNQAIAFTGDAYDAIGELFAEQPRQDLDPVMDLLALYQGHLANFPDIIHVQKGALTKVKESRRHVEEGKMEVQKADGIQDRCNTISFATLAEIHHFHQIRVRDFKSQMQHFLQQQIIFFQKVTQKLEEALHKYDSV

SEQ ID NO: 14527 - protein, 992 aa, Artificial Sequence
  Description of Artificial Sequence: Synthetic coding sequence
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNVRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKYETALDGENSSGLQQLAYHTVNRRYREFLNLQTRLEEKPDLRKFIKNVKGPKKLFPDLPLGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGNVESETLSMSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRWLEVQVANLTSPQRWVQYLLLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 14528 - protein, 435 aa, Artificial Sequence
  Description of Artificial Sequence: Synthetic coding sequence
MYETALDGENSSGLQQLAYHTVNRRYREFLNLQTRLEEKPDLRKFIKNVKGPKKLFPDLPLGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGNVESETLSMSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRWLEVQVANLTSPQRWVQYLLLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 14529 - protein, 232 aa, Artificial Sequence
  Description of Artificial Sequence: Synthetic coding sequence
MSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRWLEVQVANLTSPQRWVQYLLLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 14530 - protein, 193 aa, Artificial Sequence
  Description of Artificial Sequence: Synthetic coding sequence
MLEVHIPSVGPEAEGPRQSPEKSHMVFRVEVLCSGRRHTVPRRYSEFHALHKRIKKLYKVPDFPSKRLPNWRTRGLEQRRQGLEAYIQGILYLNQEVPKELLEFLRLRHFPTDPKASNWGTLREFLPGDSSSQQHQRPVLSFHVDPYVCNPSPESLPNVVVNGVLQGLYSFSISPDKAQPKAACHPAPLPPMP

SEQ ID NO: 14531 - protein, 174 aa, Artificial Sequence
  Description of Artificial Sequence: Synthetic coding sequence
MLEVHIPSVGPEAEGPRQSPEKSHMIKKLYKVPDFPSKRLPNWRTRGLEQRRQGLEAYIQGILYLNQEVPKELLEFLRLRHFPTDPKASNWGTLREFLPGDSSSQQHQRPVLSFHVDPYVCNPSPGEEVPRYGATGLGCGLCISRLLGPSDSISFLLPTSGATTSCSCPLEPAL

SEQ ID NO: 14532 - protein, 169 aa, Artificial Sequence
  Description of Artificial Sequence: Synthetic coding sequence
MEVYIPSFRYEESDLERGYTVFKIEVLMNGRKHFVEKRYSEFHALHKKLKKCIKTPEIPSKHVRNWVPKVLEQRRQGLETYLQAVILENEELPKLFLDFLNVRHLPSLPKAESCGSFDETESEESSKLSHQPVLLFLRDPYVLPAASDFPNVVIEGVLHGIFYPHLQPR

SEQ ID NO: 14533 - protein, 159 aa, Artificial Sequence
  Description of Artificial Sequence: Synthetic coding sequence
MEVYIPSFRYEESDLERGYTVFKIEVLMNGRKHFVEKRYSEFHALHKKLKKCIKTPEIPSKHVRNWVPKVLEQRRQGLETYLQAVILENEELPKLFLDFLNVRHLPSLPKAESCGSFDETESEESSKLSHQPVLLFLRDPYVLPAASGNQTCHLLTALY

SEQ ID NO: 14534 - protein, 159 aa, Artificial Sequence; identical to SEQ ID NO: 14533
  Description of Artificial Sequence: Synthetic coding sequence

SEQ ID NO: 14535 - protein, 361 aa, Artificial Sequence [sequence omitted]

SEQ ID NO: 14536 - protein, 840 aa, Artificial Sequence
  Description of Artificial Sequence: Synthetic coding sequence
MDKALKEVFDYSYRDYILSWYGNLSRDEGQLYHLLLEDFWEIARQLHHRLSHVDVVKVVCNDVVRTLLTHFCDLKAANARHEEQPRPFVLHACLRNSDDEVRFLQTCSRVLVFCLLPSKDVQSLSLRIMLAEILTTKVLKPVVELLSNPDYINQMLLAQLAYREQMNEHHKRAYTYAPSYEDFIKLINSNSDVEFLKQLRYQIVVEIIQATTISSFPQLKRHKGKETAAMKADLLRARNMKRYINQLTVAKKQCEKRIRILGGPAYDQQEDGALDEGEGPQSQKILQFEDILANTFYREHFGMYMERMDKRALISFWESVEHLKNANKNEIPQLVGEIYQNFFVESKEISVEKSLYKEIQQCLVGNKGIEVFYKIQEDVYETLKDRYYPSFIVSDLYEKLLIKEEEKHASQMISNKDEMGPRDEAGEEAVDDGTNQINEQASFAVNKLRELNEKLEYKRQALNSIQNAPKPDKKIVSKLKDEIILIEKERTDLQLHMARTDWWCENLGMWKASITSGEVTEENGEQLPCYFVMVSLQEVGGVETKNWTVPRRLSEFQNLHRKLSECVPSLKKVQLPSLSKLPFKSIDQKFMEKSKNQLNKFLQNLLSDERLCQSEALYAFLSPSPDYLKVIDVQGKKNSFSLSSFLERLPRDFFSHQEEETEEDSDLSDYGDDVDGRKDALAEPCFMLIGEIFELRGMFKWVRRTLIALVQVTFGRTINKQIRDTVSWIFSEQMLVYYINIFRDAFWPNGKLAPPTTIRSKEQSQETKQRAQQKLLENIPDMLQSLVGQQNARHGIIKIFNALQETRANKHLLYALMELLLIELCPELRVHLDQLKAGQV

SEQ ID NO: 14537 - protein, 840 aa, Artificial Sequence; identical to SEQ ID NO: 14536
  Description of Artificial Sequence: Synthetic coding sequence

SEQ ID NO: 14538 - protein, 451 aa, Artificial Sequence
  Description of Artificial Sequence: Synthetic coding sequence
MEGERRASQAPSSGLPAGGANGESPGGGAPFPGSSGSSALLQAEVLDLDEDEDDLEVFSKDASLMDMNSFSPMMPTSPLSMINQIKFEDEPDLKDLFITVDEPESHVTTIETFITYRIITKTSRGEFDSSEFEVRRRYQDFLWLKGKLEEAHPTLIIPPLPEKFIVKGMVERFNDDFIETRRKALHKFLNRIADHPTLTFNEDFKIFLTAQAWELSSHKKQGPGLLSRMGQTVRAVASSMRGVKNRPEEFMEMNNFIELFSQKINLIDKISQRIYKEEREYFDEMKEYGPIHILWSASEEDLVDTLKDVASCIDRCCKATEKRMSGLSEALLPVVHEYVLYSEMLMGVMKRRDQIQAELDSKVEVLTYKKADTDLLPEEIGKLEDKVECANNALKADWERWKQNMQNDIKLAFTDMAEENIHYYEQCLATWESFLTSQTNLHLEEASEDKP

SEQ ID NO: 14539 - protein, 336 aa, Artificial Sequence
  Description of Artificial Sequence: Synthetic coding sequence
MDMNSFSPMMPTSPLSMINQIKFEDEPDLKDLFITVDEPESHVTTIETFITYRIITKTSRGEFDSSEFEVRRRYQDFLWLKGKLEEAHPTLIIPPLPEKFIVKGMVERFNDDFIETRRKALHKFLNRIADHPTLTFNEDFKIFLTAQAWELSSHKKQGPGLLSRMGQTVRAVASSMRGVKNRPEEFMEMNNFIELFSQKINLIDKISQRIYKEEREYFDEMKEYGPIHILWSASEEDLVDTLKDVASCIDRCCKATEKRMSGLSEALLPVVHEYVLYSEMLMGVMKRRDQIQAELDSKVEVLTYKKADTDLCLATWESFLTSQTNLHLEEASEDKP

SEQ ID NO: 14540 - protein, 396 aa, Artificial Sequence
  Description of Artificial Sequence: Synthetic coding sequence
MEGERRASQAPSSGLPAGGANGESPGGGAPFPGSSGSSALLQAEVLDLDEDEDDLEVFSKDASLMDMNSFSPMMPTSPLSMINQIKFEDEPDLKDLFITVDEPESHVTTIETFITYRIITKTSRGEFDSSEFEVRRRYQDFLWLKGKLEEAHPTLIIPELSSHKKQGPGLLSRMGQTVRAVASSMRGVKNRPEEFMEMNNFIELFSQKINLIDKISQRIYKEEREYFDEMKEYGPIHILWSASEEDLVDTLKDVASCIDRCCKATEKRMSGLSEALLPVVHEYVLYSEMLMGVMKRRDQIQAELDSKVEVLTYKKADTDLLPEEIGKLEDKVECANNALKADWERWKQNMQNDIKLAFTDMAEENIHYYEQCLATWESFLTSQTNLHLEEASEDKP

SEQ ID NO: 14541 - protein, 465 aa, Artificial Sequence
  Description of Artificial Sequence: Synthetic coding sequence
MTGRAMDPLPAAAVGAAAEAEADEEADPPASDLPTPQAIEPQAIVQQVPAPSRMQMPQGNPLLLSHTLQELLARDTVQVELIPEKKGLFLKHVEYEVSSQRFKSSVYRRYNDFVVFQEMLLHKFPYRMVPALPPKRMLGADREFIEARRRALKRFVNLVARHPLFSEDVVLKLFLSFSGSDVQNKLKESAQCVGDEFLNCKLATRAKDFLPADIQAQFAISRELIRNIYNSFHKLRDRAERIASRAIDNAADLLIFGKELSAIGSDTTPLPSWAALNSSTWGSLKQALKGLSVEFALLADKAAQQGKQEENDVVEKLNLFLDLLQSYKDLCERHEKGVLHKHQRALHKYSLMKRQMMSATAQNREPESVEQLESRIVEQENAIQTMELRNYFSLYCLHQETQLIHVYLPLTSHILRAFVNSQIQGHKEMSKVWNDLRPKLSCLFAGPHSTLTPPCSPPEDGLCPH

SEQ ID NO: 14542 - protein, 42 aa, Artificial Sequence
  Description of Artificial Sequence: Synthetic coding sequence
MQMPQGNPLLLSHTLQELLARDTVQVELIPEKKGLFLKHVEY

SEQ ID NO: 14543 - protein, 176 aa, Artificial Sequence
  Description of Artificial Sequence: Synthetic coding sequence
MQMPQGNPLLLSHTLQELLARDTVQVELIPEKKGLFLKHVEYEVSSQRFKSSVYRRYNDFVVFQEMLLHKFPYRMVPALPPKRMLGADREFIEARRRALKRFVNLVARHPLFSEDVVLKLFLSFSGSDVQNKLKESAQCVGDEFLNCKLATRAKDFLPADIQAQFAISRELIRNIY

SEQ ID NO: 14544 - protein, 199 aa, Artificial Sequence
  Description of Artificial Sequence: Synthetic coding sequence
MHRGTQEGAMASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVLYTLAVIGPGPPDCQPAQISRRYSDFERLHRNLQRQFRGPMAAISFPQSH

SEQ ID NO: 14545 - protein, 150 aa, Artificial Sequence
  Description of Artificial Sequence: Synthetic coding sequence
MASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVTPTLSSTPSP

SEQ ID NO: 14546 - protein, 158 aa, Artificial Sequence
  Description of Artificial Sequence: Synthetic coding sequence
MHRGTQEGAMASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVTNLSSTPSP

SEQ ID NO: 14547 - protein, 373 aa, Artificial Sequence
  Description of Artificial Sequence: Synthetic coding sequence
MHRGTQEGAMASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVLYTLAVIGPGPPDCQPAQISRRYSDFERLHRNLQRQFRGPMAAISFPRKRLRRNFTAETIARRSRAFEQFLGHLQAVPELRHAPDLQDFFVLPELRRAQSLTCTGLYREALALWANAWQLQAQLGTPSGPDRPLLTLAGLAVCHQELEDPGEARACCEKALQLLGDKSLHPLLAPFLEAHVRLSWRLGLDKRQSEARLQALQEAGLTPTPPPSLKELLIKEVLD

SEQ ID NO: 14548 - protein, 97 aa, Artificial Sequence
  Description of Artificial Sequence: Synthetic coding sequence
MDKQSSAGGVKRSVPCDSNEANEMMPETSSGYSDPQPAPKKLKTSESSTILVVRYRRNFKRTSPEELVNDHARKNRINPLQMEEEEFMEIMVEIPAK

SEQ ID NO: 14549 - protein, 1256 aa, Artificial Sequence
  Description of Artificial Sequence: Synthetic coding sequence
MDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREVGMDPISCVILELSMICTGGGVICALEDTCC

SEQ ID NO: 14550 - protein, 1084 aa, Artificial Sequence
  Description of Artificial Sequence: Synthetic coding sequence
MNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 14551 - protein, 1259 aa, Artificial Sequence
  Description of Artificial Sequence: Synthetic coding sequence
MDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 14552 - protein, 172 aa, Artificial Sequence
  Description of Artificial Sequence: Synthetic coding sequence
MPVGAGLPTSLTSPPSTEAPKSSLLRKQTQPPKKQSSPAVHLRCTMDPVMMTVSPPPAHRHRRRGSPTRCAHCPVAWAPDTDDEKPHQYPAICSYHWDVPEDWEGFQHTQGTWVPWSQDAPESPPQTIRFQPGRQSETPSKKKKKKKKKRNIGAPLKRYLTVTSQLSVTSLL

SEQ ID NO: 14553 - protein, 309 aa, Artificial Sequence
  Description of Artificial Sequence: Synthetic coding sequence
MAMVERPRPEWASYHNCNSNSCQDLGNSVLLLLGLIICINISINIVTLLWSRFRGVLYQVFHDTICEKEAPKSSLLRKQTQPPKKQSSPAVHLRCTMDPVMMTVSPPPAHRHRRRGSPTRCAHCPVAWAPDTDDEKPHQYPAICSYHWDVPEDWEGFQHTQGTWVPWSQDAPESPPQTIRFQPTVEERPLKTGIWSELGLRAYVYPVNPPPPSPEAPSHKNGGEGAVPEAEAAQYQPVPAPTLGPAVIPEFSRHRSSGRIVYDARDMRRRLRELTREVEALSGCYPLASGSSTAEETSKNWVYRSLTGR

SEQ ID NO: 14554 - protein, 328 aa, Artificial Sequence
  Description of Artificial Sequence: Synthetic coding sequence
MASRCSEPYPEVSRIPTVRGCNGSLSGALSCCEDSARGSGPPKAPTVAEGPSSCLRRNVISERERRKRMSLSCERLRALLPQFDGRREDMASVLEMSVQFLRLASALGPSQEQHAILASSKEMWHSLQEDVLQLTLSSQIQAGVPDPGTGASSGTRTPDVKAFLESPWSLDPASASPEPVPHILASSRQWDPASCTSLGTDKCEALLGLCQVRGGLPPFSEPSSLVPWPPGRSLPKAVRPPLSWPPFSQQQTLPVMSGEALGWLGQAGPLAMGAAPLGEPAKEDPMLAQEAGSALGSDVDDGTSFLLTAGPSSWPGEWGPGFRAGPPA

SEQ ID NO: 14555 - protein, 387 aa, Artificial Sequence
  Description of Artificial Sequence: Synthetic coding sequence
MASRCSEPYPEVSRIPTVRGCNGSLSGALSCCEDSARGSGPPKAPTVAEGPSSCLRRNVISERERRKRMSLSCERLRALLPQFDGRREDMASVLEMSVQFLRLASALGPSQEQHAILASSKEMWHSLQEDVLQLTLSSQIQAGVPDPGTGASSGTRTPDVKAFLESPWSLDPASASPEPVPHILASSRQWDPASCTSLGTDKCEALLGLCQVRGGLPPFSEPSSLVPWPPGRSLPKAVRPPLSWPPFSQQQTLPVMSGEALGWLGQAGPLAMGAAPLGEPAKEDPMLAQEAGSALGSDVDDGTSFLLTAGPSSWPGSLEGRGGSGPAWAPAESSPLDVGEPGFLGDPELGSQELQDSPLEPWGLDVDCAGLALKDEVESIFPDFFAC

SEQ ID NO: 14556 - protein, 227 aa, Artificial Sequence
  Description of Artificial Sequence: Synthetic coding sequence
MSYFRTPQTHPGPLPSGQGGAASPGLSLGLCSPVEPVVVASGGTGPLSQKAEQVAPAAQAWGPALAMPQARGCPGGTSWETLRKEYSRNCHKFPHVRQLESLGWDNGYSRSRAPDLGGPSRPRPLMLCGLSPRVLPVPSEAVGKEASSQPDICILTLAMMIAGIPTVPVPGVREEDLIWAAQAFMMAHPEPEGAVEGARWEQAHAHTASGKMPLVRSKRGQPPGSCL

SEQ ID NO: 14557 - protein, 254 aa, Artificial Sequence
  Description of Artificial Sequence: Synthetic coding sequence
MPIKPVGWICGQVLKNFSGRIEGIQKAIMDLVDEFKDEFPTILRLSQSNQKREPAQKTSKIRMAIALAKINRATLIRGLNSISRSSKSVAKLLHPQLACRLLELRDISGRLLREVNAPRQPLYNIQVRKGSLFEIISFPAKTALTSIIYASYAALIYLAVCVNAVLKKVKNIFQEEESIRQNREESENCRKAFSEPVLSEPMFAEGEIKAKPYRSLPEKPDISDYPKLLANKQSNNIQVLHSVFDQSAEMNEQI

SEQ ID NO: 14558 - protein, 254 aa, Artificial Sequence; identical to SEQ ID NO: 14557
  Description of Artificial Sequence: Synthetic coding sequence

SEQ ID NO: 14559 - protein, 135 aa, Artificial Sequence
  Description of Artificial Sequence: Synthetic coding sequence
MPIKPVGWICGQVLKNFSGRIEGIQKAIMDLVDEFKDEFPTILRLSQSNQKREPAQKTSKIRMAIALAKINRATLIRGLNSISRSSKSVAKLLHPQLACRLLELRDISGRLLREVNAPRQPLYNIQEKKMGLQLS

SEQ ID NO: 14560 - protein, 423 aa, Artificial Sequence
  Description of Artificial Sequence: Synthetic coding sequence
MKPNFSLRLRIFNLNCWGIPYLSKHRADRMRRLGDFLNQESFDLALLEEVWSEQDFQYLRQKLSPTYPAAHHFRSGIIGSGLCVFSKHPIQELTQHIYTLNGYPYMIHHGDWFSGKAVGLLVLHLSGMVLNAYVTHLHAEYNRQKDIYLAHRVAQAWELAQFIHHTSKKADVVLLCGDLNMHPEDLGCCLLKEWTGLHDAYLETRDFKGSEEGNTMVPKNCYVSQQELKPFPFGVRIDYVLYKAVSGFYISCKSFETTTGFDPHRGTPLSDHEALMATLFVRHSPPQQNPSSTHGPAERSPLMCVLKEAWTELGLGMAQARWWATFASYVIGLGLLLLALLCVLAAGGGAGEAAILLWTPSVGLVLWAGAFYLFHVQEVNGLYRAQAELQHVLGRAREAQDLGPEPQPALLLGQQEGDRTKEQ

SEQ ID NO: 14561 - protein, 655 aa, Artificial Sequence
  Description of Artificial Sequence: Synthetic coding sequence
MVLYTTPFPNSCLSALHCVSWALIFPCYWLVDRLAASFIPTTYEKRQRADDPCCLQLLCTALFTPIYLALLVASLPFAFLGFLFWSPLQSARRPYIYSRLEDKGLAGGAALLSEWKGTGPGKSFCFATANVCLLPDSLARVNNLFNTQARAKEIGQRIRNGAARPQIKIYIDSPTNTSISAASFSSLVSPQGGDGVARAVPGSIKRTASVEYKGDGGRHPGDEAANGPASGDPVDSSSPEDACIVRIGGEEGGRPPEADDPVPGGQARNGAGGGPRGQTPNHNQQDGDSGSLGSPSASRESLVKGRAGPDTSASGEPGANSKLLYKASVVKKAAARRRRHPDEAFDHEVSAFFPANLDFLCLQEVFDKRAATKLKEQLHGYFEYILYDVGVYGCQGCCSFKCLNSGLLFASRYPIMDVAYHCYPNKCNDDALASKGALFLKVQVGSTPQDQRIVGYIACTHLHAPQEDSAIRCGQLDLLQDWLADFRKSTSSSSAANPEELVAFDVVCGDFNFDNCSSDDKLEQQHSLFTHYRDPCRLGPGEEKPWAIGTLLDTNGLYDEDVCTPDNLQKVLESEEGRREYLAFPTSKSSGQKGRKELLKGNGRRIDYMLHAEEGLCPDWKAEVEEFSFITQLSGLTDHLPVAMRLMVSSGEEEA

SEQ ID NO: 14562 - protein, 724 aa, Artificial Sequence
  Description of Artificial Sequence: Synthetic coding sequence
MAGRKHFWQPRWCPRWLEPPLLTGARESCGVQHRDGISRPWGPVKASIQECILPDSPLYHNKVQFTPTGGLGLNLALNPFEYYIFFFALSLITQKPLPVSLHVRTSDCAYFILVDRYLSWFLPTEGSVPPPLSSSPGGTSPSPPPRTPAIPFASYGLHHTSLLKRHISHQTSVNADPASHEIWRSETLLQVFVEMWLHHYSLEMYQKMQSPHAKESFTPTEEHVLVVRLLLKHLHAFANSLKPEQASPSAHSHATSPLEEFKRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 14563 - protein, 837 aa, Artificial Sequence
  Description of Artificial Sequence: Synthetic coding sequence
MTTFGAVAEWRLPSLRRATLWIPQWFAKKAIFNSPLEAAMAFPHLQQPSFLLASLKADSINKPFAQQCQDLVKVIEDFPAKELHTIFPWLVESIFGSLDGVLVGWNLRCLQGRVNPVEYSIVMEFLDPGGPMMKLVYKLQAEDYKFDFPVSYLPGPVKASIQECILPDSPLYHNKVQFTPTGGLGLNLALNPFEYYIFFFALSLITQKPLPVSLHVRTSDCAYFILVDRYLSWFLPTEGSVPPPLSSSPGGTSPSPPPRTPAIPFASYGLHHTSLLKRHISHQTSVNADPASHEIWRSETLLQVFVEMWLHHYSLEMYQKMQSPHAKESFTPTEEHVLVVRLLLKHLHAFANSLKPEQASPSAHSHATSPLEEFKRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 14564 - protein, 866 aa, Artificial Sequence
  Description of Artificial Sequence: Synthetic coding sequence
MTTFGAVAEWRLPSLRRATLWIPQWFAKKAIFNSPLEAAMAFPHLQQPSFLLASLKADSINKPFAQQCQDLVKVIEDFPAKELHTIFPWLVESIFGSLDGVLVGWNLRCLQGRVNPVEYSIVMEFLDPGGPMMKLVYKLQAEDYKFDFPVSYLPGPVKASIQECILPDSPLYHNKVQFTPTGGLGLNLALNPFEYYIFFFALSLITQKPLPVSLHVRTSDCAYFILVDRYLSWFLPTEGSVPPPLSSSPGGTSPSPPPRTPAIPFASYGLHHTSLLKRHISHQTSVNADPASHEIWRSETLLQVFVEMWLHHYSLEMYQKMQSPHAKLEVLHYRLSVSSALYSPAQPSLQALHAYQESFTPTEEHVLVVRLLLKHLHAFANSLKPEQASPSAHSHATSPLEEFKRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 14565 - protein, 502 aa, Artificial Sequence
  Description of Artificial Sequence: Synthetic coding sequence
MQTPPPTRSGGQKLCSRFLLKCGFITIPWRCIKKCSPLMPRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 14566 - protein, 764 aa, Artificial Sequence
  Description of Artificial Sequence: Synthetic coding sequence
MTTFGAVAEWRLPSLRRATLWIPQWFAKKAIFNSPLEAAMAFPHLQQPSFLLASLKADSINKPFAQQCQDLVKVIEDFPAKGPVKASIQECILPDSPLYHNKVQFTPTGGLGLNLALNPFEYYIFFFALSLITQKPLPVSLHVRTSDCAYFILVDRYLSWFLPTEGSVPPPLSSSPGGTSPSPPPRTPAIPFASYGLHHTSLLKRHISHQTSVNADPASHEIWRSETLLQVFVEMWLHHYSLEMYQKMQSPHAKESFTPTEEHVLVVRLLLKHLHAFANSLKPEQASPSAHSHATSPLEEFKRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 14567 - protein, 530 aa, Artificial Sequence
  Description of Artificial Sequence: Synthetic coding sequence
MWLHHYSLEMYQKMQSPHAKESFTPTEEHVLVVRLLLKHLHAFANSLKPEQASPSAHSHATSPLEEFKRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 14568 - protein, 607 aa, Artificial Sequence
  Description of Artificial Sequence: Synthetic coding sequence
MQTPPPTRSGGQKLCSRFLLKCGFITIPWRCIKKCSPLMPSWRFCTTDSVSPAPSTAPPNPASRPSTPTKSLGNRGSDARGFYWAEFSSGCVQDEEQESFTPTEEHVLVVRLLLKHLHAFANSLKPEQASPSAHSHATSPLEEFKRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 14569 - protein, 615 aa, Artificial Sequence
  Description of Artificial Sequence: Synthetic coding sequence
MTTFGAVAEWRLPSLRRATLWIPQWFAKKAIFNSPLEAAMAFPHLQQPSFLLASLKADSINKPFAQQCQDLVKVIEDFPAKVFVEMWLHHYSLEMYQKMQSPHAKESFTPTEEHVLVVRLLLKHLHAFANSLKPEQASPSAHSHATSPLEEFKRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 14570 - protein, 202 aa, Artificial Sequence
  Description of Artificial Sequence: Synthetic coding sequence
ILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCEALFLFCFSNMLAP

SEQ ID NO: 14571 - protein, 568 aa, Artificial Sequence
  Description of Artificial Sequence: Synthetic coding sequence
MPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVTSGGTESILMACKAYRDLAFEKGIKTPEIVAPQSAHAAFNKAASYFGMKIVRVPLTKMMEVDVRAMRRAISRNTAMLVCSTPQFPHGVIDPVPEVAKLAVKYKIPLHVDACLGGFLIVFMEKAGYPLEHPFDFRVKGVTSISADTHKYGYAPKGSSLVLYSDKKYRNYQFFVDTDWQGGIYASPTIAGSRPGGISAACWAALMHFGENGYVEATKQIIKTARFLKSELENIKGIFVFGNPQLSVIALGSRDFDIYRLSNLMTAKGWNLNQLQFPPSIHFCITLLHARKRVAIQFLKDIRESVTQIMKNPKAKTTGMGAIYGMAQTTVDRNMVAELSSVFLDSLYSTDTVTQGSQMNGSPKPH

SEQ ID NO: 14572 - protein, 135 aa, Artificial Sequence
  Description of Artificial Sequence: Synthetic coding sequence
  MOD_RES (1)..(1): Any amino acid
XIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVSICKGHPIALFFRLK

SEQ ID NO: 14573 - protein, 545 aa, Artificial Sequence
  Description of Artificial Sequence: Synthetic coding sequence
METELCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 14574 - protein, 458 aa, Artificial Sequence
  Description of Artificial Sequence: Synthetic coding sequence
MANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKSDCLFNGTAHCQFYLG

SEQ ID NO: 14575 - protein, 756 aa, Artificial Sequence
  Description of Artificial Sequence: Synthetic coding sequence
MAQAAGPAGGGEPRTEAVGGEGPREPGAAGGAAGGSRDALSLEEILRLYNQPINEEQAWAVCYQCCGSLRAAARRRQPRHRVRSAAQIRVWRDGAVTLAPAADDAGEPPPVAGKLGYSQCMETEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLAMRPLSMSYSFDLSDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 14576 - protein, 742 aa, Artificial Sequence
  Description of Artificial Sequence: Synthetic coding sequence
MAQAAGPAGGGEPRTEAVGGEGPREPGAAGGAAGGSRDALSLEEILRLYNQPINEEQAWAVCYQCCGSLRAAARRRQPRHRVRSAAQIRVWRDGAVTLAPAADDAGEPPPVAGKLGYSQCMETEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 14577 - protein, 622 aa, Artificial Sequence
  Description of Artificial Sequence: Synthetic coding sequence
METEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 14578 - protein, 207 aa, Artificial Sequence
  Description of Artificial Sequence: Synthetic coding sequence
MALLFARSLRLCRWGAKRLGVASTEAQRGVSFKLEEKTAHSSLALFRDDMGVKYGLVGLEPTKVALNVERFREWAVVLADTAVTSGRHYWEVTVKRSQQFRIGVADVDMSRDSCIGVDDRSWVFTYAQRKWYTMLANEKAPVEGIGQPEKVGLLLEYEAQKLSLVDVSQVSVVHTLQTDFRGPVVPAFALWDGELLTHSGLEVPEGL

SEQ ID NO: 14579 - protein, 129 aa, Artificial Sequence [sequence omitted]

SEQ ID NO: 14580 - protein, 418 aa, Artificial Sequence
  Description of Artificial Sequence: Synthetic coding sequence
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 14581 - protein, 123 aa, Artificial Sequence
  Description of Artificial Sequence: Synthetic coding sequence
MYEIAAPNVAFMTLRSMCNTSKMVTCAKIFFYFLVFFSLSQNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 14582 - protein, 390 aa, Artificial Sequence
  Description of Artificial Sequence: Synthetic coding sequence
MPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 14583 - protein, 395 aa, Artificial Sequence
  Description of Artificial Sequence: Synthetic coding sequence
MASVPMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 14584 - protein, 139 aa, Artificial Sequence
  Description of Artificial Sequence: Synthetic coding sequence
MPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKF

SEQ ID NO: 14585 - protein, 220 aa, Artificial Sequence
  Description of Artificial Sequence: Synthetic coding sequence
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKTLSPCGWHCVQLIMARWTQPLLHRLLSDSADLHRAFKGSRALPAEAFSEPRHQHLQTESFLSLVLLPAFQAFLGYLRAPEGAALALRHFLLSCELWASSGGGREQLKQMPVQLT

SEQ ID NO: 14586 - protein, 600 aa, Artificial Sequence
  Description of Artificial Sequence: Synthetic coding sequence
MRSCLWRCRHLSQGVQWSLLLAVLVFFLFALPSFIKEPQTKPSRHQRTENIKERSLQSLAKPKSQAPTRARRTTIYAEPVPENNALNTQTQPKAHTTGDRGKEANQAPPEEQDKVPHTAQRAAWKSPEKEKTMVNTLSPRGQDAGMASGRTEAQSWKSQDTKTTQGNGGQTRKLTASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHMGQEIDSHDYVFRLSGALIKGYEQDVGTRTSFYGFTAFSLTQSLLILGNRGFKNVPLGKDVRYLHFLEGTRDYEWLEALLMNQTVMSKNLFWFRHRPQEAFREALHMDRYLLLHPDFLRYMKNRFLRSKTLDGAHWRIYRPTTGALLLLTALQLCDQVSAYGFITEGHERFSDHYYDTSWKRLIFYINHDFKLEREVWKRLHDEGIIRLYQRPGPGTAKAKN

SEQ ID NO: 14587 - protein, 471 aa, Artificial Sequence
  Description of Artificial Sequence: Synthetic coding sequence
MRSCLWRCRHLSQGVQWSLLLAVLVFFLFALPSFIKEPQTKPSRHQRTENIKERSLQSLAKPKSQAPTRARRTTIYAEPVPENNALNTQTQPKAHTTGDRGKEANQAPPEEQDKVPHTAQRAAWKSPEKEKTMVNTLSPRGQDAGMASGRTEAQSWKSQDTKTTQGNGGQTRKLTASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHMGQEIDSHDYVFRLSGALIKGYEQDVGTRTSFYGFTAFSLTQSLLILGNRGFKNVPLGKAQTPGSFSGSPAHGQVPVAAPRLSPIHEEQVSEV

SEQ ID NO: 14588 - protein, 374 aa, Artificial Sequence
  Description of Artificial Sequence: Synthetic coding sequence
MGLPRGSFFWLLLLLTAACSGLLFALYFSAVQRYPGPAAGARDTTSFEAFFQSKASNSWTGKGQACRHLLHLAIQRHPHFRGLFNLSIPVLLWGDLFTPALWDRLSQHKAPYGWRGLSHQVIASTLSLLNGSESAKLFAPPRDTPPKCIRCAVVGNGGILNGSRQGPNIDAHDYVFRLNGAVIKGFERDVGTKTSFYGFTVNTMKNSLVSYWNLGFTSVPQGQDLQYIFIPSDIRDYVMLRSAILGVPVPEGLDKGDRPHAYFGPEASASKFKLLHPDFISYLTERFLKSKLINTHFGDLYMPSTGALMLLTALHTCDQVSAYGFITSNYWKFSDHYFERKMKPLIFYANHDLSLEAALWRDLHKAGILQLYQR

SEQ ID NO: 14589 - protein, 305 aa, Artificial Sequence
  Description of Artificial Sequence: Synthetic coding sequence
MACILKRKSVIAVSFIAAFLFLLVVRLVNEVNFPLLLNCFGQPGTKWIPFSYTYRRPLRTHYGYINVKTQEPLQLDCDLCAIVSNSGQMVGQKVGNEIDRSSCIWRMNNAPTKGYEEDVGRMTMIRVVSHTSVPLLLKNPDYFFKEANTTIYVIWGPFRNMRKDGNGIVYNMLKKTVGIYPNAQIYVTTEKRMSYCDGVFKKETGKDRVQSGSYLSTGWFTFLLAMDACYGIHVYGMINDTYCKTEGYRKVPYHYYEQGRDECDEYFLHEHAPYGGHRFITEKKVFAKWAKKHRIIFTHPNWTLS

SEQ ID NO: 14590 - protein, 304 aa, Artificial Sequence
  Description of Artificial Sequence: Synthetic coding sequence
VCIRKRKSVIAVSFIAAFLFLLVVRLVNEVNFPLLLNCFGQPGTKWIPFSYTYRRPLRTHYGYINVKTQEPLQLDCDLCAIVSNSGQMVGQKVGNEIDRSSCIWRMNNAPTKGYEEDVGRMTMIRVVSHTSVPLLLKNPDYFFKEANTTIYVIWGPFRNMRKDGNGIVYNMLKKTVGIYPNAQIYVTTEKRMSYCDGVFKKETGKDRVQSGSYLSTGWFTFLLAMDACYGIHVYGMINDTYCKTEGYRKVPYHYYEQGRDECDEYFLHEHAPYGGHRFITEKKVFAKWAKKHRIIFTHPNWTLS

SEQ ID NO: 14591 - protein, 210 aa, Artificial Sequence
  Description of Artificial Sequence: Synthetic coding sequence
MACILKVTTWIAVSFIAAFLFLLVVRLVNEVNFPLLLNCFGQPGTKWIPFSYTYRRPLRTHYGYINVKTQEPLQLDCDLCAIVSNSGQMVGQKVGNEIDRSSCIWRMNNAPTKGYEEDVGRMTMIRVVSHTSVPLLLKNPDYFFKEANTTIYVIWGPFRNMRKDGNGIVYNMLKKTVGIYPNAQIYVTTEKRMSYCDGVFKKETGKDSTE

SEQ ID NO: 14592 - protein, 203 aa, Artificial Sequence
  Description of Artificial Sequence: Synthetic coding sequence
FSIFQPLQLDCDLCAIVSNSGQMVGQKVGNEIDRSSCIWRMNNAPTKGYEEDVGRMTMIRVVSHTSVPLLLKNPDYFFKEANTTIYVIWGPFRNMRKDGNGIVYNMLKKTVGIYPNAQIYVTTEKRMSYCDGVFKKETGKDRTEGYRKVPYHYYEQGRDECDEYFLHEHAPYGGHRFITEKKVFAKWAKKHRIIFTHPNWTLS

SEQ ID NO: 14593 - protein, 302 aa, Artificial Sequence
  Description of Artificial Sequence: Synthetic coding sequence
MKAPGRLVLIILCSVVFSAVYILLCCWAGLPLCLATCLDHHFPTGSRPTVPGPLHFSGYSSVPDGKPLVREPCRSCAVVSSSGQMLGSGLGAEIDSAECVFRMNQAPTVGFEADVGQRSTLRVVSHTSVPLLLRNYSHYFQKARDTLYMVWGQGRHMDRVLGGRTYRTLLQLTRMYPGLQVYTFTERMMAYCDQIFQDETGKNRRQSGSFLSTGWFTMILALELCEEIVVYGMVSDSYCREKSHPSVPYHYFEKGRLDECQMYLAHEQAPRSAHRFITEKAVFSRWAKKRPIVFAHPSWRTE

SEQ ID NO: 14594 - protein, 218 aa, Artificial Sequence
  Description of Artificial Sequence: Synthetic coding sequence
MLGSGLGAEIDSAECVFRMNQAPTVGFEADVGQRSTLRVVSHTSVPLLLRNYSHYFQKARDTLYMVWGQGRHMDRVLGGRTYRTLLQLTRMYPGLQVYTFTERMMAYCDQIFQDETGKNRRQSGSFLSTGWFTMILALELCEEIVVYGMVSDSYCREKSHPSVPYHYFEKGRLDECQMYLAHEQAPRSAHRFITEKAVFSRWAKKRPIVFAHPSWRTE

SEQ ID NO: 14595 - protein, 201 aa, Artificial Sequence
  Description of Artificial Sequence: Synthetic coding sequence
MLGSGLGAEIDSAECVFRMNQAPTVGFEADVGQRSTLRVVSHTSVPLLLRNYSHYFQKARDTLYMVWGQGRHMDRVLGGRTYRTLLQLTRMYPGLQVYTFTERMMAYCDQIFQDETGKNRRQSGSFLSTGWFTMILALELCEEIVVYGMVSDSYCREKSHPSVPYHYFEKGRLDECQMYLAHEQAPRSAHRFITEKAVFSR

SEQ ID NO: 14596 - protein, 218 aa, Artificial Sequence; identical to SEQ ID NO: 14594
  Description of Artificial Sequence: Synthetic coding sequence

SEQ ID NO: 14597 - protein, 333 aa, Artificial Sequence
  Description of Artificial Sequence: Synthetic coding sequence
MACSRPPSQCEPTSLPPGPPAGRRHLPLSRRRREMSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 14598 - protein, 299 aa, Artificial Sequence
  Description of Artificial Sequence: Synthetic coding sequence
MSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 14599 - protein, 374 aa, Artificial Sequence
  Description of Artificial Sequence: Synthetic coding sequence
MACSRPPSQCEPTSLPPGPPAGRRHLPLSRRRREMSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSGPASSACPTTTTSPRGRTNVSPTSRMSTVARATTTASSPRKGSSHRGPSCMASPSPTPPGPRPPSLWDLRRVRGEAASAQPLGQGPSSGQSRLAGVSPSQSGP

SEQ ID NO: 14600 - protein, 299 aa, Artificial Sequence; identical to SEQ ID NO: 14598
  Description of Artificial Sequence: Synthetic coding sequence

SEQ ID NO: 14601 - protein, 333 aa, Artificial Sequence; identical to SEQ ID NO: 14597
  Description of Artificial Sequence: Synthetic coding sequence

SEQ ID NO: 14602 - protein, 200 aa, Artificial Sequence
  Description of Artificial Sequence: Synthetic coding sequence
MSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKD

SEQ ID NO: 14603 - protein, 133 aa, Artificial Sequence
  Description of Artificial Sequence: Synthetic coding sequence
MRSSITAPCGAVAADLSTSRSGASLTAMSPFSATREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 14604 - protein, 529 aa, Artificial Sequence
  Description of Artificial Sequence: Synthetic coding sequence
MKPHLKQWRQRMLFGIFAWGLLFLLIFIYFTDSNPAEPVPSSLSFLETRRLLPVQGKQRAIMGAAHEPSPPGGLDARQALPRAHPAGSFHAGPGDLQKWAQSQDGFEHKEFFSSQVGRKSQSAFYPEDDDYFFAAGQPGWHSHTQGTLGFPSPGEPGPREGAFPAAQVQRRRVKKRHRRQRRSHVLEEGDDGDRLYSSMSRAFLYRLWKGNVSSKMLNPRLQKAMKDYLTANKHGVRFRGKREAGLSRAQLLCQLRSRARVRTLDGTEAPFSALGWRRLVPAVPLSQLHPRGLRSCAVVMSAGAILNSSLGEEIDSHDAVLRFNSAPTRGYEKDVGNKTTIRIINSQILTNPSHHFIDSSLYKDVILVAWDPAPYSANLNLWYKKPDYNLFTPYIQHRQRNPNQPFYILHPKFIWQLWDIIQENTKEKIQPNPPSSGFIGILIMMSMCREVHVYEYIPSVRQTELCHYHELYYDAACTLGAYHPLLYEKLLVQRLNMGTQGDLHRKGKVVLPGFQAVHCPAPSPVIPHS

SEQ ID NO: 14605 - protein, 95 aa, Artificial Sequence
  Description of Artificial Sequence: Synthetic coding sequence
  MOD_RES (1)..(1): Any amino acid
XSGFIGILIMMSMCREVHVYEYIPSVRQTELCHYHELYYDAACTLGAYHPLLYEKLLVQRLNMGTQGDLHRKGKVVLPGFQAVHCPAPSPVIPHS

SEQ ID NO: 14606 - protein, 466 aa, Artificial Sequence
  Description of Artificial Sequence: Synthetic coding sequence
MKPHLKQWRQRMLFGIFAWGLLFLLIFIYFTDSNPAEPVPSSLSFLETRRLLPVQGKQRAIMGAAHEPSPPGGLDARQALPRAHPAGSFHAGPGDLQKWAQSQDGFEHKEFFSSQVGRKSQSAFYPEDDDYFFAAGQPGWHSHTQGTLGFPSPGEPGPREGAFPAAQVQRRRVKKRHRRQRRSHVLEEGDDGDRLYSSMSRAFLYRLWKGNVSSKMLNPRLQKAMKDYLTANKHGVRFRGKREAGLSRAQLLCQLRSRARVRTLDGTEAPFSALGWRRLVPAVPLSQLHPRGLRSCAVVMSAGAILNSSLGEEIDSHDAVLRFNSAPTRGYEKDVGNKTTIRIINSQILTNPSHHFIDSSLYKDVILVAWDPAPYSANLNLWYKKPDYNLFTPYIQHRQRNPNQPFYILHPKFIWQLWDIIQENTKEKIQPNPPSSGFIGSFVKIGHIRACSEPRSRDCTPAWTTE

SEQ ID NO: 14607 - protein, 529 aa, Artificial Sequence; identical to SEQ ID NO: 14604
  Description of Artificial Sequence: Synthetic coding sequence

SEQ ID NO: 14608 - protein, 35 aa, Artificial Sequence
  Description of Artificial Sequence: Synthetic coding sequence
MKPHLKQWRQRMLFGIFAWGLLFLLIFIYFTDSNP

SEQ ID NO: 14609 - protein, 356 aa, Artificial Sequence
  Description of Artificial Sequence: Synthetic coding sequence
MSPCGRARRQTSRGAMAVLAWKFPRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQATPFQLPLKKCAVVGNGGILKKSGCGRQIDEANFVMRCNLPPLSSEYTKDVGSKSQLVTANPSIIRQRFQNLLWSRKTFVDNMKIYNHSYIYMPAFSMKTGTEPSLRVYYTLSDVGANQTVLFANPNFLRSIGKFWKSRGIHAKRLSTGLFLVSAALGLCEEVAIYGFWPFSVNMHEQPISHHYYDNVLPFSGFHAMPEEFLQLWYLHKIGALRMQLDPCEDTSLQPTS

SEQ ID NO: 14610 - protein, 213 aa, Artificial Sequence
  Description of Artificial Sequence: Synthetic coding sequence
MTGSFYTHSPLTIQLTLSSHRCNLPPLSSEYTKDVGSKSQLVTANPSIIRQRFQNLLWSRKTFVDNMKIYNHSYIYMPAFSMKTGTEPSLRVYYTLSDVGANQTVLFANPNFLRSIGKFWKSRGIHAKRLSTGLFLVSAALGLCEEVAIYGFWPFSVNMHEQPISHHYYDNVLPFSGFHAMPEEFLQLWYLHKIGALRMQLDPCEDTSLQPTS

SEQ ID NO: 14611 - protein, 375 aa, Artificial Sequence
  Description of Artificial Sequence: Synthetic coding sequence
MQLQFRSWMLAALTLLVVFLIFADISEIEEEIGNSGGRGTIRSAVNSLHSKSNRAEVVINGSSSPAVVDRSNESIKHNIQPASSKWRHNQTLSLRIRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGFWPFPLDQNQNPVKYHYYDSLKYGYTSQASPHTMPLEFKALKSLHEQGALKLTVGQCDGAT

SEQ ID NO: 14612 - protein, 354 aa, Artificial Sequence
  Description of Artificial Sequence: Synthetic coding sequence
MQLQFRSWMLAALTLLVVFLIFADISEIEEEIGAEVVINGSSSPAVVDRSNESIKHNIQPASSKWRHNQTLSLRIRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGFWPFPLDQNQNPVKYHYYDSLKYGYTSQASPHTMPLEFKALKSLHEQGALKLTVGQCDGAT

SEQ ID NO: 14613 - protein, 380 aa, Artificial Sequence
  Description of Artificial Sequence: Synthetic coding sequence
MRNCKMARVASVLGLVMLSVALLILSLISYVSLKKENIFTTPKYASPGAPRMYMFHAGFRSQFALKFLDPSFVPITNSLTQELQEKPSKWKFNRTAFLHQRQEILQHVDVIKNFSLTKNSVRIGQLMHYDYSSHKYVFSISNNFRSLLPDVSPIMNKHYNICAVVGNSGILTGSQCGQEIDKSDFVFRCNFAPTEAFQRDVGRKTNLTTFNPSILEKYYNNLLTIQDRNNFFLSLKKLDGAILWIPAFFFHTSATVTRTLVDFFVEHRGQLKVQLAWPGNIMQHVNRYWKNKHLSPKRLSTGILMYTLASAICEEIHLYGFWPFGFDPNTREDLPYHYYDKKGTKFTTKWQESHQLPAEFQLLYRMHGEGLTKLTLSHCA

SEQ ID NO: 14614 - protein, 487 aa, Artificial Sequence
  Description of Artificial Sequence: Synthetic coding sequence
AGGRGRTALRAPSPRRRAAPPSSCSAPGPARPCLRGPAALRGSCQPQPPAPVASPHPRPGPPPPPHARAHTHTHTHTHTHTHIYTPASCWPLNGPISPVSLNPAQPGMRNCKMARVASVLGLVMLSVALLILSLISYVSLKKENIFTTPKYASPGAPRMYMFHAGFRSQFALKFLDPSFVPITNSLTQELQEKPSKWKFNRTAFLHQRQEILQHVDVIKNFSLTKNSVRIGQLMHYDYSSHKYVFSISNNFRSLLPDVSPIMNKHYNICAVVGNSGILTGSQCGQEIDKSDFVFRCNFAPTEAFQRDVGRKTNLTTFNPSILEKYYNNLLTIQDRNNFFLSLKKLDGAILWIPAFFFHTSATVTRTLVDFFVEHRGQLKVQLAWPGNIMQHVNRYWKNKHLSPKRLSTGILMYTLASAICEEIHLYGFWPFGFDPNTREDLPYHYYDKKGTKFTTKWQESHQLPAEFQLLYRMHGEGLTKLTLSHCA

SEQ ID NO: 14615 - protein, 359 aa, Artificial Sequence
  Description of Artificial Sequence: Synthetic coding sequence
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRGYWLTNKVPIKRPSTGLLMYTLATRFCDEIHLYGFWPFPKDLNGKAVKYHYYDDLKYRYFSNASPHRMPLEFKTLNVLHNRGALKLTTGKCVKQ

SEQ ID NO: 14616 - protein, 168 aa, Artificial Sequence
  Description of Artificial Sequence: Synthetic coding sequence
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIR

SEQ ID NO: 14617 - protein, 376 aa, Artificial Sequence
  Description of Artificial Sequence: Synthetic coding sequence
MRYADPSANRDLLGSRTLLFIFICAFALVTLLQQILYGRNYIKRYFEFYEGPFEYNSTRCLELRHEILEVKVLSMVKQSELFDRWKSLQMCKWAMNISEANQFKSTLSRCCNAPAFLFTTQKNTPLGTKLKYEVDTSGIYHINQEIFRMFPKDMPYYRSQFKKCAVVGNGGILKNSRCGREINSADFVFRCNLPPISEKYTMDVGVKTDVVTVNPSIITERFHKLEKWRRPFYRVLQVYENASVLLPAFYNTRNTDVSIRVKYVLDDFESPQAVYYFHPQYLVNVSRYWLSLGVRAKRISTGLILVTAALELCEEVHLFGFWAFPMNPSGLYITHHYYDNVKPRPGFHAMPSEIFNFLHLHSRGILRVHTGTCSCC

SEQ ID NO: 14618 - protein, 345 aa, Artificial Sequence
  Description of Artificial Sequence: Synthetic coding sequence
MRYADPSANRDLLGSRTLLFIFICAFALVTLLQQILYGRNYIKRVKQSELFDRWKSLQMCKWAMNISEANQFKSTLSRCCNAPAFLFTTQKNTPLGTKLKYEVDTSGIYHINQEIFRMFPKDMPYYRSQFKKCAVVGNGGILKNSRCGREINSADFVFRCNLPPISEKYTMDVGVKTDVVTVNPSIITERFHKLEKWRRPFYRVLQVYENASVLLPAFYNTRNTDVSIRVKYVLDDFESPQAVYYFHPQYLVNVSRYWLSLGVRAKRISTGLILVTAALELCEEVHLFGFWAFPMNPSGLYITHHYYDNVKPRPGFHAMPSEIFNFLHLHSRGILRVHTGTCSCC

SEQ ID NO: 14619 - protein, 412 aa, Artificial Sequence
  Description of Artificial Sequence: Synthetic coding sequence
MRYADPSANRDLLGSRTLLFIFICAFALVTLLQQILYGRNYIKRGLQFGWQSGDQLTNWTGLFNVTDDPAVQSGSDSSSRYFEFYEGPFEYNSTRCLELRHEILEVKVLSMVKQSELFDRWKSLQMCKWAMNISEANQFKSTLSRCCNAPAFLFTTQKNTPLGTKLKYEVDTSGIYHINQEIFRMFPKDMPYYRSQFKKCAVVGNGGILKNSRCGREINSADFVFRCNLPPISEKYTMDVGVKTDVVTVNPSIITERFHKLEKWRRPFYRVLQVYENASVLLPAFYNTRNTDVSIRVKYVLDDFESPQAVYYFHPQYLVNVSRYWLSLGVRAKRISTGLILVTAALELCEEVHLFGFWAFPMNPSGLYITHHYYDNVKPRPGFHAMPSEIFNFLHLHSRGILRVHTGTCSCC

SEQ ID NO: 14620 - protein, 398 aa, Artificial Sequence
  Description of Artificial Sequence: Synthetic coding sequence
MRPGGALLALLASLLLLLLLRLLWCPADAPGRARILVEESREATHGTPAALRTLRSPATAVPRATNSTYLNEKSLQLTEKCKNLQYGIESFSNKTKGYSENDYLQIITDIQSCPWKRQAEEYANFRAKLASCCDAVQNFVVSQNNTPVGTNMSYEVESKKEIPIKKNIFHMFPVSQPFVDYPYNQCAVVGNGGILNKSLCGTEIDKSDFVFRCNLPPTTGDVSKDVGSKTNLVTINPSIITLKYGNLKEKKALFLEDIATYGDAFFLLPAFSFRANTGTSFKVYYTLEESKARQKVLFFHPKYLKDLALFWRTKGVTAYRLSTGLMITSVAVELCKNVKLYGFWPFSKTVEDIPVSHHYYDNKLPKHGFHQMPKEYSQILQLHMKGILKLQFSKCEVA

SEQ ID NO: 14621 - protein, 137 aa, Artificial Sequence
  Description of Artificial Sequence: Synthetic coding sequence
MFPVSQPFVDYPYNQCAVVGNGGILNKSLCGTEIDKSDFVFRCNLPPTTGDVSKDVGSKTNLVTINPSIITLKYGNLKEKKALFLEDIATYGDAFFLLPAFSFRANTGTSFKVYYTLEESKARQKCKTKRKTINSIL

SEQ ID NO: 14622 - protein, 128 aa, Artificial Sequence
  Description of Artificial Sequence: Synthetic coding sequence
  MOD_RES (1)..(1): Any amino acid
XYPYNQCAVVGNGGILNKSLCGTEIDKSDFVFRCNLPPTTGDVSKDVGSKTNLVTINPSIITLKYGNLKEKKALFLEDIATYGDAFFLLPAFSFRANTGTSFKVYYTLEESKARQKCKTKRKTINSIL

SEQ ID NO: 14623 - protein, 2570 aa, Artificial Sequence
  Description of Artificial Sequence: Synthetic coding sequence
MAGPRGLLPLCLLAFCLAGFSFVRGQVLFKGCDVKTTFVTHVPCTSCAAIKKQTCPSGWLRELPDQITQDCRYEVQLGGSMVSMSGCRRKCRKQVVQKACCPGYWGSRCHECPGGAETPCNGHGTCLDGMDRNGTCVCQENFRGSACQECQDPNRFGPDCQSVCSCVHGVCNHGPRGDGSCLCFAGYTGPHCDQELPVCQELRCPQNTQCSAEAPSCRCLPGYTQQGSECRAPNPCWPSPCSLLAQCSVSPKGQAQCHCPENYHGDGMVCLPKDPCTDNLGGCPSNSTLCVYQKPGQAFCTCRPGLVSINSNASAGCFAFCSPFSCDRSATCQVTADGKTSCVCRESEVGDGRACYGHLLHEVQKATQTGRVFLQLRVAVAMMDQGCREILTTAGPFTVLVPSVSSFSSRTMNASLAQQLCRQHIIAGQHILEDTRTQQTRRWWTLAGQEITVTFNQFTKYSYKYKDQPQQTFNIYKANNIAANGVFHVVTGLRWQAPSGTPGDPKRTIGQILASTEAFSRFETILENCGLPSILDGPGPFTVFAPSNEAVDSLRDGRLIYLFTAGLSKLQELVRYHIYNHGQLTVEKLISKGRILTMANQVLAVNISEEGRILLGPEGVPLQRVDVMAANGVIHMLDGILLPPTILPILPKHCSEEQHKIVAGSCVDCQALNTSTCPPNSVKLDIFPKECVYIHDPTGLNVLKKGCASYCNQTIMEQGCCKGFFGPDCTQCPGGFSNPCYGKGNCSDGIQGNGACLCFPDYKGIACHICSNPNKHGEQCQEDCGCVHGLCDNRPGSGGVCQQGTCAPGFSGRFCNESMGDCGPTGLAQHCHLHARCVSQEGVARCRCLDGFEGDGFSCTPSNPCSHPDRGGCSENAECVPGSLGTHHCTCHKGWSGDGRVCVAIDECELDMRGGCHTDALCSYVGPGQSRCTCKLGFAGDGYQCSPIDPCRAGNGGCHGLATCRAVGGGQRVCTCPPGFGGDGFSCYGDIFRELEANAHFSIFYQWLKSAGITLPADRRVTALVPSEAAVRQLSPEDRAFWLQPRTLPNLVRAHFLQGALFEEELARLGGQEVATLNPTTRWEIRNISGRVWVQNASVDVADLLATNGVLHILSQVLLPPRGDVPGGQGLLQQLDLVPAFSLFRELLQHHGLVPQIEAATAYTIFVPTNRSLEAQGNSSHLDADTVRHHVVLGEALSMETLRKGGHRNSLLGPAHWIVFYNHSGQPEVNHVPLEGPMLEAPGRSLIGLSGVLTVGSSRCLHSHAEALREKCVNCTRRFRCTQGFQLQDTPRKSCVYRSGFSFSRGCSYTCAKKIQVPDCCPGFFGTLCEPCPGGLGGVCSGHGQCQDRFLGSGECHCHEGFHGTACEVCELGRYGPNCTGVCDCAHGLCQEGLQGDGSCVCNVGWQGLRCDQKITSPQCPRKCDPNANCVQDSAGASTCACAAGYSGNGIFCSEVDPCAHGHGGCSPHANCTKVAPGQRTCTCQDGYMGDGELCQEINSCLIHHGGCHIHAECIPTGPQQVSCSCREGYSGDGIRTCELLDPCSKNNGGCSPYATCKSTGDGQRTCTCDTAHTVGDGLTCRARVGLELLRDKHASFFSLRLLEYKELKGDGPFTIFVPHADLMSNLSQDELARIRAHRQLVFRYHVVGCRRLRSEDLLEQGYATALSGHPLRFSEREGSIYLNDFARVVSSDHEAVNGILHFIDRVLLPPEALHWEPDDAPIPRRNVTAAAQGFGYKIFSGLLKVAGLLPLLREASHRPFTMLWPTDAAFRALPPDRQAWLYHEDHRDKLAAILRGHMIRNVEALASDLPNLGPLRTMHGTPISFSCSRTRAGELMVGEDDARIVQRHLPFEGGLAYGIDQLLEPPGLGARCDHFETRPLRLNTCSICGLEPPCPEGSQEQGSPEACWRFYPKFWTSPPLHSLGLRSVWVHPSLWGRPQGLGRGCHRNCVTTTWKPSCCPGHYGSECQACPGGPSSPCSDRGVCMDGMSGSGQCLCRSGFAGTACELCAPGAFGPHCQACRCTVHGRCDEGLGGSGSCFCDEGWTGPRCEVQLELQPVCTPPCAPEAVCRAGNSCECSLGYEGDGRVCTVADLCQDGHGGCSEHANCSQVGTMVTCTCLPDYEGDGWSCRARNPCTDGHRGGCSEHANCLSTGLNTRRCECHAGYVGDGLQCLEESEPPVDRCLGQPPPCHSDAMCTDLHFQEKRAGVFHLQATSGPYGLNFSEAEAACEAQGAVLASFPQLSAAQQLGFHLCLMGWLANGSTAHPVVFPVADCGNGRVGIVSLGARKNLSERWDAYCFRVQDVACRCRNGFVGDGISTCNGKLLDVLAATANFSTFYGMLLGYANATQRGLDFLDFLDDELTYKTLFVPVNEGFVDNMTLSGPDLELHASNATLLSANASQGKLLPAHSGLSLIISDAGPDNSSWAPVAPGTVVVSRIIVWDIMAFNGIIHALASPLLAPPQPQAVLAPEAPPVAAGVGAVLAAGALLGLVAGALYLRARGKPMGFGFSAFQAEDDADDDFSPWQEGTNPTLVSVPNPVFGSDTFCEPFDDSLLEEDFPDTQRILTVK

SEQ ID NO: 14624 - protein, 1000 aa, Artificial Sequence
  Description of Artificial Sequence: Synthetic coding sequence
MGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKGSAGLFQQLSSRPCISRTPD

SEQ ID NO: 14625 - protein, 2551 aa, Artificial Sequence
  Description of Artificial Sequence: Synthetic coding sequence
MMLQHLVIFCLGLVVQNFCSPAETTGQARRCDRKSLLTIRTECRSCALNLGVKCPDGYTMITSGSVGVRDCRYTFEVRTYSLSLPGCRHICRKDYLQPRCCPGRWGPDCIECPGGAGSPCNGRGSCAEGMEGNGTCSCQEGFGGTACETCADDNLFGPSCSSVCNCVHGVCNSGLDGDGTCECYSAYTGPKCDKPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQSHCECKEHYQNFVPGVGCSMTDICKSDNPCHRNANCTTVAPGRTECICQKGYVGDGLTCYGNIMERLRELNTEPRGKWQGRLTSFISLLDKAYAWPLSKLGPFTVLLPTDKGLKGFNVNELLVDNKAAQYFVKLHIIAGQMNIEYMNNTDMFYTLTGKSGEIFNSDKDNQIKLKLHGGKKKVKIIQGDIIASNGLLHILDRAMDKLEPTFESNNEQTIMTMLQPRYSKFRSLLEETNLGHALDEDGVGGPYTIFVPNNEALNNMKDGTLDYLLSPEGSRKLLELVRYHIVPFTQLEVATLISTPHIRSMANQLIQFNTTDNGQILANDVAMEEIEITAKNGRIYTLTGVLIPPSIVPILPHRCDETKREMKLGTCVSCSLVYWSRCPANSEPTALFTHRCVYSGRFGSLKSGCARYCNATVKIPKCCKGFYGPDCNQCPGGFSNPCSGNGQCADSLGGNGTCICEEGFQGSQCQFCSDPNKYGPRCNKKCLCVHGTCNNRIDSDGACLTGTCRDGSAGRLCDKQTSACGPYVQFCHIHATCEYSNGTASCICKAGYEGDGTLCSEMDPCTGLTPGGCSRNAECIKTGTGTHTCVCQQGWTGNGRDCSEINNCLLPSAGGCHDNASCLYVGPGQNECECKKGFRGNGIDCEPITSCLEQTGKCHPLASCQSTSSGVWSCVCQEGYEGDGFLCYGNAAVELSFLSEAAIFNRWINNASLQPTLSATSNLTVLVPSQQATEDMDQDEKSFWLSQSNIPALIKYHMLLGTYRVADLQTLSSSDMLATSLQGNFLHLAKVDGNITIEGASIVDGDNAATNGVIHIINKVLVPQRRLTGSLPNLLMRLEQMPDYSIFRGYIIQYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 14626 - protein, 358 aa, Artificial Sequence
  Description of Artificial Sequence: Synthetic coding sequence
MGAVWSALLVGGGLAGALFVWLLRGGPGDTGKDGDAEQEKDAPLGGAAIPGGHQSGSSGLSPGPSGQELVTKPEHLQESNGHLISKTKDLGKLQAASWRLQNPSREVCDNSREHVPSGQFPDTEAPATSETSNSRSYSEVSRNESLESPMGEWGFQKGQEISAKAATCFAEKLPSSNLLKNRAKEEMSLSDLNSQDRVDHEEWEMVPRHSSWGDVGVGGSLKAPVLNLNQGMDNGRSTLVEARGQQVHGKMERVAVMPAGSQQVSVRFQVHYVTSTDVQFIAVTGDHECLGRWNTYIPLHYNKDGFWSHSIFLPADTVVEWKFVLVENGGVTRWEECSNRFLETGHEDKVVHAWWGIH

SEQ ID NO: 14627 - protein, 209 aa, Artificial Sequence
  Description of Artificial Sequence: Synthetic coding sequence
MGEWGFQKGQEISAKAATCFAEKLPSSNLLKNRAKEEMSLSDLNSQDRVDHEEWEMVPRHSSWGDVGVGGSLKAPVLNLNQGMDNGRSTLVEARGQQVHGKMERVAVMPAGSQQVSVRFQVHYVTSTDVQFIAVTGDHECLGRWNTYIPLHYNKDGFWSHSIFLPADTVVEWKFVLVENGGVTRWEECSNRFLETGHEDKVVHAWWGIH

SEQ ID NO: 14628 - protein, 370 aa, Artificial Sequence
  Description of Artificial Sequence: Synthetic coding sequence
MLPRRLLAAWLAGTRGGGLLALLANQCRFVTGLRVRRAQQIAQLYGRLYSESSRRVLLGRLWRRLHGRPGHASALMAALAGVFVWDEERIQEEELQRSINEMKRLEEMSNMFQSSGVQHHPPEPKAQTEGNEDSEGKEQRWEMVMDKKHFKLWRRPITGTHLYQYRVFGTYTDVTPRQFFNVQLDTEYRKKWDALVIKLEVIERDVVSGSEVLHWVTHFPYPMYSRDYVYVRRYSVDQENNMMVLVSRAVEHPSVPESPEFVRVRSYESQMVIRPHKSFDENGFDYLLTYSDNPQTVFPRYCVSWMVSSGMPDFLEKLHMATLKAKNMEIKVKDYISAKPLEMSSEAKATSQSSERKNEGSCGPARIEYA

SEQ ID NO: 14629 - protein, 245 aa, Artificial Sequence
  Description of Artificial Sequence: Synthetic coding sequence
MESRKDITNQEEIWKMKPRRNLEDNDYLQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRMEIYVSLGIVGLAILALLAVTSIPSVSDSLTWREFHYIQVHGRINFLTL

SEQ ID NO: 14630 - protein, 254 aa, Artificial Sequence
  Description of Artificial Sequence: Synthetic coding sequence
MESRKDITNQEEIWKMKPRRNLEDNDYLHEDTGETSMLKRPVLLHLQQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRMEIYVSLGIVGLAILALLAVTSIPSVSDSLTWREFHYIQ

SEQ ID NO: 14631 - protein, 342 aa, Artificial Sequence
  Description of Artificial Sequence: Synthetic coding sequence
MESRKDITNQEEIWKMKPRRNLEDNDYLHEDTGETSMLKRPVLLHLQQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRMEIYVSLGIVGLAILALLAVTSIPSVSDSLTWREFHYIQAILTGSLVALCNFQATKLAKTQLVGTPNFWQEQQCGIHFPPPSKTRSYIYFILSAASPSKGNVSSHMFQLHLENLNKKDKLLLIIFQI

SEQ ID NO: 14632 - protein, 256 aa, Artificial Sequence
  Description of Artificial Sequence: Synthetic coding sequence
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRNTQHIQKEGRALNQEAACEMLREWHQGHILKVTLPGLHILALLHTHCNHSEKCCLMLRALSVSLEVF

SEQ ID NO: 14633 - protein, 132 aa, Artificial Sequence
  Description of Artificial Sequence: Synthetic coding sequence
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQAAAEVVLTQMP

SEQ ID NO: 14634 - protein, 330 aa, Artificial Sequence
  Description of Artificial Sequence: Synthetic coding sequence
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRKYYKISVVLMCFVVPTLVPWYIWGESLWNSYFLASILRYTISLNISWLVNSAAHMYGNRPYDKHISPRQNPLVALGAIGEGFHNYHHTFPFDYSASEFGLNFNPTTWFIDFMCWLGLATDRKRATKPMIEARKARTGDSSA

SEQ ID NO: 14635 - protein, 288 aa, Artificial Sequence [sequence omitted]

SEQ ID NO: 14636 - protein, 123 aa, Artificial Sequence
  Description of Artificial Sequence: Synthetic coding sequence
MAEKRHTRDSEAQRLPDSFKDSPSKGLGPCGWILVAFSFLFTVITFPISIWMCIKVIAAEGEMNASRALKEASMVITESPAALQLRYLQTLTTIAAEKNSTIVFPLPIDMLQGIIGAKHSHLG

SEQ ID NO: 14637 - protein, 237 aa, Artificial Sequence
  Description of Artificial Sequence: Synthetic coding sequence
MCIKIIKEYERAIIFRLGRILQGGAKGPGLFFILPCTDSFIKVDMRTISFDIPPQEILTKDSVTISVDGVVYYRVQNATLAVANITNADSATRLLAQTTLRNVLGTKNLSQILSDREEIAHNMQSTLDDATDAWGIKVERVEIKDVKLPVQLQRAMAAEAEASREARAKVIAAEGEMNASRALKEASMVITESPAALQLRYLQTLTTIAAEKNSTIVFPLPIDMLQGIIGAKHSHLG

SEQ ID NO: 14638 - protein, 1182 aa, Artificial Sequence
  Description of Artificial Sequence: Synthetic coding sequence
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSPLAISGGESSLLPTRPTCLSHALLPSDHSCTHPTPKVGLPDEVNPQQAESLGFQSDDLPQFQYFREDCAFSSPFWKDEGSDSHFTLDPPGSKKMFSSRNKEMPIDQKSLNKCSLNYICEKLEHLQSAENQDSLRSLSMHCLCAEENASSFVPHTLFRSQPKSGWSFMLRIPEKKNMMSSRQWGPIFLKVLPGGILQMYYEQGLEKPFKEIQLDPYCRLSEPKVENFSVAGKIHTVKIEHVSYTEKRKYHSKTEVVHEPDIEQMLKLGSTSYHDFLDFLTTVEEELMKLPAVSKPKKNYEEQEISLEIVDNFWGKVTKEGKFVESAVITQIYCLCFVNGNLECFLTLNDLELPKRDESYYEKDSEKKGIDILDYHFHKCVNVQEFEQSRIIKFVPLDACRFELMRFKTLYNGDNLPFSLKSVVVVQGAYVELQAFVNMASLAQRSSYAGSLRSCDNIRIHFPVPSQWIKALWTMNLQRQKSLKAKMNRRACLGSLQELESEPVIQVTVGSAKYESAYQAVVWKIDRLPDKNSSLDHPHCLSYKLELGSDQEIPSDWYPFATVQFSVPDTCASRTEVRSLGVESDVQPQKHVQQRACYNIQPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 14639 - protein, 477 aa, Artificial Sequence
  Description of Artificial Sequence: Synthetic coding sequence
ACLFLIPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 14640 - protein, 1135 aa, Artificial Sequence
  Description of Artificial Sequence: Synthetic coding sequence
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSPLAISGGESSLLPTRPTCLSHALLPSDHSCTHPTPKVGLPDEVNPQQAESLGFQSDDLPQFQYFREDCAFSSPFWKDEGSDSHFTLDPPGSKKMFSSRNKEMPIDQKSLNKCSLNYICEKLEHLQSAENQDSLRSLSMHCLCAEENASSFVPHTLFRSQPKSGWSFMLRIPEKKNMMSSRQWGPIFLKVLPGGILQMYYEQGLEKPFKEIQLDPYCRLSEPKVENFSVAGKIHTVKIEHVSYTEKRKYHSKTEVVHEPDIEQMLKLGSTSYHDFLDFLTTVEEELMKLPAVSKPKKNYEEQEISLEIVDNFWGKVTKEGKFVESAVITQIYCLCFVNGNLECFLTLNDLELPKRDESYYEKDSEKKGIDILDYHFHKCVNVQEFEQSRIIKFVPLDACRFELMRFKTLYNGDNLPFSLKSVVVVQGAYVELQAFVNMASLAQRSSYAGSLRSCDNIRIHFPVPSQWIKALWTMNLQRQKSLKAKMNRRACLGSLQELESEPVIQVTVGSAKYESAYQAVVWKIDRLPDKNSSLDHPHCLSYKLELGSDQEIPSDWYPFATVQFSVPDTCASRTEVRSLGVESDVQPQKHVQQRACYNIQPKLYRSVIEDVIEGVRNLFAEEGIEEQVLKDLKQLWETKVLQSKATEDFFRNSIQSPLFTLQLPHSLHQTLQSSTGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 14641 - protein, 1182 aa, Artificial Sequence; identical to SEQ ID NO: 14638
  Description of Artificial Sequence: Synthetic coding sequence

SEQ ID NO: 14642 - protein, 1182 aa, Artificial Sequence; identical to SEQ ID NO: 14638
  Description of Artificial Sequence: Synthetic coding sequence

SEQ ID NO: 14643 - protein, 1158 aa, Artificial Sequence
  Description of Artificial Sequence: Synthetic coding sequence
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSPLAISGGESSLLPTRPTCLSHALLPSDHSCTHPTPKVGLPDEVNPQQAESLGFQSDDLPQFQYFREDCAFSSPFWKDEGSDSHFTLDPPGSKKMFSSRNKEMPIDQKSLNKCSLNYICEKLEHLQSAENQDSLRSLSMHCLCAEENASSFVPHTLFRSQPKSGWSFMLRIPEKKNMMSSRQWGPIFLKVLPGGILQMYYEQGLEKPFKEIQLDPYCRLSEPKVENFSVAGKIHTVKIEHVSYTEKRKYHSKTEVVHEPDIEQMLKLGSTSYHDFLDFLTTVEEELMKLPAVSKPKKNYEEQEISLEIVDNFWGKVTKEGKFVESAVITQIYCLCFVNGNLECFLTLNDLELPKRDESYYEKDSEKKGIDILDYHFHKCVNVQEFEQSRIIKFVPLDACRFELMRFKTLYNGDNLPFSLKSVVVVQGAYVELQAFVNMASLAQRSSYAGSLRSCDNIRIHFPVPSQWIKALWTMNLQRQKSLKAKMNRRACLGSLQELESEPVIQVTVGSAKYESAYQAVVWKIDRLPDKNSSLDHPHCLSYKLELGSDQEIPSDWYPFATVQFSVPDTCASRTEVRSLGVESDVQPQKHVQQRACYNIQPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKQGDTRVRHGQQ

SEQ ID NO: 14644 - protein, 735 aa, Artificial Sequence
  Description of Artificial Sequence: Synthetic coding sequence
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSPLAISGGESSLLPTRPTCLSHALLPSDHSCTHPTPKVGLPDEVNPQQAESLGFQSDDLPQFQYFREDCAFSSPFWKDEGSDSHFTLDPPGSKKMFSSRNKEMPIDQKSLNKCSLNYICEKLEHLQSAENQDSLRSLSMHCLCAEENASSFVPHTLFRSQPKSGWSFMLRIPEKKNMMSSRQWGPIFLKVLPGGILQMYYEQGLEKPFKEIQLDPYCRLSEPKVENFSVAGKIHTVKIEHVSYTEKRKYHSKTEVVHEPDIEQMLKLGSTSYHDFLDFLTTVEEELMKLPAVSKPKKNYEEQEISLEIVDNFWGKVTKEGKFVESAVITQIYCLCFVNGNLECFLTLNDLELPKRDESYYEKDSEKKGIDILDYHFHKCVNVQEFEQSRIIKFVPLDACRFELMRFKTLYNGDNLPFSLKSVVVVQGAYVELQAFVNMASLAQRSSYAGSLRSCDNIRIHFPVPSQWIKALWTMNLQRQKSLKAKMNRRACLGSLQELESEPVIQVTVGSAKYESAYQAVVWKIDRLPDKNSSLDHPHCLSYKLELGSDQEIPSDWYPFATVQFSVPDTCASRTEVRSLGVESDVQPQKHVQQRACYNIQVEIEKKWIKIDGEDPDKIGDCITQ

SEQ ID NO: 14645 - protein, 735 aa, Artificial Sequence; identical to SEQ ID NO: 14644
  Description of Artificial Sequence: Synthetic coding sequence

SEQ ID NO: 14646 - protein, 735 aa, Artificial Sequence; identical to SEQ ID NO: 14644
  Description of Artificial Sequence: Synthetic coding sequence

SEQ ID NO: 14647 - protein, 905 aa, Artificial Sequence
  Description of Artificial Sequence: Synthetic coding sequence
MTTLDHVIATHQSEWVSFNEEPPFPAHSQGGTEEHLPGLSSSPDQSESSSGENHVVDGGSQDHSHSEQDDSSEKMGLISEAASPPGSPEQPPPDLASAISNWVQFEDDTPWASTSPPHQETAETALPLTMPCWTCPSFDSLGRCPLTSESSWTTHSEDTSSPSFGCSYTDLQLINAEEQTSGQASGADSTDNSSSLQEDEEVEMEAISWQASSPAMNGHPAPPVTSARFPSWVTFDDNEVSCPLPPVTSPLKPNTPPSASVIPDVPYNSMGSFKKRDRPKSTLMNFSKVQKLDISSLNRTPSVTEASPWRATNPFLNETLQDVQPSPINPFSAFFEEQERRSQNSSISSTTGKSQRDSLIVIYQDAISFDDSSKTQSHSDAVEKLKQLQIDDPDHFGSATLPDDDPVAWIELDAHPPGSARSQPRDGWPMMLRIPEKKNIMSSRHWGPIFVKLTDTGYLQLYYEQGLEKPFREFKLEICHEISEPRLQNYDENGRIHSLRIDRVTYKEKKKYQPKPAVAHTAEREQVIKLGTTNYDDFLSFIHAVQDRLMDLPVLSMDLSTVGLNYLEEEITVDVRDEFSGIVSKGDNQILQHHVLTRIHILSFLSGLAECRLGLNDILVKGNEIVLRQDIMPTTTTKWIKLHECRFHGCVDEDVFHNSRVILFNPLDACRFELMRFRTVFAEKTLPFTLRTATSVNGAEVEVQSWLRMSTGFSANRDPLTQVPCENVMIRYPVPSEWVKNFRRESVLGEKSLKAKVNRGASFGSTSVSGSEPVMRVTLGTAKYEHAFNSIVWRINRLPDKNSASGHPHCFFCHLELGSDREVPSRFANHVNVEFSMPTTSASKASVRSISVEDKTDVRKWVNYSAHYSYQVALGSIWLMLPTPFVHPTTLPLLFLLAMLTMFAW

SEQ ID NO: 14648 - protein, 932 aa, Artificial Sequence
  Description of Artificial Sequence: Synthetic coding sequence
GQQCEDDQCLFSMTTLDHVIATHQSEWVSFNEEPPFPAHSQGGTEEHLPGLSSSPDQSESSSGENHVVDGGSQDHSHSEQDDSSEKMGLISEAASPPGSPEQPPPDLASAISNWVQFEDDTPWASTSPPHQETAETALPLTMPCWTCPSFDSLGRCPLTSESSWTTHSEDTSSPSFGCSYTDLQLINAEEQTSGQASGADSTDNSSSLQEDEEVEMEAISWQASSPAMNGHPAPPVTSARFPSWVTFDDNEVSCPLPPVTSPLKPNTPPSASVIPDVPYNSMGSFKKRDRPKSTLMNFSKVQKLDISSLNRTPSVTEASPWRATNPFLNETLQDVQPSPINPFSAFFEEQERRSQNSSISSTTGKSQRDSLIVIYQDAISFDDSSKTQSHSDAVEKLKQLQIDDPDHFGSATLPDDDPVAWIELDAHPPGSARSQPRDGWPMMLRIPEKKNIMSSRHWGPIFVKLTDTGYLQLYYEQGLEKPFREFKLEICHEISEPRLQNYDENGRIHSLRIDRVTYKEKKKYQPKPAVAHTAEREQVIKLGTTNYDDFLSFIHAVQDRLMDLPVLSMDLSTVGLNYLEEEITVDVRDEFSGIVSKGDNQILQHHVLTRIHILSFLSGLAECRLGLNDILVKGNEIVLRQDIMPTTTTKWIKLHECRFHGCVDEDVFHNSRVILFNPLDACRFELMRFRTVFAEKTLPFTLRTATSVNGAEVEVQSWLRMSTGFSANRDPLTQVPCENVMIRYPVPSEWVKNFRRESVLGEKSLKAKVNRGASFGSTSVSGSEPVMRVTLGTAKYEHAFNSIVWRINRLPDKNSASGHPHCFFCHLELGSDREVPSRFANHVNVEFSMPTTSASKASVRSISVEDKTDVRKWVNYSAHYSYQTTETDNLPNPLYCSCLPHTDLKRGSKRVVKIRWNASLEVPLASSIRTMV

SEQ ID NO: 14649 - protein, 3 aa, Artificial Sequence
  Description of Artificial Sequence: Synthetic coding sequence
MTT

SEQ ID NO: 14650 - protein, 50 aa, Artificial Sequence
  Description of Artificial Sequence: Synthetic coding sequence
MTTLDHVIATHQSEWVSFNEEPPFPAHSQGGTEEHLPGLSSSPDQSESSS

SEQ ID NO: 14651 - protein, 920 aa, Artificial Sequence
  Description of Artificial Sequence: Synthetic coding sequence
MTTLDHVIATHQSEWVSFNEEPPFPAHSQGGTEEHLPGLSSSPDQSESSSGENHVVDGGSQDHSHSEQDDSSEKMGLISEAASPPGSPEQPPPDLASAISNWVQFEDDTPWASTSPPHQETAETALPLTMPCWTCPSFDSLGRCPLTSESSWTTHSEDTSSPSFGCSYTDLQLINAEEQTSGQASGADSTDNSSSLQEDEEVEMEAISWQASSPAMNGHPAPPVTSARFPSWVTFDDNEVSCPLPPVTSPLKPNTPPSASVIPDVPYNSMGSFKKRDRPKSTLMNFSKVQKLDISSLNRTPSVTEASPWRATNPFLNETLQDVQPSPINPFSAFFEEQERRSQNSSISSTTGKSQRDSLIVIYQDAISFDDSSKTQSHSDAVEKLKQLQIDDPDHFGSATLPDDDPVAWIELDAHPPGSARSQPRDGWPMMLRIPEKKNIMSSRHWGPIFVKLTDTGYLQLYYEQGLEKPFREFKLEICHEISEPRLQNYDENGRIHSLRIDRVTYKEKKKYQPKPAVAHTAEREQVIKLGTTNYDDFLSFIHAVQDRLMDLPVLSMDLSTVGLNYLEEEITVDVRDEFSGIVSKGDNQILQHHVLTRIHILSFLSGLAECRLGLNDILVKGNEIVLRQDIMPTTTTKWIKLHECRFHGCVDEDVFHNSRVILFNPLDACRFELMRFRTVFAEKTLPFTLRTATSVNGAEVEVQSWLRMSTGFSANRDPLTQVPCENVMIRYPVPSEWVKNFRRESVLGEKSLKAKVNRGASFGSTSVSGSEPVMRVTLGTAKYEHAFNSIVWRINRLPDKNSASGHPHCFFCHLELGSDREVPSRFANHVNVEFSMPTTSASKASVRSISVEDKTDVRKWVNYSAHYSYQTTETDNLPNPLYCSCLPHTDLKRGSKRVVKIRWNASLEVPLASSIRTMV

SEQ ID NO: 14652 - protein, 146 aa, Artificial Sequence
  Description of Artificial Sequence: Synthetic coding sequence
MWPAPCSVGRLLIFFMCSSSGYVVQGCGPSPGARTTLGSPLSLWSIKTPSHIFCTRRAINLGFPSPPLVQLIFWSLNAGLDLYLCLISSCGFSQVFWPVEAFCSFSLSFFALALSHKFVICRLDQHIFSGFTKSLKNLPPCHRTDI

SEQ ID NO: 14653 - protein, 66 aa, Artificial Sequence
  Description of Artificial Sequence: Synthetic coding sequence
MVAKQRIRMANEKHSKNITQRGNVAKTSRNAPEEKASVGPWLLALFIFVVCGSAIFQIIQSIRMGM

SEQ ID NO: 14654 - protein, 66 aa, Artificial Sequence; identical to SEQ ID NO: 14653
  Description of Artificial Sequence: Synthetic coding sequence

SEQ ID NO: 14655 - protein, 65 aa, Artificial Sequence
  Description of Artificial Sequence: Synthetic coding sequence
MVAKQRIRMANEKHSKNITQRGNVAKTLRPQEEKYPVGPWLLALFVFVVCGSAIFQIIQSIRMGM

SEQ ID NO: 14656 - protein, 780 aa, Artificial Sequence
  Description of Artificial Sequence: Synthetic coding sequence
MDEQAGPGVFFSNNHPGAGGAKGLGPLAEAAAAGDGAAAAGAARAQYSLPGILHFLQHEWARFEVERAQWEVERAELQAQIAFLQGERKGQENLKKDLVRRIKMLEYALKQERAKYHKLKYGTELNQGDMKPPSYDSDEGNETEVQPQQNSQLMWKQGRQLLRQYLQEVGYTDTILDVKSKRVRALLGFSSDVTDREDDKNQDSVVNGTEAEVKETAMIAKSELTDSASVLDNFKFLESAAADFSDEDEDDDVDGREKSVIDTSTIVRKKALPDSGEDRDTKEALKEFDFLVTSEEGDNESRSAGDGTDWEKEDQCLMPEAWNVDQGVITKLKEQYKKERKGKKGVKRPNRSKLQDMLANLRDVDELPSLQPSVGSPSRPSSSRLPEHEINRADEVEALTFPPSSGKSFIMGADEALESELGLGELAGLTVANEADSLTYDIANNKDALRKTWNPKFTLRSHFDGIRALAFHPIEPVLITASEDHTLKMWNLQKTAPAKKSTSLDVEPIYTFRAHKGPVLCVVMSSNGEQCYSGGTDGLIQGWNTTNPNIDPYDSYDPSVLRGPLLGHTDAVWGLAYSAAHQRLLSCSADGTLRLWNTTEVAPALSVFNDTKELGIPASVDLVSSDPSHMVASFSKGYTSIFNMETQQRILTLESNVDTTANSSCQINRVISHPTLPISITAHEDRHIKFYDNNTGKLIHSMVAHLEAVTSLAVDPNGLYLMSGSHDCSIRLWNLESKTCIQEFTAHRKKFEESIHDVAFHPSKCYIASAGADALAKVFV

SEQ ID NO: 14657 - protein, 731 aa, Artificial Sequence
  Description of Artificial Sequence: Synthetic coding sequence
MDEQAGPGVFFSNNHPGAGGAKGLGPLAGAARAQYSLPGILHFLQHEWARFEVERAQWEVERAELQAQIAFLQGERKGQENLKKDLVRRIKMLEYALKQERAKYHKLKYGTELNQGDMKPPSYDSDEGNETEVQPQQNSQLMWKQGRQLLRQYLQEVGYTDTILDVKSKRVRALLGFSSDVTDREDDKNQDSVVNGTEAEVKETAMIAKSELTDSASVLDNFKFLESAAADFSDEDEDDDVDGREKSVIDTSTIVRKKALPDSGEDRDTKEALKEFDFLVTSEEGDNESRSAGDGTDWGPNRSKLQDMLANLRDVDELPSLQPSVGSPSRPSSSRLPEHEINRADEVEALTFPPSSGKSFIMGADEALESELGLGELAGLTVANEADSLTYDIANNKDALRKTWNPKFTLRSHFDGIRALAFHPIEPVLITASEDHTLKMWNLQKTAPAKKSTSLDVEPIYTFRAHKGPVLCVVMSSNGEQCYSGGTDGLIQGWNTTNPNIDPYDSYDPSVLRGPLLGHTDAVWGLAYSAAHQRLLSCSADGTLRLWNTTEVAPALSVFNDTKELGIPASVDLVSSDPSHMVASFSKGYTSIFNMETQQRILTLESNVDTTANSSCQINRVISHPTLPISITAHEDRHIKFYDNNTGKLIHSMVAHLEAVTSLAVDPNGLYLMSGSHDCSIRLWNLESKTCIQEFTAHRKKFEESIHDVAFHPSKCYIASAGADALAKVFV

SEQ ID NO: 14658 - protein, 755 aa, Artificial Sequence
  Description of Artificial Sequence: Synthetic coding sequence
RPPWTSRRVPASSSATTTRAQYSLPGILHFLQHEWARFEVERAQWEVERAELQAQIAFLQGERKGQENLKKDLVRRIKMLEYALKQERAKYHKLKYGTELNQGDMKPPSYDSDEGNETEVQPQQNSQLMWKQGRQLLRQYLQEVGYTDTILDVKSKRVRALLGFSSDVTDREDDKNQDSVVNGTEAEVKETAMIAKSELTDSASVLDNFKFLESAAADFSDEDEDDDVDGREKSVIDTSTIVRKKALPDSGEDRDTKEALKEFDFLVTSEEGDNESRSAGDGTDWEKEDQCLMPEAWNVDQGVITKLKEQYKKERKGKKGVKRPNRSKLQDMLANLRDVDELPSLQPSVGSPSRPSSSRLPEHEINRADEVEALTFPPSSGKSFIMGADEALESELGLGELAGLTVANEADSLTYDIANNKDALRKTWNPKFTLRSHFDGIRALAFHPIEPVLITASEDHTLKMWNLQKTAPAKKSTSLDVEPIYTFRAHKGPVLCVVMSSNGEQCYSGGTDGLIQGWNTTNPNIDPYDSYDPSVLRGPLLGHTDAVWGLAYSAAHQRLLSCSADGTLRLWNTTEVAPALSVFNDTKELGIPASVDLVSSDPSHMVASFSKGYTSIFNMETQQRILTLESNVDTTANSSCQINRVISHPTLPISITAHEDRHIKFYDNNTGKLIHSMVAHLEAVTSLAVDPNGLYLMSGSHDCSIRLWNLESKTCIQEFTAHRKKFEESIHDVAFHPSKCYIASAGADALAKVFV

SEQ ID NO: 14659 - protein, 713 aa, Artificial Sequence
  Description of Artificial Sequence: Synthetic coding sequence
MDELAGGGGGGPGMAAPPRQQQGPGGNLGLSPGGNGAAGGGGPPASEGAGPAAGPELSRPQQYTIPGILHYIQHEWARFEMERAHWEVERAELQARIAFLQGERKGQENLKKDLVRRIKMLEYALKQERAKYHKLKYGTELNQGDLKMPTFESEETKDTEAPTAPQNSQLTWKQGRQLLRQYLQEVGYTDTILDVRSQRVRSLLGLSNSEPNGSVETKNLEQILNGGESPKQKGQEIKRSSGDVLETFNFLENADDSDEDEENDMIEGIPEGKDKHRMNKHKIGNEGLAADLTDDPDTEEALKEFDFLVTAEDGEGAGEARSSGDGTEWAEPITFPSGGGKSFIMGSDDVLLSVLGLGDLADLTVTNDADYSYDLPANKDAFRKTWNPKYTLRSHFDGVRALAFHPVEPVLVTASEDHTLKLWNLQKTVPAKKSASLDVEPIYTFRAHIGPVLSLAISSNGEQCFSGGIDATIQWWNMPSPSVDPYDTYEPNVLAGTLVGHTDAVWGLAYSGIKNQLLSCSADGTVRLWNPQEKLPCICTYNGDKKHGIPTSVDFIGCDPAHMVTSFNTGSAVIYDLETSQSLVILSSQVDSGLQSNNHINRVVSHPTLPVTITAHEDRHIKFFDNKTGKMIHSMVAHLDAVTSLAVDPNGIYLMSGSHDCSIRLWNLDSKTCVQEITAHRKKLDESIYDVAFHSSKAYIASAGADALAKVFV

SEQ ID NO: 14660 - protein, 797 aa, Artificial Sequence
  Description of Artificial Sequence: Synthetic coding sequence
MDELAGGGGGGPGMAAPPRQQQGPGGNLGLSPGGNGAAGGGGPPASEGAGPAAGPELSRPQQYTIPGILHYIQHEWARFEMERAHWEVERAELQARIAFLQGERKGQENLKKDLVRRIKMLEYALKQERAKYHKLKYGTELNQGDLKMPTFESEETKDTEAPTAPQNSQLTWKQGRQLLRQYLQEVGYTDTILDVRSQRVRSLLGLSNSEPNGSVETKNLEQILNGGESPKQKGQEIKRSSGDVLETFNFLENADDSDEDEENDMIEGIPEGKDKHRMNKHKIGNEGLAADLTDDPDTEEALKEFDFLVTAEDGEGAGEARSSGDGTEWDKDDLSPTAEVWDVDQGLISKLKEQYKKERKGKKGVKRANRTKLYDMIADLGDDELPHIPSGIINQSRSASTRMTDHEGARAEEAEPITFPSGGGKSFIMGSDDVLLSVLGLGDLADLTVTNDADYSYDLPANKDAFRKTWNPKYTLRSHFDGVRALAFHPVEPVLVTASEDHTLKLWNLQKTVPAKKSASLDVEPIYTFRAHIGPVLSLAISSNGEQCFSGGIDATIQWWNMPSPSVDPYDTYEPNVLAGTLVGHTDAVWGLAYSGIKNQLLSCSADGTVRLWNPQEKLPCICTYNGDKKHGIPTSVDFIGCDPAHMVTSFNTGSAVIYDLETSQSLVILSSQVDSGLQSNNHINRVVSHPTLPVTITAHEDRHIKFFDNKTGKMIHSMVAHLDAVTSLAVDPNGIYLMSGSHDCSIRLWNLDSKTCVQEITAHRKKLDESIYDVAFHSSKAYIASAGADALAKVFV

SEQ ID NO: 14661 - protein, 705 aa, Artificial Sequence
  Description of Artificial Sequence: Synthetic coding sequence
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCVFLAPLFSSFTTIVTYHLTKELKDAGAGLLAAAMIAVVPGYISRSVAGSYDNEGIAIFCMLLTYYMWIKAVKTGSICWAAKCALAYFYMVSSWGGYVFLINLIPLHVLVLMLTGRFSHRIYVAYCTVYCLGTILSMQISFVGFQPVLSSEHMAAFGVFGLCQIHAFVDYLRSKLNPQQFEVLFRSVISLVGFVLLTVGALLMLTGKISPWTGRFYSLLDPSYAKNNIPIIASVSEHQPTTWSSYYFDLQLLVFMFPVGLYYCFSNLSDARIFIIMYGVTSMYFSAVMVRLMLVLAPVMCILSGIGVSQVLSTYMKNLDISRPDKKSKKQQDSTYPIKNEVASGMILVMAFFLITYTFHSTWVTSEAYSSPSIVLSARGGDGSRIIFDDFREAYYWLRHNTPEDAKVMSWWDYGYQITAMANRTILVDNNTWNNTHISRVGQAMASTEEKAYEIMRELDVSYVLVIFGGLTGYSSDDINKFLWMVRIGGSTDTGKHIKENDYYTPTGEFRVDREGSPVLLNCLMYKMCYYRFGQVYTEAKRPPGFDRVRNAEIGNKDFELDVLEEAYTTEHWLVRIYKVKDLDNRGLSRT

SEQ ID NO: 14662 - protein, 705 aa, Artificial Sequence; identical to SEQ ID NO: 14661
  Description of Artificial Sequence: Synthetic coding sequence

SEQ ID NO: 14663 - protein, 826 aa, Artificial Sequence
  Description of Artificial Sequence: Synthetic coding sequence
MAEPSAPESKHKSSLNSSPWSGLMALGNSRHGHHGPGAQCAHKAAGGAAPPKPAPAGLSGGLSQPAGWQSLLSFTILFLAWLAGFSSRLFAVIRFESIIHEFDPWFNYRSTHHLASHGFYEFLNWFDERAWYPLGRIVGGTVYPGLMITAGLIHWILNTLNITVHIRDVCVFLAPTFSGLTSISTFLLTRELWNQGAGLLAACFIAIVPGYISRSVAGSFDNEGIAIFALQFTYYLWVKSVKTGSVFWTMCCCLSYFYMVSAWGGYVFIINLIPLHVFVLLLMQRYSKRVYIAYSTFYIVGLILSMQIPFVGFQPIRTSEHMAAAGVFALLQAYAFLQYLRDRLTKQEFQTLFFLGVSLAAGAVFLSVIYLTYTGYIAPWSGRFYSLWDTGYAKIHIPIIASVSEHQPTTWVSFFFDLHILVCTFPAGLWFCIKNINDERVFVALYAISAVYFAGVMVRLMLTLTPVVCMLSAIAFSNVFEHYLGDDMKRENPPVEDSSDEDDKRNQGNLYDKAGKVRKHATEQEKTEEGLGPNIKSIVTMLMLMLLMMFAVHCTWVTSNAYSSPSVVLASYNHDGTRNILDDFREAYFWLRQNTDEHARVMSWWDYGYQIAGMANRTTLVDNNTWNNSHIALVGKAMSSNETAAYKIMRTLDVDYVLVIFGGVIGYSGDDINKFLWMVRIAEGEHPKDIRESDYFTPQGEFRVDKAGSPTLLNCLMYKMSYYRFGEMQLDFRTPPGFDRTRNAEIGNKDIKFKHLEEAFTSEHWLVRIYKVKAPDNRETLDHKPRVTNIFPKQKYLSKKTTKRKRGYIKNKLVFKKGKKISKKTV

SEQ ID NO: 14664 - protein, 334 aa, Artificial Sequence
  Description of Artificial Sequence: Synthetic coding sequence
MLGIMAWNATCKNWLAAEAALEKYYLSIFYGIEFVVGVLGNTIVVYGYIFSLKNWNSSNIYLFNLSVSDLAFLCTLPMLIRSYANGNWIYGDVLCISNRYVLHANLYTSILFLTFISIDRYLIIKYPFREHLLQKKEFAILISLAIWVLVTLELLPILPLINPVITDNGTTCNDFASSGDPNYNLIYSMCLTLLGFLIPLFVMCFFYYKIALFLKQRNRQVATALPLEKPLNLVIMAVVIFSVLFTPYHVMRNVRIASRLGSWKQYQCTQVVINSFYIVTRPLAFLNSVINPVFYFLLGDHFRDMLMNQLRHNFKSLTSFSRWAHELLLSFREK

SEQ ID NO: 14665 - protein, 440 aa, Artificial Sequence
  Description of Artificial Sequence: Synthetic coding sequence
MASPVAAQAGKLLRALALRPRFLAAGSQAVQLTSRRWLNLQEYQSKKLMSDNGVRVQRFFVADTANEALEAAKRLNAKEIVLKAQILAGGRGKGVFNSGLKGGVHLTKDPNVVGQLAKQMIGYNLATKQTPKEGVKVNKVMVAEALDISRETYLAILMDRSCNGPVLVGSPQGGVDIEEVAASNPELIFKEQIDIFEGIKDSQAQRMAENLGFVGPLKSQAADQITKLYNLFLKIDATQVEVNPFGETPEGQVVCFDAKINFDDNAEFRQKDIFAMDDKSENEPIENEAAKYDLKYIGLDGNIACFVNGAGLAMATCDIIFLNGGKPANFLDLGGGVKEAQVYQAFKLLTADPKVEAILVNIFGGIVNCAIIANGITKACRELELKVPLVVRLEGTFMEKKGSYMHIKQETGNSNENITGIQENVAHQNLSKCAISIFLC

SEQ ID NO: 14666 - protein, 432 aa, Artificial Sequence
  Description of Artificial Sequence: Synthetic coding sequence
MASPVAAQAGKLLRALALRPRFLAAGSQAVQLTSRRWLNLQEYQSKKLMSDNGVRVQRFFVADTANEALEAAKRLNAKEIVLKAQILAGGRGKGVFNSGLKGGVHLTKDPNVVGQLAKQMIGYNLATKQTPKEGVKVNKVMVAEALDISRETYLAILMDRSCNGPVLVGSPQGGVDIEEVAASNPELIFKEQIDIFEGIKDSQAQRMAENLGFVGPLKSQAADQITKLYNLFLKIDATQVEVNPFGETPEGQVVCFDAKINFDDNAEFRQKDIFAMDDKSENEPIENEAAKYDLKYIGLDGNIACFVNGAGLAMATCDIIFLNGGKPANFLDLGGGVKEAQVYQAFKLLTADPKVEAILVNIFGGIVNCAIIANGITKACRELELKVPLVVRLEGTNVQEAQKILNNSGLPITSAIDLEDAAKKAVASVAKK

SEQ ID NO: 14667 - protein, 250 aa, Artificial Sequence
  Description of Artificial Sequence: Synthetic coding sequence
MSDNGVRVQRFFVADTANEALEAAKRLNAKEIVLKAQILAGGRGKGVFNSGLKGGVHLTKDPNVVGQLAKQMIGYNLATKQTPKEGVKVNKVMVAEALDISRETYLAILMDRSCNGPVLVGSPQGGVDIEEVAASNPELIFKEQIDIFEGIKDSQAQRMAENLGFVGPLKSQVEAILVNIFGGIVNCAIIANGITKACRELELKVPLVVRLEGTNVQEAQKILNNSGLPITSAIDLEDAAKKAVASVAKK

SEQ ID NO: 14668 - protein, 213 aa, Artificial Sequence
  Description of Artificial Sequence: Synthetic coding sequence
MFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 14669 - protein, 358 aa, Artificial Sequence
  Description of Artificial Sequence: Synthetic coding sequence
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGWATLQIQPQTTSVSAVLQTQAGRQGSCKQPGGDKEKSLLGSLSFPGHVANSAIPSSRASASGKNFPFPVSHPSVAGASHQGRRGLSLLCFGEGAQCVLTMAGGQVFLLEAKYY

SEQ ID NO: 14670 - protein, 236 aa, Artificial Sequence
  Description of Artificial Sequence: Synthetic coding sequence
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 14671 - protein, 305 aa, Artificial Sequence
  Description of Artificial Sequence: Synthetic coding sequence
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 14672 - protein, 294 aa, Artificial Sequence
  Description of Artificial Sequence: Synthetic coding sequence
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRYIRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVT

SEQ ID NO: 14673 - protein, 320 aa, Artificial Sequence
  Description of Artificial Sequence: Synthetic coding sequence
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 14674 - protein, 606 aa, Artificial Sequence
  Description of Artificial Sequence: Synthetic coding sequence
MVRGARQPQQPRSRLAPRLTGTVEKPPRKRRSRTEFALKEIMSSGGAEDDIPQGERKTVTDFCYLLDKSKQLFNGLRDLPQYGQKQWQSYFGRTFDVYTKLWKFQQQHRQVLDNRYGLKRWQIGEIASKIGQLYYHYYLRTSETSYLNEAFSFYSAIRQRSYYSQVNKEDRPELVVKKLRYYARFIVVCLLLNKMDVVKDLVKELSDEIEDYTHRFNTEDQVEWNLVLQEVAAFIEADPVMVLNDDNTIVITSNRLAETGAPLLEQGMIVGQLSLADALIIGNCNNQVKFSELTVDMFRMLQALEREPMNLASQMNKPGMQESADKPTRRENPHKYLLYKPTFSQLYTFLAASFKELPANSVLLIYLSATGVFPTGRSDSEGPYDFGGVLTNSNRDIINGDAIHKRNQSHKEMHCLHPGDLYPFTRKPLFIIVDSSNSVAYKNFTNLFGQPLVCLLSPTAYPKALQDQSQRGSLFTLFLNNPLMAFLFVSGLSSMRRGLWEKCQEYLRKINRDIAQLLTHSRSIDQAFLQFFGDEFLRLLLTRFIFCSATMRMHKIFRETRNYPESYPQLPRDETVENPHLQKHILELASILDVRNVFFENTIDDY

SEQ ID NO: 14675 - protein, 629 aa, Artificial Sequence
  Description of Artificial Sequence: Synthetic coding sequence
MVRGARQPQQPRSRLAPRLTGTVEKPPRKRRSSIRGSGDSSHSQSQGERYQHFTEKTEFALKEIMSSGGAEDDIPQGERKTVTDFCYLLDKSKQLFNGLRDLPQYGQKQWQSYFGRTFDVYTKLWKFQQQHRQVLDNRYGLKRWQIGEIASKIGQLYYHYYLRTSETSYLNEAFSFYSAIRQRSYYSQVNKEDRPELVVKKLRYYARFIVVCLLLNKMDVVKDLVKELSDEIEDYTHRFNTEDQVEWNLVLQEVAAFIEADPVMVLNDDNTIVITSNRLAETGAPLLEQGMIVGQLSLADALIIGNCNNQVKFSELTVDMFRMLQALEREPMNLASQMNKPGMQESADKPTRRENPHKYLLYKPTFSQLYTFLAASFKELPANSVLLIYLSATGVFPTGRSDSEGPYDFGGVLTNSNRDIINGDAIHKRNQSHKEMHCLHPGDLYPFTRKPLFIIVDSSNSVAYKNFTNLFGQPLVCLLSPTAYPKALQDQSQRGSLFTLFLNNPLMAFLFVSGLSSMRRGLWEKCQEYLRKINRDIAQLLTHSRSIDQAFLQFFGDEFLRLLLTRFIFCSATMRMHKIFRETRNYPESYPQLPRDETVENPHLQKHILELASILDVRNVFFENTIDDY

SEQ ID NO: 14676 - protein, 581 aa, Artificial Sequence
  Description of Artificial Sequence: Synthetic coding sequence
MVFRNVGRPPEEEDVEAAPEPGPSELLCPRHRCALDPKALPPGLALERTWGPAAGLEAQLAALGLGQPAGPGVKTVGGGCCPCPCPPQPPPPQPQPPAAAPQAGEDPTETSDALLVLEGLESEAESLETNSCSEEELSSPGRGGGGGGRLLLQPPGPELPPVPFPLQDLVPLGRLSRGEQQQQQQQQPPPPPPPPGPLRPLAGPSRKGSFKIRLSRLFRTKSCNGGSGGGDGTGKRPSGELAASAASLTDMGGSAGRELDAGRKPKLTRTQSAFSPVSFSPLFTGETVSLVDVDISQRGLTSPHPPTPPPPPRRSLSLLDDISGTLPTSVLVAPMGSSLQSFPLPPPPPPHAPDAFPRIAPIRAAESLHSQPPQHLQCPLYRPDSSSFAASLRELEKCGWYWGPMNWEDAEMKLKGKPDGSFLVRDSSDPRYILSLSFRSQGITHHTRMEHYRGTFSLWCHPKFEDRCQSVVEFIKRAIMHSKNGKFLYFLRSRVPGLPPTPVQLLYPVSRFSNVKSLQHLCRFRIRQLVRIDHIPDLPLPKPLISYIRKFYYYDPQEEVYLSLKEAQLISKQKQEVEPST

SEQ ID NO: 14677 - protein, 581 aa, Artificial Sequence; identical to SEQ ID NO: 14676
  Description of Artificial Sequence: Synthetic coding sequence

SEQ ID NO: 14678 - protein, 722 aa, Artificial Sequence
  Description of Artificial Sequence: Synthetic coding sequence
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKIRHSCCCRWRVLDWVPWLL

SEQ ID NO: 14679 - protein, 757 aa, Artificial Sequence
  Description of Artificial Sequence: Synthetic coding sequence
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKVRRHSCAVWAQVKEIPCNCNFLRLHIHRANSGDTQIRHSCCCRWRVLDWVPWLL

SEQ ID NO: 14680 - protein, 747 aa, Artificial Sequence
  Description of Artificial Sequence: Synthetic coding sequence
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKVRRHSCAVWAQVKDSSLMLLQMAGVGLGSLAVVIILTFLSFSAV

SEQ ID NO: 14681 - protein, 822 aa, Artificial Sequence
  Description of Artificial Sequence: Synthetic coding sequence
MKPALLPWALLLLATALGPGPGPTADAQESCSMRCGALDGPCSCHPTCSGLGTCCLDFRDFCLEILPYSGSMMGGKDFVVRHFKMSSPTDASVICRFKDSIQTLGHVDSSGQVHCVSPLLYESGRIPFTVSLDNGHSFPRAGTWLAVHPNKVSMMEKSELVNETRWQYYGTANTSGNLSLTWHVKSLPTQTITIELWGYEETGMPYSQEWTAKWSYLYPLATHIPNSGSFTFTPKPAPPSYQRWRVGALRIIDSKNYAGQKDVQALWTNDHALAWHLSDDFREDPVAWARTQCQAWEELEDQLPNFLEELPDCPCTLTQARADSGRFFTDYGCDMEQGSVCTYHPGAVHCVRSVQASLRYGSGQQCCYTADGTQLLTADSSGGSTPDRGHDWGAPPFRTPPRVPSMSHWLYDVLSFYYCCLWAPDCPRYMQRRPSNDCRNYRPPRLASAFGDPHFVTFDGTNFTFNGRGEYVLLEAALTDLRVQARAQPGTMSNGTETRGTGLTAVAVQEGNSDVVEVRLANRTGGLEVLLNQEVLSFTEQSWMDLKGMFLSVAAGDRVSIMLASGAGLEVSVQGPFLSVSVLLPEKFLTHTHGLLGTLNNDPTDDFTLHSGRVLPPGTSPQELFLFGANWTVHNASSLLTYDSWFLVHNFLYQPKHDPTFEPLFPSETTLNPSLAQEAAKLCGDDHFCNFDVAATGSLSTGTATRVAHQLHQRRMQSLQPVVSCGWLAPPPNGQKEGNRYLAGSTIYFHCDNGYSLAGAETSTCQADGTWSSPTPKCQPGRSYAVLLGIIFGGLAVVAAVALVYVLLRRRKGNTHVWGAQP

SEQ ID NO: 14682 - protein, 242 aa, Artificial Sequence
  Description of Artificial Sequence: Synthetic coding sequence
MKNIGLVMEWEIPEIICTCAKLRLPPQATFQVLRGNGASVGTVLMFRCPSNHQMVGSGLLTCTWKGSIAEWSSGSPVCKLVPPHETFGFKVAVIASIVSCAIILLMSMAFLTCCLLKCVKKSKRRRSNRSAQLWSQLKDEDLETVQAAYLGLKHFNKPVSGPSQAHDNHSFTTDHGESTSKLASVTRSVDKDPGIPRALSLSGSSSSPQAQVMVHMANPRQPLPASGLATGMPQQPAAYALG

SEQ ID NO: 14683 - protein, 255 aa, Artificial Sequence
  Description of Artificial Sequence: Synthetic coding sequence
MRWAAATLRGKARPRGRAGVTTPAPGNRTGTCAKLRLPPQATFQVLRGNGASVGTVLMFRCPSNHQMVGSGLLTCTWKGSIAEWSSGSPVCKLVPPHETFGFKVAVIASIVSCAIILLMSMAFLTCCLLKCVKKSKRRRSNRSAQLWSQLKDEDLETVQAAYLGLKHFNKPVSGPSQAHDNHSFTTDHGESTSKLASVTRSVDKDPGIPRALSLSGSSSSPQAQVMVHMANPRQPLPASGLATGMPQQPAAYALG

SEQ ID NO: 14684 - protein, 236 aa, Artificial Sequence
  Description of Artificial Sequence: Synthetic coding sequence
MYHGMNPSNGDGFLEQQQQQQQPQSPQRLLAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGCLRPLAPQHTPAQGTRTQAQGSQKPVTASQALLSCSKVCIHLPGAKRAPTLLRTTLT

SEQ ID NO: 14685 - protein, 106 aa, Artificial Sequence
  Description of Artificial Sequence: Synthetic coding sequence
MYHGMNPSNGDGFLEQQQQQQQPQSPQRLLAVILWFQLALCFGPAQLTGVHLTRDLLGFEGCPECPPPPGFKEESQEFAQQVTPLRSLTHANPWSSGPLCIPKSWS

SEQ ID NO: 14686 - protein, 490 aa, Artificial Sequence
  Description of Artificial Sequence: Synthetic coding sequence
MYHGMNPSNGDGFLEQQQQQQQPQSPQRLLAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEVCPLPPMVSHGDFVCHPRPCERYNHGTVVEFYCDPGYSLTSDYKYITCQYGEWFPSYQVYCIKSEQTWPSTHETLLTTWKIVAFTATSVLLVLLLVILARMFQTKFKAHFPPRGPPRSSSSDPDFVVVDGVPVMLPSYDEAVSGGLSALGPGYMASVGQGCPLPVDDQSPPAYPGSGDTDTGPGESETCDSVSGSSELLQSLYSPPRCQESTHPASDNPDIIASTAEEVASTSPGIDIADEIPLMEEDP

SEQ ID NO: 14687 - protein, 290 aa, Artificial Sequence
  Description of Artificial Sequence: Synthetic coding sequence
MYHGMNPSNGDGFLEQQQQQQQPQSPQRLLAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEGGRPEHLFPVLYFPHIRLAAAVLYFCPVLKSSPTPAPTCSSTSTTTSLF

SEQ ID NO: 14688 - protein, 106 aa, Artificial Sequence; identical to SEQ ID NO: 14685
  Description of Artificial Sequence: Synthetic coding sequence

SEQ ID NO: 14689 - protein, 490 aa, Artificial Sequence; identical to SEQ ID NO: 14686
  Description of Artificial Sequence: Synthetic coding sequence

SEQ ID NO: 14690 - protein, 330 aa, Artificial Sequence
  Description of Artificial Sequence: Synthetic coding sequence
MVSLCRDDGTWNNLPICQGCLRPLASSNGYVNISELQTSFPVGTVISYRCFPGFKLDGSAYLECLQNLIWSSSPPRCLALEVCPLPPMVSHGDFVCHPRPCERYNHGTVVEFYCDPGYSLTSDYKYITCQYGEWFPSYQVYCIKSEQTWPSTHETLLTTWKIVAFTATSVLLVLLLVILARMFQTKFKAHFPPRGPPRSSSSDPDFVVVDGVPVMLPSYDEAVSGGLSALGPGYMASVGQGCPLPVDDQSPPAYPGSGDTDTGPGESETCDSVSGSSELLQSLYSPPRCQESTHPASDNPDIIASTAEEVASTSPGIDIADEIPLMEEDP

SEQ ID NO: 14691 - protein, 421 aa, Artificial Sequence
  Description of Artificial Sequence: Synthetic coding sequence
MYHGMNPSNGDGFLEQQQQQQQPQSPQRLLAVILWFQLALCFGPAQLTGDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEAQVCPLPPMVSHGDFVCHPRPCERYNHGTVVEFYCDPGYSLTSDYKYITCQYGEWFPSYQVYCIKSEQTWPSTHETLLTTWKIVAFTATSVLLVLLLVILARMFQTKFKAHFPPRGPPRSSSSDPDFVVVDGVPVMLPSYDEAVSGGLSALGPGYMASVGQGCPLPVDDQSPPAYPGSGDTDTGPGESETCDSVSGSSELLQSLYSPPRCQESTHPASDNPDIIASTAEEVASTSPGIDIADEIPLMEEDP

SEQ ID NO: 14692 - protein, 629 aa, Artificial Sequence
  Description of Artificial Sequence: Synthetic coding sequence
MTAEGPSPPARWHRRLPGLWAAALLLLGLPRLSVRADGKFFVLESQNGSQGLQLEAARLSCKSRGAHLASADELRRVVQDCSFAVCTTGWLADGTLGTTVCSKGSGEQQIMRAVDVRIESNPVPGGTYSALCIKDEEKPCGDPPSFPHTILQGRTGLEMGDELLYVCAPGHIMGHRETAFTLLCNSCGEWYGLVQACGKDEAEAHIDYEDNFPDDRSVSFRELMEDSRTEADEDRGQGDSSEEAPKQDRLVSISVGRENIARDKVFVPTTGLPGAGSSVPADSPGSRLLQKHLFWFPAEAFHKPGLEKEVDDDTKKQFSAGDNHSGVKLVPGEPETKVIYGNTDGPSGPFVGKNDSKAGDPVVSSSDESWLDGYPVTEGAWRKTEAEEEEDGDRGDGSVGLDENVLVTPDQPILVEVKKPKSSTLTPSEGMTHSSVLPSQMLDVEALALRPVNASETEGIGDGDLTKYQSTLPWRFITEESPMATLSYELTSSTLEILTVNTVKQTPNHIPSTIMATTQPPVETTVPEIQDSFPYLLSEDFFGQEGPGPGASEELHPTLESCVGDGCPGLSRGPVIATIVTVLCLLLLLAGVGMVWGYRKCQHKSSVYKLNVGQRQARHYHQQIEMEKV

SEQ ID NO: 14693 - protein, 1274 aa, Artificial Sequence
  Description of Artificial Sequence: Synthetic coding sequence
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKTESVLIKRRLSAQGQAISVVGSLSSMSPLEEEAPQAKRRPEPIIPVTQPRLAGAGGRKKIFRLSDVLKPLTDAQVEAMKLGAVKRILRAEKAVACSGAAQVRIKILASLVTQFNSGLKAEVLSFILEDVRARLDLAFAWLYQEYNAYLAAGASGSLDKYEDCLIRLLSGLQEKPDQKDGIFTKVVLEAPLITESALEVVRKYCEDESRTYLGMSTLRDLIFKRPSRQFQYLHVLLDLSSHEKDKVRSQALLFIKRMYEKEQLREYVEKFALNYLQLLVHPNPPSVLFGADKDTEVAAPWTEETVKQCLYLYLALLPQNHKLIHELAAVYTEAIADIKRTVLRVIEQPIRGMGMNSPELLLLVENCPKGAETLVTRCLHSLTDKVPPSPELVKRVRDLYHKRLPDVRFLIPVLNGLEKKEVIQALPKLIKLNPIVVKEVFNRLLGTQHGEGNSALSPLNPGELLIALHNIDSVKCDMKSIIKATNLCFAERNVYTSEVLAVVMQQLMEQSPLPMLLMRTVIQSLTMYPRLGGFVMNILSRLIMKQVWKYPKVWEGFIKCCQRTKPQSFQVILQLPPQQLGAVFDKCPELREPLLAHVRSFTPHQQAHIPNSIMTILEASGKQEPEAKEAPAGPLEEDDLEPLTLAPAPAPRPPQDLIGLRLAQEKALKRQLEEEQKLKPGGVGAPSSSSPSPSPSARPGPPPSEEAMDFREEGPECETPGIFISMDDDSGLTEAALLDSSLEGPLPKETAAGGLTLKEERSPQTLAPVGEDAMKTPSPAAEDAREPEAKGNS

SEQ ID NO: 14694 - protein, 154 aa, Artificial Sequence
  Description of Artificial Sequence: Synthetic coding sequence
LTAAMASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLPVPVPACPPRPQLP

SEQ ID NO: 14695 - protein, 1299 aa, Artificial Sequence
  Description of Artificial Sequence: Synthetic coding sequence
MSRSRASIHRGSIPAMSYAPFRDVRGPSMHRTQYVHSPYDRPGWNPRFCIISGNQLLMLDEDEIHPLLIRDRRSESSRNKLLRRTVSVPVEGRPHGEHEYHLGRSRRKSVPGGKQYSMEGAPAAPFRPSQGFLSRRLKSSIKRTKSQPKLDRTSSFRQILPRFRSADHDRARLMQSFKESHSHESLLSPSSAAEALELNLDEDSIIKPVHSSILGQEFCFEVTTSSGTKCFACRSAAERDKWIENLQRAVKPNKDNSRRVDNVLKLWIIEARELPPKKRYYCELCLDDMLYARTTSKPRSASGDTVFWGEHFEFNNLPAVRALRLHLYRDSDKKRKKDKAGYVGLVTVPVATLAGRHFTEQWYPVTLPTGSGGSGGMGSGGGGGSGGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHCVFPRELKEVFASWRLRCAERGREDIADRLISASLFLRFLCPAIMSPSLFGLMQEYPDEQTSRTLTLIAKVIQNLANFSKFTSKEDFLGFMNEFLELEWGSMQQFLYEISNLDTLTNSSSFEGYIDLGRELSTLHALLWEVLPQLSKEALLKLGPLPRLLNDISTALRNPNIQRQPSRQSERPRPQPVVLRGPSAEMQGYMMRDLNSSIDLQSFMARGLNSSMDMARLPSPTKEKPPPPPPGGGKDLFYVSRPPLARSSPAYCTSSSDITEPEQKMLSVNKSVSMLDLQGDGPGGRLNSSSVSNLAAVGDLLHSSQASLTAALGLRPAPAGRLSQGSGSSITAAGMRLSQMGVTTDGVPAQQLRIPLSFQNPLFHMAADGPGPPGGHGGGGGHGPPSSHHHHHHHHHHRGGEPPGDTFAPFHGYSKSEDLSSGVPKPPAASILHSHSYSDEFGPSGTDFTRRQLSLQDNLQHMLSPPQITIGPQRPAPSGPGGGSGGGSGGGGGGQPPPLQRGKSQQLTVSAAQKPRPSSGNLLQSPEPSYGPARPRQQSLSKEGSIGGSGGSGGGGGGGLKPSITKQHSQTPSTLNPTMPASERTVAWVSNMPHLSADIESAHIEREEYKLKEYSKSMDESRLDRVKEYEEEIHSLKERLHMSNRKLEEYERRLLSQEEQTSKILMQYQARLEQSEKRLRQQQAEKDSQIKSIIGRLMLVEEELRRDHPAMAEPLPEPKKRLLDAQLLIR

SEQ ID NO: 14696 - protein, 487 aa, Artificial Sequence
  Description of Artificial Sequence: Synthetic coding sequence
EDFLGFMNEFLELEWGSMQQFLYEISNLDTLTNSSSFEGYIDLGRELSTLHALLWEVLPQLSKEALLKLGPLPRLLNDISTALRNPNIQRQPSRQSERPRPQPVVLRGPSAEMQGYMMRDLNSSMDMARLPSPTKEKPPPPPPGGGKDLFYVSRPPLARSSPAYCTSSSDITEPEQKMLSVNKSVSMLDLQGDGPGGRLNSSSVSNLAAVGDLLHSSQASLTAALGLRPAPAGRLSQGSGSSITAAGMRLSQMGVTTDGVPAQQLRIPLSFQNPLFHMAADGPGPPGGHGGGGGHGPPSSHHHHHHHHHHRGGEPPGDTFAPFHGYSKSEDLSSGVPKPPAASILHSHSYSDEFGPSGTDFTRRQLSLQDNLQHMLSPPQITIGPQRPAPSGPGGGSGGGSGGGGGGQPPPLQRGKSQQLTVSAAQKPRPSSGNLLQSPEPSYGPARPRQQSLSKEGSIGGSGGSGGGGGGGLKPSITKQHSQTPST

SEQ ID NO: 14697 - protein, 1299 aa, Artificial Sequence; identical to SEQ ID NO: 14695
  Description of Artificial Sequence: Synthetic coding sequence

SEQ ID NO: 14698 - protein, 1284 aa, Artificial Sequence
  Description of Artificial Sequence: Synthetic coding sequence
MGLRPPTPSPSGGSCSGSLPPPSRCQPLRRRCSSCCFPGEYHLGRSRRKSVPGGKQYSMEGAPAAPFRPSQGFLSRRLKSSIKRTKSQPKLDRTSSFRQILPRFRSADHDRARLMQSFKESHSHESLLSPSSAAEALELNLDEDSIIKPVHSSILGQEFCFEVTTSSGTKCFACRSAAERDKWIENLQRAVKPNKDNSRRVDNVLKLWIIEARELPPKKRYYCELCLDDMLYARTTSKPRSASGDTVFWGEHFEFNNLPAVRALRLHLYRDSDKKRKKDKAGYVGLVTVPVATLAGRHFTEQWYPVTLPTGSGGSGGMGSGGGGGSGGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHCVFPRELKEVFASWRLRCAERGREDIADRLISASLFLRFLCPAIMSPSLFGLMQEYPDEQTSRTLTLIAKVIQNLANFSKFTSKEDFLGFMNEFLELEWGSMQQFLYEISNLDTLTNSSSFEGYIDLGRELSTLHALLWEVLPQLSKEALLKLGPLPRLLNDISTALRNPNIQRQPSRQSERPRPQPVVLRGPSAEMQGYMMRDLNSSIDLQSFMARGLNSSMDMARLPSPTKEKPPPPPPGGGKDLFYVSRPPLARSSPAYCTSSSDITEPEQKMLSVNKSVSMLDLQGDGPGGRLNSSSVSNLAAVGDLLHSSQASLTAALGLRPAPAGRLSQGSGSSITAAGMRLSQMGVTTDGVPAQQLRIPLSFQNPLFHMAADGPGPPGGHGGGGGHGPPSSHHHHHHHHHHRGGEPPGDTFAPFHGYSKSEDLSSGVPKPPAASILHSHSYSDEFGPSGTDFTRRQLSLQDNLQHMLSPPQITIGPQRPAPSGPGGGSGGGSGGGGGGQPPPLQRGKSQQLTVSAAQKPRPSSGNLLQSPEPSYGPARPRQQSLSKEGSIGGSGGSGGGGGGGLKPSITKQHSQTPSTLNPTMPASERTVAWVSNMPHLSADIESAHIEREEYKLKEYSKSMDESRLDRVKEYEEEIHSLKERLHMSNRKLEEYERRLLSQEEQTSKILMQYQARLEQSEKRLRQQQAEKDSQIKSIIGRLMLVEEELRRDHPAMAEPLPEPKKRLLDAQERQLPPLGPTNPRVTLAPPWNGLAPPAPPPPPRLQITENGEFRNTADH

SEQ ID NO: 14699 - protein, 1343 aa, Artificial Sequence [sequence omitted]

SEQ ID NO: 14700 - protein, 1292 aa, Artificial Sequence
  Description of Artificial Sequence: Synthetic coding sequence
MSRSRASIHRGSIPAMSYAPFRDVRGPSMHRTQYVHSPYDRPGWNPRFCIISGNQLLMLDEDEIHPLLIRDRRSESSRNKLLRRTVSVPVEGRPHGEHEYHLGRSRRKSVPGGKQYSMEGAPAAPFRPSQGFLSRRLKSSIKRTKSQPKLDRTSSFRQILPRFRSADHDRARLMQSFKESHSHESLLSPSSAAEALELNLDEDSIIKPVHSSILGQEFCFEVTTSSGTKCFACRSAAERDKWIENLQRAVKPNKDNSRRVDNVLKLWIIEARELPPKKRYYCELCLDDMLYARTTSKPRSASGDTVFWGEHFEFNNLPAVRALRLHLYRDSDKKRKKDKAGYVGLVTVPVATLAGRHFTEQWYPVTLPTGSGGSGGMGSGGGGGSGGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHCVFPRELKEVFASWRLRCAERGREDIADRLISASLFLRFLCPAIMSPSLFGLMQEYPDEQTSRTLTLIAKVIQNLANFSKFTSKEDFLGFMNEFLELEWGSMQQFLYEISNLDTLTNSSSFEGYIDLGRELSTLHALLWEVLPQLSKEALLKLGPLPRLLNDISTALRNPNIQRQPSRQSERPRPQPVVLRGPSAEMQGYMMRDLNSSMDMARLPSPTKEKPPPPPPGGGKDLFYVSRPPLARSSPAYCTSSSDITEPEQKMLSVNKSVSMLDLQGDGPGGRLNSSSVSNLAAVGDLLHSSQASLTAALGLRPAPAGRLSQGSGSSITAAGMRLSQMGVTTDGVPAQQLRIPLSFQNPLFHMAADGPGPPGGHGGGGGHGPPSSHHHHHHHHHHRGGEPPGDTFAPFHGYSKSEDLSSGVPKPPAASILHSHSYSDEFGPSGTDFTRRQLSLQDNLQHMLSPPQITIGPQRPAPSGPGGGSGGGSGGGGGGQPPPLQRGKSQQLTVSAAQKPRPSSGNLLQSPEPSYGPARPRQQSLSKEGSIGGSGGSGGGGGGGLKPSITKQHSQTPSTLNPTMPASERTVAWVSNMPHLSADIESAHIEREEYKLKEYSKSMDESRLDREYEEEIHSLKERLHMSNRKLEEYERRLLSQEEQTSKILMQYQARLEQSEKRLRQQQAEKDSQIKSIIGRLMLVEEELRRDHPAMAEPLPEPKKRLLDAQRGSFPPWVQQTRV

SEQ ID NO: 14701 - protein, 1343 aa, Artificial Sequence [sequence omitted]

SEQ ID NO: 14702 - protein, 1299 aa, Artificial Sequence; identical to SEQ ID NO: 14695
  Description of Artificial Sequence: Synthetic coding sequence

SEQ ID NO: 14703 - protein, 682 aa, Artificial Sequence
  Description of Artificial Sequence: Synthetic coding sequence
MEEGFRDRAAFIRGAKDIAKEVKKHAAKKVVKGLDRVQDEYSRRSYSRFEEEDDDDDFPAPSDGYYRGEGTQDEEEGGASSDATEGHDEDDEIYEGEYQGIPRAESGGKGERMADGAPLAGVRGGLSDGEGPPGGRGEAQRRKEREELAQQYEAILRECGHGRFQWTLYFVLGLALMADGVEVFVVGFVLPSAEKDMCLSDSNKGMLGLIVYLGMMVGAFLWGGLADRLGRRQCLLISLSVNSVFAFFSSFVQGYGTFLFCRLLSGVGIGGSIPIVFSYFSEFLAQEKRGEHLSWLCMFWMIGGVYAAAMAWAIIPHYGWSFQMGSAYQFHSWRVFVLVCAFPSVFAIGALTTQPESPRFFLENGKHDEAWMVLKQVHDTNMRAKGHPERVFSVTHIKTIHQEDELIEIQSDTGTWYQRWGVRALSLGGQVWGNFLSCFGPEYRRITLMMMGVWFTMSFSYYGLTVWFPDMIRHLQAVDYASRTKVFPGERVEHVTFNFTLENQIHRGGQYFNDKFIGLRLKSVSFEDSLFEECYFEDVTSSNTFFRNCTFINTVFYNTDLFEYKFVNSRLINSTFLHNKEGCPLDVTGTGEGAYMVYFVSFLGTLAVLPGNIVSALLMDKIGRLRMLAGSSVMSCVSCFFLSFGNSESAMIALLCLFGGVSIASWNALDVLTVELYPSDKR

SEQ ID NO: 14704 - protein, 742 aa, Artificial Sequence
  Description of Artificial Sequence: Synthetic coding sequence
MEEGFRDRAAFIRGAKDIAKEVKKHAAKKVVKGLDRVQDEYSRRSYSRFEEEDDDDDFPAPSDGYYRGEGTQDEEEGGASSDATEGHDEDDEIYEGEYQGIPRAESGGKGERMADGAPLAGVRGGLSDGEGPPGGRGEAQRRKEREELAQQYEAILRECGHGRFQWTLYFVLGLALMADGVEVFVVGFVLPSAEKDMCLSDSNKGMLGLIVYLGMMVGAFLWGGLADRLGRRQCLLISLSVNSVFAFFSSFVQGYGTFLFCRLLSGVGIGGSIPIVFSYFSEFLAQEKRGEHLSWLCMFWMIGGVYAAAMAWAIIPHYGWSFQMGSAYQFHSWRVFVLVCAFPSVFAIGALTTQPESPRFFLENGKHDEAWMVLKQVHDTNMRAKGHPERVFSVTHIKTIHQEDELIEIQSDTGTWYQRWGVRALSLGGQVWGNFLSCFGPEYRRITLMMMGVWFTMSFSYYGLTVWFPDMIRHLQAVDYASRTKVFPGERVEHVTFNFTLENQIHRGGQYFNDKFIGLRLKSVSFEDSLFEECYFEDVTSSNTFFRNCTFINTVFYNTDLFEYKFVNSRLINSTFLHNKEGCPLDVTGTGEGAYMVYFVSFLGTLAVLPGNIVSALLMDKIGRLRMLAGSSVMSCVSCFFLSFGNSESAMIALLCLFGGVSIASWNALDVLTVELYPSDKRTTAFGFLNALCKLAAVLGISIFTSFVGITKAAPILFASAALALGSSLALKLPETRGQVLQ

SEQ ID NO: 14705 - protein, 683 aa, Artificial Sequence
  Description of Artificial Sequence: Synthetic coding sequence
MDDYKYQDNYGGYAPSDGYYRGNESNPEEDAQSDVTEGHDEEDEIYEGEYQGIPHPDDVKAKQAKMAPSRMDSLRGQTDLMAERLEDEEQLAHQYETIMDECGHGRFQWILFFVLGLALMADGVEVFVVSFALPSAEKDMCLSSSKKGMLGMIVYLGMMAGAFILGGLADKLGRKRVLSMSLAVNASFASLSSFVQGYGAFLFCRLISGIGIGGALPIVFAYFSEFLSREKRGEHLSWLGIFWMTGGLYASAMAWSIIPHYGWGFSMGTNYHFHSWRVFVIVCALPCTVSMVALKFMPESPRFLLEMGKHDEAWMILKQVHDTNMRAKGTPEKVFTVSNIKTPKQMDEFIEIQSSTGTWYQRWLVRFKTIFKQVWDNALYCVMGPYRMNTLILAVVWFAMAFSYYGLTVWFPDMIRYFQDEEYKSKMKVFFGEHVYGATINFTMENQIHQHGKLVNDKFTRMYFKHVLFEDTFFDECYFEDVTSTDTYFKNCTIESTIFYNTDLYEHKFINCRFINSTFLEQKEGCHMDLEQDNDFLIYLVSFLGSLSVLPGNIISALLMDRIGRLKMIGGSMLISAVCCFFLFFGNSESAMIGWQCLFCGTSIAAWNALDVITVELYPTNQRATAFGILNGLCKFGAILGNTIFASFVGITKVVPILLAAASLVGGGLIALRLPETREQVLM

SEQ ID NO: 14706 - protein, 683 aa, Artificial Sequence; identical to SEQ ID NO: 14705
  Description of Artificial Sequence: Synthetic coding sequence

SEQ ID NO: 14707 - protein, 532 aa, Artificial Sequence
  Description of Artificial Sequence: Synthetic coding sequence
MIVYLGMMAGAFILGGLADKLGRKRVLSMSLAVNASFASLSSFVQGYGAFLFCRLISGIGIGGALPIVFAYFSEFLSREKRGEHLSWLGIFWMTGGLYASAMAWSIIPHYGWGFSMGTNYHFHSWRVFVIVCALPCTVSMVALKFMPESPRFLLEMGKHDEAWMILKQVHDTNMRAKGTPEKVFTVSNIKTPKQMDEFIEIQSSTGTWYQRWLVRFKTIFKQVWDNALYCVMGPYRMNTLILAVVWFAMAFSYYGLTVWFPDMIRYFQDEEYKSKMKVFFGEHVYGATINFTMENQIHQHGKLVNDKFTRMYFKHVLFEDTFFDECYFEDVTSTDTYFKNCTIESTIFYNTDLYEHKFINCRFINSTFLEQKEGCHMDLEQDNDFLIYLVSFLGSLSVLPGNIISALLMDRIGRLKMIGGSMLISAVCCFFLFFGNSESAMIGWQCLFCGTSIAAWNALDVITVELYPTNQRATAFGILNGLCKFGAILGNTIFASFVGITKVVPILLAAASLVGGGLIALRLPETREQVLM

SEQ ID NO: 14708 - protein, 683 aa, Artificial Sequence; identical to SEQ ID NO: 14705
  Description of Artificial Sequence: Synthetic coding sequence

SEQ ID NO: 14709 - protein, 676 aa, Artificial Sequence
  Description of Artificial Sequence: Synthetic coding sequence
MEDSYKDRTSLMKGAKDIAREVKKQTVKKVNQAVDRAQDEYTQRSYSRFQDEEDDDDYYPAGETYNGEANDDEGSSEATEGHDEDDEIYEGEYQGIPSMNQAKDSIVSVGQPKGDEYKDRRELESERRADEEELAQQYELIIQECGHGRFQWALFFVLGMALMADGVEVFVVGFVLPSAETDLCIPNSGSGWLGSIVYLGMMVGAFFWGGLADKVGRKQSLLICMSVNGFFAFLSSFVQGYGFFLFCRLLSGFGIGGAIPTVFSYFAEVLAREKRGEHLSWLCMFWMIGGIYASAMAWAIIPHYGWSFSMGSAYQFHSWRVFVIVCALPCVSSVVALTFMPESPRFLLEVGKHDEAWMILKLIHDTNMRARGQPEKVFTVNKIKTPKQIDELIEIESDTGTWYRRCFVRIRTELYGIWLTFMRCFNYPVRDNTIKLTIVWFTLSFGYYGLSVWFPDVIKPLQSDEYALLTRNVERDKYANFTINFTMENQIHTGMEYDNGRFIGVKFKSVTFKDSVFKSCTFEDVTSVNTYFKNCTFIDTVFDNTDFEPYKFIDSEFKNCSFFHNKTGCQITFDDDYSAYWIYFVNFLGTLAVLPGNIVSALLMDRIGRLTMLGGSMVLSGISCFFLWFGTSESMMIGMLCLYNGLTISAWNSLDVVTVELYPTDRRRRVLPCCPG

SEQ ID NO: 14710 - protein, 727 aa, Artificial Sequence
  Description of Artificial Sequence: Synthetic coding sequence
MEDSYKDRTSLMKGAKDIAREVKKQTVKKVNQAVDRAQDEYTQRSYSRFQDEEDDDDYYPAGETYNGEANDDEGSSEATEGHDEDDEIYEGEYQGIPSMNQAKDSIVSVGQPKGDEYKDRRELESERRADEEELAQQYELIIQECGHGRFQWALFFVLGMALMADGVEVFVVGFVLPSAETDLCIPNSGSGWLGSIVYLGMMVGAFFWGGLADKVGRKQSLLICMSVNGFFAFLSSFVQGYGFFLFCRLLSGFGIGGAIPTVFSYFAEVLAREKRGEHLSWLCMFWMIGGIYASAMAWAIIPHYGWSFSMGSAYQFHSWRVFVIVCALPCVSSVVALTFMPESPRFLLEVGKHDEAWMILKLIHDTNMRARGQPEKVFTVNKIKTPKQIDELIEIESDTGTWYRRCFVRIRTELYGIWLTFMRCFNYPVRDNTIKLTIVWFTLSFGYYGLSVWFPDVIKPLQSDEYALLTRNVERDKYANFTINFTMENQIHTGMEYDNGRFIGVKFKSVTFKDSVFKSCTFEDVTSVNTYFKNCTFIDTVFDNTDFEPYKFIDSEFKNCSFFHNKTGCQITFDDDYSAYWIYFVNFLGTLAVLPGNIVSALLMDRIGRLTMLGGSMVLSGISCFFLWFGTSESMMIGMLCLYNGLTISAWNSLDVVTVELYPTDRRATGFGFLNALCKAAAVLGNLIFGSLVSITKSIPILLASTVLVCGGLVGLCLPDTRTQVLM

SEQ ID NO: 14711 - protein, 259 aa, Artificial Sequence
  Description of Artificial Sequence: Synthetic coding sequence
MAPNIYLVRQRISRLGQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 14712 - protein, 241 aa, Artificial Sequence
  Description of Artificial Sequence: Synthetic coding sequence
MSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 14713 - protein, 272 aa, Artificial Sequence
  Description of Artificial Sequence: Synthetic coding sequence
MSSTESAGRTADKSPRQQVDRLLVGLRWRRLEEPLGFIKVLQWLFAIFAFGSCGSYSGETGAMVRCNNEAKDVSSIIVAFGYPFRLHRIQYEMPLCDEESSSKTMHLMGDFSAPAEFFVTLGIFSFFYTMAALVIYLRFHNLYTENKRFPLVDFCVTVSFTFFWLVAAAAWGKGLTDVKGATRPSSLTAAMSVCHGEEAVCSAGATPSMGLANISVLFGFINFFLWAGNCWFVFKETPWHGQGQGQDQDQDQDQGQGPSQESAAEQGAVEKQ

SEQ ID NO: 14714 - protein, 208 aa, Artificial Sequence
  Description of Artificial Sequence: Synthetic coding sequence
MSSTESAGRTADKSPRQQVDRLLVGLRWRRLEEPLGFIKVLQWLFAIFAFGSCGSYSGETGAMVRCNNEAKDVSSIIVAFGYPFRLHRIQYEMPLCDEESSSKTMHLMGDFSAPAEFFVTLGIFSFFYTMAALVIYLRFHNLYTENKRFPLVLFGFINFFLWAGNCWFVFKETPWHGQGQGQDQDQDQDQGQGPSQESAAEQGAVEKQ

SEQ ID NO: 14715 - protein, 265 aa, Artificial Sequence
  Description of Artificial Sequence: Synthetic coding sequence
MCMVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 14716 - protein, 276 aa, Artificial Sequence
  Description of Artificial Sequence: Synthetic coding sequence
MCMVIFAPHNEECKSHFHLLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 14717 - protein, 285 aa, Artificial Sequence
  Description of Artificial Sequence: Synthetic coding sequence
MDPVSQLASAGTFRVLKEPLAFLRALELLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 14718 - protein, 58 aa, Artificial Sequence
  Description of Artificial Sequence: Synthetic coding sequence
MSGQTLTDRIAAAQYSVTGSAVARAVCKATTHEVMGPKKKHLDYLQTFFQQVLPNFEI

SEQ ID NO: 14719 - protein, 877 aa, Artificial Sequence
  Description of Artificial Sequence: Synthetic coding sequence
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNKSGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 14720 - protein, 902 aa, Artificial Sequence
  Description of Artificial Sequence: Synthetic coding sequence
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNNEGSGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 14721 - protein, 149 aa, Artificial Sequence
  Description of Artificial Sequence: Synthetic coding sequence
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVK

SEQ ID NO: 14722 - protein, 907 aa, Artificial Sequence
  Description of Artificial Sequence: Synthetic coding sequence
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNNEGSGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 14723 - protein, 907 aa, Artificial Sequence
  Description of Artificial Sequence: Synthetic coding sequence
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEQVGIDKGDIPDLTQAPSSLMETLEQHLNTLEGKKPGNNKISGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGDAFAASPGEAPAASEGAAAPATPTPVAAALDACSGNDPFAPSEGSAEAAPELDLFAMKPPETSVPVVTPTASTAPPVPATAPSPAPAVAAAAAATTAATAAATTTTTTSAATATTAPPALDIFGDLFESTPEVAAAPKPDAAPSIDLFSTDAFSSPPQGASPVPESSLTADLLSVDAFAAPSPATTASPAKVDSSGVIDLFGDAFGSSASEPQPASQAASSSSASADLLAGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 14724 - protein, 600 aa, Artificial Sequence
  Description of Artificial Sequence: Synthetic coding sequence
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMAPEKLLKSMPILQGQIDALLEFDVHPNELTNGVINAAFMLLFKDLIKLFACYNDGVINLLEKFFEMKKGQCKDALEIYKRFLTRMTRVSEFLKVAEAPSSLMETLEQHLNTLEGKKPGNKSGAPSPLSKSSPATTVTSPNSTPAKTIDTSPPVDLFATASAAVPVSTSKPSSDLLDLQPDFSSGGAAAAAAPAPPPPAGGATAWGGFGGSFMAPSPSPVTPAQNNLLQPNFEAAFGTTPSTSSSSSFDPSVFDGLGDLLMPTMAPAGQPAPVSMVPPSPAMAASKALGSDLDSSLASLVGNLGISGTTTKKGDLQWNAGEKKLTGGANWQPKVAPATWSAGVPPSAPLQGAVPPTSSVPPVAGAPSVGQPGAGFGMPPAGTGMPMMPQQPVMFAQPMMRPPFGAAAVPGTQLSPSPTPASQSPKKPPAKDPLADLNIKDFL

SEQ ID NO: 14725 - protein, 907 aa, Artificial Sequence; identical to SEQ ID NO: 14722
  Description of Artificial Sequence: Synthetic coding sequence

SEQ ID NO: 14726 - protein, 210 aa, Artificial Sequence
  Description of Artificial Sequence: Synthetic coding sequence
METLEQHLNTLEGKKPGNKYASGAPSPLSKSSPATTVTSPNSTPAKTIDTSPPVDLFATASAAVPVSTSKPSSDLLDLQPDFSSGGAAAAAAPAPPPPAGGATAWGDLLGEDSLAALSSVPSEAQISDPFAPEPTPPTTTAEIATASASASTTTTVTAVTAEVDLFGGSAEAAPELDLFAMKPPETSVPVVTPTASTAPPVPATAPSPAP

SEQ ID NO: 14727 - protein, 151 aa, Artificial Sequence
  Description of Artificial Sequence: Synthetic coding sequence
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKG

SEQ ID NO: 14728 - protein, 152 aa, Artificial Sequence
  Description of Artificial Sequence: Synthetic coding sequence
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGA

SEQ ID NO: 14729 - protein, 66 aa, Artificial Sequence
  Description of Artificial Sequence: Synthetic coding sequence
MSGQTLTDRIAAAQYSVTGSAVARAVCKATTHEVMGPKKKHLDYLIQATNETNVNIPQMADTLFER

SEQ ID NO: 14730 - protein, 600 aa, Artificial Sequence; identical to SEQ ID NO: 14724
  Description of Artificial Sequence: Synthetic coding sequence

SEQ ID NO: 14731 - protein, 902 aa, Artificial Sequence; identical to SEQ ID NO: 14720
  Description of Artificial Sequence: Synthetic coding sequence

SEQ ID NO: 14732 - protein, 907 aa, Artificial Sequence; identical to SEQ ID NO: 14722
  Description of Artificial Sequence: Synthetic coding sequence

SEQ ID NO: 14733 - protein, 117 aa, Artificial Sequence
  Description of Artificial Sequence: Synthetic coding sequence
MSGQTLTDRIAAAQYSVTGSAVARAVCKATTHEVMGPKKKHLDYLIQATNETNVNIPQMADTLFERATNSSWVVVFKALVTTHHLMVHGNERFIQYLASRNTLFNLSNFLDKSGSHG

SEQ ID NO: 14734 - protein, 562 aa, Artificial Sequence
  Description of Artificial Sequence: Synthetic coding sequence
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQARRRLMSGKVKVWGNVGTVEWADPIEDPDPEVMAKVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQVGARGRGGRGARGAAPSRGRGAAPPRGRAGYSQRGGPGSARGVRGARGGAQQQRGRGQGKGVEAGPDLLQ

SEQ ID NO: 14735 - protein, 623 aa, Artificial Sequence
  Description of Artificial Sequence: Synthetic coding sequence
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQARRRLMSGKVKVWGNVGTVEWADPIEDPDPEVMAKVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQVGARGRGGRGARGAAPSRGRGAAPPRGRAGYSQRGGPGSARGVRGARGGAQQQRGRGVRGARGGRGGNVGGKRKADGYNQPDSKRRQTNNQNWGSQPIAQQPLQGGDHSGNYGYKSENQEFYQDTFGQQWK

SEQ ID NO: 14736 - protein, 185 aa, Artificial Sequence
  Description of Artificial Sequence: Synthetic coding sequence
MATEHVNGNGTEEPMDTTSAVIHSENFQTLLDAGLPQKVAEKLDEIYVAGLVAHSDLDERAIEALKEFNEDGALAVLQQFKDSDLSHVQNKSAFLCGVMKTYRQREKQGTKVADSSKGPDEAKIKALLERTGYTLDVTTGQRKYGGPPPDSVYSGQQPSVGTEIFVGKIPRDLFEDELVPLFEKA

SEQ ID NO: 14737 - protein, 419 aa, Artificial Sequence
  Description of Artificial Sequence: Synthetic coding sequence
MRNIFKRNQEPIVAPATTTATMPIGPVDNSTESGGAGESQEDMFAKLKEKLFNEINKIPLPPWALIAIAVVAGLLLLTCCFCICKKCCCKKKKNKKEKGKGMKNAMNMKDMKGGQDDDDAETGLTEGEGEGEEEKEPENLGKLQFSLDYDFQANQLTVGVLQAAELPALDMGGTSDPYVKVFLLPDKKKKYETKVHRKTLNPAFNETFTFKVPYQELGGKTLVMAIYDFDRFSKHDIIGEVKVPMNTVDLGQPIEEWRDLQGGEKEEPEKLGDICTSLRYVPTAGKLTVCILEAKNLKKMDVGGLSDPYVKIHLMQNGKRLKKKKTTVKKKTLNPYFNESFSFEIPFEQIQKVQVVVTVLDYDKLGKNEAIGKIFVGSNATGTELRHWSDMLANPRRPIAQWHSLKPEEEVDALLGKNK

SEQ ID NO: 14738 - protein, 419 aa, Artificial Sequence; identical to SEQ ID NO: 14737
  Description of Artificial Sequence: Synthetic coding sequence

SEQ ID NO: 14739 - protein, 401 aa, Artificial Sequence
  Description of Artificial Sequence: Synthetic coding sequence
MLHLHGWQTMQGRKMGHPPVSPSAPAPAGTTAIPGLIPDLVAGTPWPRWALIAGALAAGVLLVSCLLCAACCCCRRHRKKPRDKESVGLGSARGTTTTHLVQPDVDGLESSPGDAQQWGCLQLSLEFDFGSQEIRVGLRQAADLRPGGTVDPYARVSVSTQAGHRHETKVHRGTLCPVFDETCCFHIPQAELPGATLQVQLFNFKRFSGHEPLGELRLPLGTVDLQHVLEHWYLLGPPAATQPEQVGELCFSLRYVPSSGRLTVVVLEARGLRPGLAEPYVKVQLMLNQRKWKKRKTATKKGTAAPYFNEAFTFLVPFSQVQNVDLVLAVWDRSLPLRTEPVGKVHLGARASGQPLQHWADMLAHARRPIAQRHPLRPAREVDRMLALQPRLRLRLPLPHS

SEQ ID NO: 14740 - protein, 158 aa, Artificial Sequence
  Description of Artificial Sequence: Synthetic coding sequence
MGHPPVSPSAPAPAGTTAIPGLIPDLVAGTPWPRWALIAGALAAGVLLVSCLLCAACCCCRRHRKKPRDKESVGLGSARGTTTTHLVQPDVDGLESSPGDAQQWGCLQLSLEFDFGSQEVKGPAAQDQRFCEFPERVTGEGQTPCPGWWGADRAGALG

SEQ ID NO: 14741 - protein, 310 aa, Artificial Sequence
  Description of Artificial Sequence: Synthetic coding sequence
MPSSKPGSPAPQDPSPSCRTCSNQVQPGHLLLPLTKASLTGPSPPPAKLGRAQGAPSPKGPLEIGWSPDAQPLRLGETFLPKGVAQLSRASSSGHKVGFLQPWPPHPLLPQERVPRHQRQCCPRAGPAFGCLRGRPGGWPATGSGGRQQGRKMGHPPVSPSAPAPAGTTAIPGLIPDLVAGTPWPRWALIAGALAAGVLLVSCLLCAACCCCRRHRKKPRDKESVGLGSARGTTTTHLVQPDVDGLESSPGDAQQWGCLQLSLEFDFGSQEVKGPAAQDQRFCEFPERVTGEGQTPCPGWWGADRAGALG

SEQ ID NO: 14742 - protein, 523 aa, Artificial Sequence
  Description of Artificial Sequence: Synthetic coding sequence
MSFHKEDGVNSLCQKALHIVTELCFAGQVEWEKCSGIFPRDRGSQGGSSTDISVSLLAVVVSFCGLALLVVSLFVFWKLCWPCWKSKPVTSNITTLPQSISSAPTEVFETEEKKEIKENEKPAVKAIEPAIKISHTSPDIPAEVQTALKEHLIKHARVQRQITEPTSSTRHSSFRRHLPRQMQVSSVDFSMGTEPVLQRGETTTSIGRIKPELYKQKSVDSEGNQNEDVKICGKLNFTLQYDYENELLVVKIIKALDLPAKDFTGTSDPYVKMYLLPDRKKKFQTRVHRKTLNPLFDETFQFPVAYDQLSNRKLHFSVYDFDRFSRHDMIGEVILDNLFEVSDLSREATVWKDIHCATTESIDLGEIMFSLCYLPTAGRMTLTVIKCRNLKAMDITGSSDPYVKVSLMCEGRRLKKRKTTTKKNTLNPVYNEAIIFDIPPENVDQVSLSIAVMDYDRVGHNEVIGVCRTGLDAEGLGRDHWNEMLAYHRKPITHWHPLLELPGRATSFDSQGSCPSPKPPSTP

SEQ ID NO: 14743 - protein, 342 aa, Artificial Sequence
  Description of Artificial Sequence: Synthetic coding sequence
MQVSSVDFSMGTEPVLQRGETTTSIGRIKPELYKQKSVDSEGNQNEDVKICGKLNFTLQYDYENELLVVKIIKALDLPAKDFTGTSDPYVKMYLLPDRKKKFQTRVHRKTLNPLFDETFQFPVAYDQLSNRKLHFSVYDFDRFSRHDMIGEVILDNLFEVSDLSREATVWKDIHCATTESIDLGEIMFSLCYLPTAGRMTLTVIKCRNLKAMDITGSSDPYVKVSLMCEGRRLKKRKTTTKKNTLNPVYNEAIIFDIPPENVDQVSLSIAVMDYDRVGHNEVIGVCRTGLDAEGLGRDHWNEMLAYHRKPITHWHPLLELPGRATSFDSQGSCPSPKPPSTP

SEQ ID NO: 14744 - protein, 431 aa, Artificial Sequence
  Description of Artificial Sequence: Synthetic coding sequence
MAEITNIRPSFDVSPVVAGLIGASVLVVCVSVTVFVWSCCHQQAEKKQKNPPYKFIHMLKGISIYPETLSNKKKIIKVRRDKDGPGREGGRRNLLVDAAEAGLLSRDKDPRGPSSGSCIDQLPIKMDYGEELRSPITSLTPGESKTTSPSSPEEDVMLGSLTFSVDYNFPKKALVVTIQEAHGLPVMDDQTQGSDPYIKMTILPDKRHRVKTRVLRKTLDPVFDETFTFYGIPYSQLQDLVLHFLVLSFDRFSRDDVIGEVMVPLAGVDPSTGKVQLTRDIIKRNIQKCISRGELQVSLSYQPVAQRMTVVVLKARHLPKMDITGLSGNPYVKVNVYYGRKRIAKKKTHVKKCTLNPIFNESFIYDIPTDLLPDISIEFLVIDFDRTTKNEVVGRLILGAHSVTASGAEHWREVCESPRKPVAKWHSLSEY

SEQ ID NO: 14745 - protein, 124 aa, Artificial Sequence
  Description of Artificial Sequence: Synthetic coding sequence
MTVVVLKARHLPKMDITGLSGNPYVKVNVYYGRKRIAKKKTHVKKCTLNPIFNESFIYDIPTDLLPDISIEFLVIDFDRTTKNEVVGRLILGAHSVTASGAEHWREVCESPRKPVAKWHSLSEY

SEQ ID NO: 14746 - protein, 474 aa, Artificial Sequence
  Description of Artificial Sequence: Synthetic coding sequence
MAYIQLEPLNEGFLSRISGLLLCRWTCRHCCQKCYESSCCQSSEDEVEILGPFPAQTPPWLMASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 14747 - protein, 476 aa, Artificial Sequence
  Description of Artificial Sequence: Synthetic coding sequence
MASPEPRRGGDGAAQAARKTRVEANSPLPKNSGSLNEAEALNPEVTLSSEGSLNLEDILYLEDTGDLDETLYVQETEKAEEALYIEEAMQPDEALHVEEPGNPEETVCVEETTEPDRIQFVEGPVEPGKPTSPEHVVYEGETVTRAEKSNPEESLRAEQSPSMEENLSIEDLELLEGRFQQCVQAVAQLEEERDQLIHELVLLREPALQEVQQVHQDILAAYKLHAQAELERDGLREEIRLVKQKLFKVTKECVAYQYQLECRQQDVAQFADFREVLTTRATQLSEELAQLRDAYQKQKEQLRQQLEAPPSQRDGHFLQESRRLSAQFENLMAESRQDLEEEYEPQFLRLLERKEAGTKALQRTQAEIQEMKEALRPLQAEARQLRLQNRNLEDQIALVRQKRDEEVQQYREQLEEMEERQRQLRNGVQLQQQKNKEMEQLRLSLAEELSTYKGCLEIYGQICNPETAKNFLAKDH

SEQ ID NO: 14748 - protein, 482 aa, Artificial Sequence
  Description of Artificial Sequence: Synthetic coding sequence
MASPEPRRGGDGAAQAARKTRVEANSPLPKNSGSLNEAEALNPEVTLSSEGSLNLEDILYLEDTGDLDETLYVQETEKAEEALYIEEAMQPDEALHVEEPGNPEETVCVEETTEPDRIQFVEGPVEPGKPTSPEHVVYEGETVTRAEKSNPEESLRAEQSPSMEENLSIEDLELLEGRFQQCVQAVAQLEEERDQLIHELVLLREPALQEVQQVHQDILAAYKLHAQAELERDGLREEIRLVKQKLFKVTKECVAYQYQLECRQQDVAQFADFREVLTTRATQLSEELAQLRDAYQKQKEQLRQQLEAPPSQRDGHFLQESRRLSAQFENLMAESRQDLEEEYEPQFLRLLERKEAGTKALQRTQAEIQEMKEALRPLQAEARQLRLQNRNLEDQIALVRQKRDEEVQQYREQLEEMEERQRQLRNGVQLQQQKNKEMEQLRLSLAEELSTYKAMLLPKSLEQADAPTSQAGGMETQSQGAV

SEQ ID NO: 14749 - protein, 90 aa, Artificial Sequence
  Description of Artificial Sequence: Synthetic coding sequence
MQPDEALHVEEPGNPEETVCVEETTEPDRIQFVEGPVEPGKPTSPEHVVYEGETVTRAEKSNPEESLRAEQSPSMEENLSIEDLELLEGR

SEQ ID NO: 14750 - protein, 70 aa, Artificial Sequence
  Description of Artificial Sequence: Synthetic coding sequence
MQPDEALHVEEPGNPEETVCVEETTEPDRIQFVEGPVEPGKPTSPEHVVYEGETVTRAEKSNPEESLRAE

SEQ ID NO: 14751 - protein, 134 aa, Artificial Sequence
  Description of Artificial Sequence: Synthetic coding sequence
MSPLRPLLLALALASVPCAQGACPASADLKHSDGTRTCAKLYDKSDPYYENCCGGAELSLESGADLPYLPSNWANTASSLVVAPRCELTVWSRQGKAGKTHKFSAGTYPRLEEYRRGILGDWSNAISALYCRCS

SEQ ID NO: 14752 - protein, 298 aa, Artificial Sequence
  Description of Artificial Sequence: Synthetic coding sequence
MSLYPSLEDLKVDKVIQAQTAFSANPANPAILSEASAPIPHDGNLYPRLYPELSQYMGLSLNEEEIRANVAVVSGAPLQGQLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKQAFGEKITMTIRDRPFERTITMHKDSTGHVGFIFKNGKITSIVKDSSAARNGLLTEHNICEINGQNVIGLKDSQIADILSTSGTVVTITIMPAFIFEHIIKRMAPSIMKSLMDHTIPEV

SEQ ID NO: 14753 - protein, 298 aa, Artificial Sequence; identical to SEQ ID NO: 14752
  Description of Artificial Sequence: Synthetic coding sequence

SEQ ID NO: 14754 - protein, 297 aa, Artificial Sequence
  Description of Artificial Sequence: Synthetic coding sequence
MSLYPSLEDLKVDKVIQAQTAFSANPANPAILSEASAPIPHDGNLYPRLYPELSQYMGLSLNEEEIRANVAVVSGAPLQGLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKQAFGEKITMTIRDRPFERTITMHKDSTGHVGFIFKNGKITSIVKDSSAARNGLLTEHNICEINGQNVIGLKDSQIADILSTSGTVVTITIMPAFIFEHIIKRMAPSIMKSLMDHTIPEV

SEQ ID NO: 14755 - protein, 292 aa, Artificial Sequence
  Description of Artificial Sequence: Synthetic coding sequence
MSLYPSLEDLKAQTAFSANPANPAILSEASAPIPHDGNLYPRLYPELSQYMGLSLNEEEIRANVAVVSGAPLQGQLVARPSSINYMVAPVTGNDVGIRRAEIKQGIREVILCKDQDGKIGLRLKSIDNGIFVQLVQANSPASLVGLRFGDQVLQINGENCAGWSSDKAHKVLKQAFGEKITMTIRDRPFERTITMHKDSTGHVGFIFKNGKITSIVKDSSAARNGLLTEHNICEINGQNVIGLKDSQIADILSTSGTVVTITIMPAFIFEHIIKRMAPSIMKSLMDHTIPEV

SEQ ID NO: 14756 - protein, 297 aa, Artificial Sequence; identical to SEQ ID NO: 14754
  Description of Artificial Sequence: Synthetic coding sequence

SEQ ID NO: 14757 - protein, 292 aa, Artificial Sequence
  Description of Artificial Sequence: Synthetic coding sequence
MSSLYPSLEDLKVDQAIQAQVRASPKMPALPVQATAISPPPVLYPNLAELENYMGLSLSSQEVQESLLQIPEGDSTAVSGPGPGQMVAPVTGYSLGVRRAEIKPGVREIHLCKDERGKTGLRLRKVDQGLFVQLVQANTPASLVGLRFGDQLLQIDGRDCAGWSSHKAHQVVKKASGDKIVVVVRDRPFQRTVTMHKDSMGHVGFVIKKGKIVSLVKGSSAARNGLLTNHYVCEVDGQNVIGLKDKKIMEILATAGNVVTLTIIPSVIYEHMVKKLPPVLLHHTMDHSIPDA

SEQ ID NO: 14758 - protein, 292 aa, Artificial Sequence; identical to SEQ ID NO: 14757
  Description of Artificial Sequence: Synthetic coding sequence

SEQ ID NO: 14759 - protein, 207 aa, Artificial Sequence
  Description of Artificial Sequence: Synthetic coding sequence
MVAPVTGYSLGVRRAEIKPGVREIHLCKDERGKTGLRLRKVDQGLFVQLVQANTPASLVGLRFGDQLLQIDGRDCAGWSSHKAHQVVKKASGDKIVVVVRDRPFQRTVTMHKDSMGHVGFVIKKGKIVSLVKGSSAARNGLLTNHYVCEVDGQNVIGLKDKKIMEILATAGNVVTLTIIPSVIYEHMVKKLPPVLLHHTMDHSIPDA

SEQ ID NO: 14760 - protein, 292 aa, Artificial Sequence; identical to SEQ ID NO: 14757
  Description of Artificial Sequence: Synthetic coding sequence

SEQ ID NO: 14761 - protein, 249 aa, Artificial Sequence
  Description of Artificial Sequence: Synthetic coding sequence
MSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSDRRQWCAIAVLVGVLLLVLILLFSL

SEQ ID NO: 14762 - protein, 200 aa, Artificial Sequence
  Description of Artificial Sequence: Synthetic coding sequence
MSLEDPFFVVRGEVQKAVNTARGLYQRWCELLQESAAVGREELDWTTNELRNGLRSIEWDLEDLEETIGIVEANPGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSDRRQWCAIAVLVGVLLLVLILLFSL

SEQ ID NO: 14763 - protein, 246 aa, Artificial Sequence
  Description of Artificial Sequence: Synthetic coding sequence
MSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSGESPQGRGQSWWGQVVGGTLSP

SEQ ID NO: 14764 - protein, 249 aa, Artificial Sequence; identical to SEQ ID NO: 14761
  Description of Artificial Sequence: Synthetic coding sequence

SEQ ID NO: 14765 - protein, 246 aa, Artificial Sequence; identical to SEQ ID NO: 14763
  Description of Artificial Sequence: Synthetic coding sequence

SEQ ID NO: 14766 - protein, 276 aa, Artificial Sequence
  Description of Artificial Sequence: Synthetic coding sequence
MSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSAEERQREEQLVSFDSHEEWNQMQSQEDEVAITEQDLELIKERETAIRQLEADILDVNQIFKDLAMMIHDQGDLIDSIEANVESSEVHVERATEQLQRAAYYQKKSRKKMCILVLVLSVIILILGLIIWLVYKTK

SEQ ID NO: 14767 - protein, 234 aa, Artificial Sequence
  Description of Artificial Sequence: Synthetic coding sequence
MSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSAEERQREEQLVSFDSSLLLDMKNVALQDFIDSRGLEPCHEEWNQMQSQEDEVAITEQDLELIKERETAIRQLEADILDVNQIFKDLAMMIHD

SEQ ID NO: 14768 - protein, 335 aa, Artificial Sequence
  Description of Artificial Sequence: Synthetic coding sequence
MAVDITLLFRASVKTVKTRNKALGVAVGGGVDGSRDELFRRSPRPKGDFSSRAREVISHIGKLRDFLLEHRKDYINAYSHTMSEYGRMTDTERDQIDQDAQIFMRTCSEAIQQLRTEAHKEIHSQQVKEHRTAVLDFIEDYLKRVCKLYSEQRAIRVKRVVDKKRLSKLEPEPNTKTRESTSSEKVSQSPSKDSEENPATEERPEKILAETQPELGTWGDGKGEDELSPEEIQMFEQENQRLIGEMNSLFDEVRQIEGRVVEISRLQEIFTEKVLQQEAEIDSIHQLVVGATENIKEGNEDIREAIKNNAGFRVWILFFLVMCSFSLLFLDWYDS

SEQ ID NO: 14769 - protein, 255 aa, Artificial Sequence
  Description of Artificial Sequence: Synthetic coding sequence
MSMEDPFFVVKGEVQKAVNTAQGLFQRWTELLQDPSTATREEIDWTTNELRNNLRSIEWDLEDLDETISIVEANPRKFNLDATELSIRKAFITSTRQVVRDMKDQMSTSSVQALAERKNRQALLGDSGSQNWSTGTTDKYGRLDRELQRANSHFIEEQQAQQQLIVEQQDEQLELVSGSIGVLKNMSQRIGGELEEQAVMLEDFSHELESTQSRLDNVMKKLAKVSHMTSDRRQWCAIAILFAVLLVVLILFLVL

SEQ ID NO: 14770 - protein, 154 aa, Artificial Sequence
  Description of Artificial Sequence: Synthetic coding sequence
MKDQMSTSSVQALAERKNRQALLGDSGSQNWSTGTTDKYGRLDRELQRANSHFIEEQQAQQQLIVEQQDEQLELVSGSIGVLKNMSQRIGGELEEQAVMLEDFSHELESTQSRLDNVMKKLAKVSHMTSDRRQWCAIAILFAVLLVVLILFLVL

SEQ ID NO: 14771 - protein, 592 aa, Artificial Sequence
  Description of Artificial Sequence: Synthetic coding sequence
MAPPVAERGLKSVVWQKIKATVFDDCKKEGEWKIMLLDEFTTKLLASCCKMTDLLEEGITVVENIYKNREPVRQMKALYFITPTSKSVDCFLHDFASKSENKYKAAYIYFTDFCPDNLFNKIKASCSKSIRRCKEINISFIPHESQVYTLDVPDAFYYCYSPDPGNAKGKDAIMETMADQIVTVCATLDENPGVRYKSKPLDNASKLAQLVEKKLEDYYKIDEKSLIKGKTHSQLLIIDRGFDPVSTVLHELTFQAMAYDLLPIENDTYKYKTDGKEKEAILEEEDDLWVRIRHRHIAVVLEEIPKLMKEISSTKKATEGKTSLSALTQLMKKMPHFRKQITKQVVHLNLAEDCMNKFKLNIEKLCKTEQDLALGTDAEGQKVKDSMRVLLPVLLNKNHDNCDKIRAILLYIFSINGTTEENLDRLIQNVKIENESDMIRNWSYLGVPIVPQSQQGKPLRKDRSAEETFQLSRWTPFIKDIMEDAIDNRLDSKEWPYCSQCPAVWNGSGAVSARQKPRANYLEDRKNGSKLIVFVIGGITYSEVRCAYEVSQAHKSCEVIIGSTHVLTPKKLLDDIKMLNKPKDKVSLIKDE

SEQ ID NO: 14772 - protein, 505 aa, Artificial Sequence
  Description of Artificial Sequence: Synthetic coding sequence
MASGRRAPRTGLLELRAGAGSGAGGERWQRVLLSLAEDVLTVSPADGDPGPEPGAPREQEPAQLNGAAEPGAGPPQLPEALLLQRRRVTVRKADAGGLGISIKGGRENKMPILISKIFKGLAADQTEALFVGDAILSVNGEDLSSATHDEAVQVLKKTGKEVVLEVKYMKDVSPYFKNSTGGTSVGWDSPPASPLQRQPSSPGPTPRNFSEAKHMSLKMAYVSKRCTPNDPEPRYLEICSADGQDTLFLRAKDEASARSWATAIQAQVNTLTPRVKDELQALLAATSTAGSQDIKQIGWLTEQLPSGGTAPTLALLTEKELLLYLSLPETREALSRPARTAPLIATRLVHSGPSKGSVPYDAELSFALRTGTRHGVDTHLFSVESPQELAAWTRQLVDGCHRAAEGVQEVSTACTWNGRPCSLSVHIDKGFTLWAAEPGAARAVLLRQPFEKLQMSSDDGASLLFLDFGGAEGEIQLDLHSCPKTIVFIIHSFLSAKVTRLGLLA

SEQ ID NO: 14773 - protein, 539 aa, Artificial Sequence
  Description of Artificial Sequence: Synthetic coding sequence
MGTEGPPPPAASRGRQGCLLVPARTKTTIALLYDEESENAYDIRLKLTKEVLTIQKQDVVCVGGSHQGRNRRTVTLRRQPVGGLGLSIKGGSEHNVPVVISKIFEDQAADQTGMLFVGDAVLQVNGIHVENATHEEVVHLLRNAGDEVTITVEYLREAPAFLKLPLGSPGPSSDHSSGASSPLFDSGLHLNGNSSTTAPSSPSSPIAKDPRYEKRWLDTLSVPLSMARISRYKAGTEKLRWNAFEVLALDGVSSGILRFYTAQDGTDWLRAVSANIRELTLQNMKMANKCCSPSDQVVHMGWVNEKLQGADSSQTFRPKFLALKGPSFYVFSTPPVSTFDWVRAERTYHLCEVLFKVHKFWLTEDCWLQANLYLGLQDFDFEDQRPYCFSIVAGHGKSHVFNVELGSELAMWEKSFQRATFMEVQRTGSRTYMCSWQGEMLCFTVDFALGFTCFESKTKNVLWRFKFSQLKGSSDDGKTRVKLLFQNLDTKQIETKELEFQDLRAVLHCIHSFIAAKVASVDPGFMDSQSLARKYMYSS

SEQ ID NO: 14774 - protein, 179 aa, Artificial Sequence
  Description of Artificial Sequence: Synthetic coding sequence
  MOD_RES (1)..(1): Any amino acid
XDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 14775 - protein, 154 aa, Artificial Sequence
  Description of Artificial Sequence: Synthetic coding sequence
  MOD_RES (1)..(1): Any amino acid
XSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 14776 - protein, 118 aa, Artificial Sequence
  Description of Artificial Sequence: Synthetic coding sequence
MRWALLVLLAFLSPASQKSSNLEGRTKSVTRQTGSSAEITCDLTVTNTFYIHWYLHQEGKAPQRLLYYDVSTARDVLESGLSPGKYYTHTPRRWSWILRLQNLIENDSGVYYCATWDR

SEQ ID NO: 14777 - protein, 271 aa, Artificial Sequence
  Description of Artificial Sequence: Synthetic coding sequence
MIPKLLSLLCFRLCVGQGDTRGDGSLPKPSLSAWPSSVVPANSNVTLRCWTPARGVSFVLRKGGIILESPKPLDSTEGAAEFHLNNLKVRNAGEYTCEYYRKASPHILSQRSDVLLLLVTGHLSKPFLRTYQRGTVTAGGRVTLQCQKRDQLFVPIMFALLKAGTPSPIQLQSPAGKEIDFSLVDVTAGDAGNYSCMYYQTKSPFWASEPSDQLEILVTVPPGTTSSNYSLGNFVRLGLAAVIVVIMGAFLVEAWYSRNVSPGESEAFKPE

SEQ ID NO: 14778 - protein, 279 aa, Artificial Sequence [sequence omitted]

SEQ ID NO: 14779 - protein, 316 aa, Artificial Sequence
  Description of Artificial Sequence: Synthetic coding sequence
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPVKIISVNEDVTLRSALDRNLKSAVTAAFLMLPESFSEEDLFIEIAGLSYSGDFRMVVGEDKTKVLNIVKPNIAHFRELYGSILQENPQVVYKSQQGWLEIDKSPEGQFTQLMTLPKTLQQQINHIMDPPGKNRDVEETLFQVAHDPDCGDVVRLGLKKSVIYSSLKLHKMWKGWLRKTS

SEQ ID NO: 14780 - protein, 729 aa, Artificial Sequence
  Description of Artificial Sequence: Synthetic coding sequence
MQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKAITGVVCYACRIASTLLLYQELMRKGIRWLIELIKDDYNETVHKKTEVVITLDFCIRNIEKTVKVYEKLMKINLEAAELGEISDIHTKLLRLSSSQGTIETSLQDIDSRLSPGGSLADAWAHQEGTHPKDRNVEKLQVLLNCMTEIYYQFKKDKAERRLAYNEEQIHKFDKQKLYYHATKAMTHFTDECVKKYEAFLNKSEEWIRKMLHLRKQLLSLTNQCFDIEEEVSKYQEYTNELQETLPQKMFTASSGIKHTMTPIYPSSNTLVEMTLGMKKLKEEMEGVVKELAENNHILERFGSLTMDGGLRNVDCL

SEQ ID NO: 14781 - protein, 103 aa, Artificial Sequence
  Description of Artificial Sequence: Synthetic coding sequence
MQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSN

SEQ ID NO: 14782 - protein, 98 aa, Artificial Sequence
  Description of Artificial Sequence: Synthetic coding sequence
MQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVL

SEQ ID NO: 14783 - protein, 307 aa, Artificial Sequence
  Description of Artificial Sequence: Synthetic coding sequence
MHDDESTINSSSSVVHKKDHVFIRDEAGHGDPRPEPRPTQSVQSQALHYRNRERFATIKSASLVTRQIHEHEQENELREQMSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTEGDGACHANPDESTRELEYRQLHTLQKLHGSDPFTAPDGTGKPAGVQ

SEQ ID NO: 14784 - protein, 898 aa, Artificial Sequence
  Description of Artificial Sequence: Synthetic coding sequence
MRKGVLKDPEIADLFYKDDPEELFIGLHEIGHGSFGAVYFATNAHTSEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLIDLIQRTKDAVRELDNLQYRKMKKILFQETRNGPLNESQEDEEDSEHGTSLNREMDSLGSNHSIPSMSVSTGSQSSSVNSMQEVMDESSSELVMMHDDESTINSSSSVVHKKDHVFIRDEAGHGDPRPEPRPTQSVQSQALHYRNRERFATIKSASLVTRQIHEHEQENELREQMSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 14785 - protein, 898 aa, Artificial Sequence; identical to SEQ ID NO: 14784
  Description of Artificial Sequence: Synthetic coding sequence

SEQ ID NO: 14786 - protein, 136 aa, Artificial Sequence
  Description of Artificial Sequence: Synthetic coding sequence
MRKGVLKDPEIADLFYKDDPEELFIGLHEIGHGSFGAVYFATNAHTSEVVAIKKMSYSGKQTHEKWQDILKEVKFLRQLKHPNTIEYKGCYLKEHTAWLVMEYCLGSASDLLEVHKKPLQEVEIAAITHGALHGLA

SEQ ID NO: 14787 - protein, 18 aa, Artificial Sequence
  Description of Artificial Sequence: Synthetic coding sequence
MRKGVLKDPEIADLFYKD

SEQ ID NO: 14788 - protein, 93 aa, Artificial Sequence
  Description of Artificial Sequence: Synthetic coding sequence
MRKGVLKDPEIADLFYKDDPEELFIGLHEIGHGSFGAVYFATNAHTSEVVAIKKMSYSGKQTHEKWQDILKEVKFLRQLKHPNTIEYKGCYLK

SEQ ID NO: 14789 - protein, 21 aa, Artificial Sequence
  Description of Artificial Sequence: Synthetic coding sequence
MRKGVLKDPEIADLFYKDDPE

SEQ ID NO: 14790 - protein, 62 aa, Artificial Sequence
  Description of Artificial Sequence: Synthetic coding sequence
MRKGVLKDPEIADLFYKDDPEELFIGLHEIGHGSFGAVYFATNAHTSEVVAIKKMSYSGKQT

SEQ ID NO: 14791 - protein, 36 aa, Artificial Sequence
  Description of Artificial Sequence: Synthetic coding sequence
MRKGVLKDPEIADLFYKDDPEELFIGLHEIGHGSFG

SEQ ID NO: 14792 - protein, 57 aa, Artificial Sequence
  Description of Artificial Sequence: Synthetic coding sequence
MRKGVLKDPEIADLFYKDDPEELFIGLHEIGHGSFGAVYFATNAHTSEVVAIKKMSY

SEQ ID NO: 14793 - protein, 468 aa, Artificial Sequence
  Description of Artificial Sequence: Synthetic coding sequence
MGTQEGWCLLLCLALSGAAETKPHPAEGQWRAVDVVLDCFLAKDGAHRGALASSEDRARASLVLKQVPVLDDGSLEDFTDFQGGTLAQDDPPIIFEASVDLVQIPQAEALLHADCSGKEVTCEISRYFLQMTETTVKTAAWFMANMQVSGGGPSISLVMKTPRVTKNEALWHPTLNLPLSPQGTVRTAVEFQVMTQTQSLSFLLGSSASLDCGFSMAPGLDLISVEWRLQHKGRGQLVYSWTAGQGQAVRKGATLEPAQLGMARDASLTLPGLTIQDEGTYICQITTSLYRAQQIIQLNIQASPKVRLSLANEALLPTLICDIAGYYPLDVVVTWTREELGGSPAQVSGASFSSLRQSVAGTYSISSSLTAEPGSAGATYTCQVTHISLEEPLGASTQVVPPERRTALGVIFASSLFLLALMFLGLQRRQAPTGLGLLQAERWETTSCADTQSSHLHEDRTARVSQPS

SEQ ID NO: 14794 - protein, 399 aa, Artificial Sequence
  Description of Artificial Sequence: Synthetic coding sequence
MCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 14795 - protein, 476 aa, Artificial Sequence
  Description of Artificial Sequence: Synthetic coding sequence
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 14796 - protein, 399 aa, Artificial Sequence; identical to SEQ ID NO: 14794
  Description of Artificial Sequence: Synthetic coding sequence

SEQ ID NO: 14797 - protein, 364 aa, Artificial Sequence
  Description of Artificial Sequence: Synthetic coding sequence
MCVQNCGPSFQSLIVKKEFVKENLVKLLNPRYNLPLDIQNRILNFIKTWSQGFPGGVDVSEVKEVYLDLVKKGVQFPPSEAEAETARQEIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 14798 - protein, 476 aa, Artificial Sequence; identical to SEQ ID NO: 14795
  Description of Artificial Sequence: Synthetic coding sequence

SEQ ID NO: 14799 - protein, 299 aa, Artificial Sequence
  Description of Artificial Sequence: Synthetic coding sequence
MLESHLIIYFLLAVIQFLLGIFTNGIIVVVNGIDLIKHRKMAPLDLLLSCLAVSRIFLQLFIFYVNVIVIFFIEFIMCSANCAILLFINELELWLATWLGVFYCAKVASVRHPLFIWLKMRISKLVPWMILGSLLYVSMICVFHSKYAGFMVPYFLRKFFSQNATIQKEDTLAIQIFSFVAEFSVPLLIFLFAVLLLIFSLGRHTRQMRNTVAGSRVPGRGAPISALLSILSFLILYFSHCMIKVFLSSLKFHIRRFIFLFFILVIGIYPSGHSLILILGNPKLKQNAKKFLLHSKCCQ

SEQ ID NO: 14800 - protein, 307 aa, Artificial Sequence
  Description of Artificial Sequence: Synthetic coding sequence
MLRVVEGIFIFVVVSESVFGVLGNGFIGLVNCIDCAKNKLSTIGFILTGLAISRIFLIWIIITDGFIQIFSPNIYASGNLIEYISYFWVIGNQSSMWFATSLSIFYFLKIANFSNYIFLWLKSRTNMVLPFMIVFLLISSLLNFAYIAKILNDYKTKNDTVWDLNMYKSEYFIKQILLNLGVIFFFTLSLITCIFLIISLWRHNRQMQSNVTGLRDSNTEAHVKAMKVLISFIILFILYFIGMAIEISCFTVRENKLLLMFGMTTTAIYPWGHSFILILGNSKLKQASLRVLQQLKCCEKRKNLRVT

SEQ ID NO: 14801 - protein, 303 aa, Artificial Sequence
  Description of Artificial Sequence: Synthetic coding sequence
MESALPSIFTLVIIAEFIIGNLSNGFIVLINCIDWVSKRELSSVDKLLIILAISRIGLIWEILVSWFLALHYLAIFVSGTGLRIMIFSWIVSNHFNLWLATIFSIFYLLKIASFSSPAFLYLKWRVNKVILMILLGTLVFLFLNLIQINMHIKDWLDRYERNTTWNFSMSDFETFSVSVKFTMTMFSLTPFTVAFISFLLLIFSLQKHLQKMQLNYKGHRDPRTKVHTNALKIVISFLLFYASFFLCVLISWISELYQNTVIYMLCETIGVFSPSSHSFLLILGNAKLRQAFLLVAAKVWAKR

SEQ ID NO: 14802 - protein, 317 aa, Artificial Sequence
  Description of Artificial Sequence: Synthetic coding sequence
MGGVIKSIFTFVLIVEFIIGNLGNSFIALVNCIDWVKGRKISSVDRILTALAISRISLVWLIFGSWCVSVFFPALFATEKMFRMLTNIWTVINHFSVWLATGLGTFYFLKIANFSNSIFLYLKWRVKKVVLVLLLVTSVFLFLNIALINIHINASINGYRRNKTCSSDSSNFTRFSSLIVLTSTVFIFIPFTLSLAMFLLLIFSMWKHRKKMQHTVKISGDASTKAHRGVKSVITFFLLYAIFSLSFFISVWTSERLEENLIILSQVMGMAYPSCHSCVLILGNKKLRQASLSVLLWLRYMFKDGEPSGHKEFRESS

SEQ ID NO: 14803 - protein, 338 aa, Artificial Sequence
  Description of Artificial Sequence: Synthetic coding sequence
MLGRCFPPDTKEKQQLRMTKLCDPAESELSPFLITLILAVLLAEYLIGIIANGFIMAIHAAEWVQNKAVSTSGRILVFLSVSRIALQSLMMLEITISSTSLSFYSEDAVYYAFKISFIFLNFCSLWFAAWLSFFYFVKIANFSYPLFLKLRWRITGLIPWLLWLSVFISFSHSMFCINICTVYCNNSFPIHSSNSTKKTYLSEINVVGLAFFFNLGIVTPLIMFILTATLLILSLKRHTLHMGSNATGSNDPSMEAHMGAIKAISYFLILYIFNAVALFIYLSNMFDINSLWNNLCQIIMAAYPASHSILLIQDNPGLRRAWKRLQLRLHLYPKEWTL

SEQ ID NO: 14804 - protein, 318 aa, Artificial Sequence
  Description of Artificial Sequence: Synthetic coding sequence
MADKVQTTLLFLAVGEFSVGILGNAFIGLVNCMDWVKKRKIASIDLILTSLAISRICLLCVILLDCFILVLYPDVYATGKEMRIIDFFWTLTNHLSIWFATCLSIYYFFKIGNFFHPLFLWMKWRIDRVISWILLGCVVLSVFISLPATENLNADFRFCVKAKRKTNLTWSCRVNKTQHASTKLFLNLATLLPFCVCLMSFFLLILSLRRHIRRMQLSATGCRDPSTEAHVRALKAVISFLLLFIAYYLSFLIATSSYFMPETELAVIFGESIALIYPSSHSFILILGNNKLRHASLKVIWKVMSILKGRKFQQHKQI

SEQ ID NO: 14805 - protein, 309 aa, Artificial Sequence
  Description of Artificial Sequence: Synthetic coding sequence
MFSPADNIFIILITGEFILGILGNGYIALVNWIDWIKKKKISTVDYILTNLVIARICLISVMVVNGIVIVLNPDVYTKNKQQIVIFTFWTFANYLNMWITTCLNVFYFLKIASSSHPLFLWLKWKIDMVVHWILLGCFAISLLVSLIAAIVLSCDYRFHAIAKHKRNITEMFHVSKIPYFEPLTLFNLFAIVPFIVSLISFFLLVRSLWRHTKQIKLYATGSRDPSTEVHVRAIKTMTSFIFFFFLYYISSILMTFSYLMTKYKLAVEFGEIAAILYPLGHSLILIVLNNKLRQTFVRMLTCRKIACMI

SEQ ID NO: 14806 - protein, 312 aa, Artificial Sequence
  Description of Artificial Sequence: Synthetic coding sequence
MPSAIEAIYIILIAGELTIGIWGNGFIVLVNCIDWLKRRDISLIDIILISLAISRICLLCVISLDGFFMLLFPGTYGNSVLVSIVNVVWTFANNSSLWFTSCLSIFYLLKIANISHPFFFWLKLKINKVMLAILLGSFLISLIISVPKNDDMWYHLFKVSHEENITWKFKVSKIPGTFKQLTLNLGVMVPFILCLISFFLLLFSLVRHTKQIRLHATGFRDPSTEAHMRAIKAVIIFLLLLIVYYPVFLVMTSSALIPQGKLVLMIGDIVTVIFPSSHSFILIMGNSKLREAFLKMLRFVKCFLRRRKPFVP

SEQ ID NO: 14807 - protein, 1233 aa, Artificial Sequence
  Description of Artificial Sequence: Synthetic coding sequence
MWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTESSPAPQEGSEQPASPASPLSSRQSFCAQEAPTASQGLLKLFQKNSPMEDLGAKGAKEKMKEESWHIHFFEYGRGVCMYRTAKTRALVLKGIPESLRGELWLLFSGAWNEMVTHPGYYAELVEKSTGKYSLATEEIERDLHRSMPEHPAFQNELGIAALRRVLTAYAFRNPTIGYCQAMNIVTSVLLLYGSEEEAFWLLVALCERMLPDYYNTRVVGALVDQGIFEELTRDFLPQLSEKMQDLGVISSISLSWFLTLFLSVMPFESAVVIVDCFFYEGIKVILQVALAVLDANMEQLLGCSDEGEAMTMLGRYLDNVVNKQSVSPPIPHLRALLSSSDDPPAEVDIFELLKVSYEKFSSLRAEDIEQMRFKQRLKVIQSLEDTAKRSVVRAIPVDIGFSIEELEDLYMVFKAKHLASQYWGCSRTMAGRRDPSLPYLEQYRIDASQFRELFASLTPWACGSHTPLLAGRMFRLLDENKDSLINFKEFVTGMSGMYHGDLTEKLKVLYKLHLPPALSPEEAESALEAAHYFTEDSSSEEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGKAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDQKKVERQFSTASDHEQPGVSG

SEQ ID NO: 14808 - protein, 1250 aa, Artificial Sequence
  Description of Artificial Sequence: Synthetic coding sequence
MWLSPEEVLVANALWVTERANPFFVLQRRRGHGRGGGLTGLLVGTLDVVLDSSARVAPYRILHQTQDSQVYWTVACGSSRKEITKHWEWLENNLLQTLSIFDSEEDITTFVKGKIHGIIAEENKNLQPQGDEDPGKFKEAELKMRKQFGMPEGEKLVNYYSCSYWKGRVPRQGWLYLTVNHLCFYSFLLGKEVSLVVQWVDITRLEKNATLLFPESIRVDTRDQELFFSMFLNIGETFKLMEQLANLAMRQLLDSEGFLEDKALPRPIRPHRNISALKRDLDARAKNECYRATFRLPRDERLDGHTSCTLWTPFNKLHIPGQMFISNNYICFASKEEDACHLIIPLREVTIVEKADSSSVLPSPLSISTKSKMTFLFANLKDRDFLVQRISDFLQKTPSKQPGSIGSRKASVVDPSTESSPAPQEGSEQPASPASPLSSRQSFCAQEAPTASQGLLKLFQKNSPMEDLGAKGAKEKMKEESWHIHFFEYGRGVCMYRTAKTRALVLKGIPESLRGELWLLFSGAWNEMVTHPGYYAELVEKSTGKYSLATEEIERDLHRSMPEHPAFQNELGIAALRRVLTAYAFRNPTIGYCQAMNIVTSVLLLYGSEEEAFWLLVALCERMLPDYYNTRVVGALVDQGIFEELTRDFLPQLSEKMQDLGVISSISLSWFLTLFLSVMPFESAVVIVDCFFYEGIKVILQVALAVLDANMEQLLGCSDEGEAMTMLGRYLDNVVNKQSVSPPIPHLRALLSSSDDPPAEVDIFELLKVSYEKFSSLRAEDIEQMRFKQRLKVIQSLEDTAKRSVVRAIPVDIGFSIEELEDLYMVFKAKHLASQYWGCSRTMAGRRDPSLPYLEQYRIDASQFRELFASLTPWACGSHTPLLAGRMFRLLDENKDSLINFKEFVTGMSGMYHGDLTEKLKVLYKLHLPPALSPEEAESALEAAHYFTEDSSSEASPLASDLDLFLPWEAQEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGKAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDQKKVERQFSTASDHEQPGVSG

SEQ ID NO: 14809 - protein, 391 aa, Artificial Sequence
  Description of Artificial Sequence: Synthetic coding sequence
MAGRRDPSLPYLEQYRIDASQFRELFASLTPWACGSHTPLLAGRMFRLLDENKDSLINFKEFVTGMSGMYHGDLTEKLKVLYKLHLPPALSPEEAESALEAAHYFTEDSSSEEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGKAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDQKKVERQFSTASDHEQPGVSG

SEQ ID NO: 14810 - protein, 324 aa, Artificial Sequence [sequence omitted]

SEQ ID NO: 14811 - protein, 378 aa, Artificial Sequence
  Description of Artificial Sequence: Synthetic coding sequence
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSVESTSADTVLLTSKESKVWDLPSTSHVSMWKTSDSVSSPQPGASDTAVPEQNKTTKTGQMDGIPMSMKNEMPISQLLMIIAPSLGFVLFALFVAFLLRGKLMETYCSQKHTRLDYIGDSKNVLNDVQHGREDEDGLFTL

SEQ ID NO: 14812 - protein, 350 aa, Artificial Sequence
  Description of Artificial Sequence: Synthetic coding sequence
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSVESTSADTVLLTSKASDTAVPEQNKTTKTGQMDGIPMSMKNEMPISQLLMIIAPSLGFVLFALFVAFLLRGKLMETYCSQKHTRLDYIGDSKNVLNDVQHGREDEDGLFTL

SEQ ID NO: 14813 - protein, 1167 aa, Artificial Sequence
  Description of Artificial Sequence: Synthetic coding sequence
MPNSVLWAVDLFGRVYTLSTAGQYWEMCKDSQLEFKRVSATTQCCWGIACDNQVYVYVCASDVPIRRREEAYENQRWNPMGGFCEKLLLSDRWGWSDVSGLQHRPLDRVALPSPHWEWESDWYVDENFGGEPTEKGGWTYAIDFPATYTKDKKWNSCVRRRKWIRYRRYKSRDIWAKIPSKDDPKELPDPFNDLSVGGWEITEEPVGRLSVWAVSLQGKVWYREDVSHSNPEGSSWSLLDTPGEVVQISCGPHDLLWATLWEGQALVREGINRSNPKGSSWSIVEPPGSENGVMHISVGVSVVWAVTKDWKVWFRRGVNSHNPCGTSWIEMVGEMTMVNVGMNDQVWGIGCEDRAVYFRQGVTPSELSGKTWKAIIAARECDRSHSGSSSSLLSAGCFFGDEVRGSGESAPSDTDASSEVERPGPGQILPAEPLDDSKNATGNSASGLGAGRTAEDTVEDACPAEGSREARPNTHPGPAPTPAELPWTNIDLKEAKKVPSHSAAGFPETTSLSSLGLLPLGLEEPYGVDDHPLWAWVSGGGCVVEACAMPRWFTVQAAGLSSSVHMLSLSITPAQTAAWRKQIFQQLTERTKRELENFRHYEQAVEQSVWVKTGALQWWCDWKPHKWVDVRLALEQFTGHDGVRDSILFIYYVVHEEKKYIHIFLNEVVALVPVLNETKHSFALYTPERTRQRWPVRLAAATEQDMNDWLALLSLSCCESRKVQGRPSPQAIWSITCKGDIFVSEPSPDLEAHEHPLPCDQMFWRQMGGHLRMVEANSRGVVWGIGYDHTAWVYTGGYGGGCFQGLASSTSNIYTQSDVKCVHIYENQRWNPVTGYTSSRGLPTDRYMWSDASGLQECTKAGTKPPSLQWAWVSDWFVDFSVPGGTDQEGWQYASDFPASYHGSKTMKDFVRRRCWARKCKLVTSGPWLEVPPIALRDVSIIPESPGAEGSGHSIALWAVSDKGDVLCRLGVSELNPAGSSWLHVGTDQPFASISIGACYQVWAVARDGSAFYRGSVYPSQPAGDCWYHIPSPPRQRLKQVSAGQTSVYALDENGNLWYRQGITPSYPQGSSWEHVSNNVCRVSVGPLDQVWVIANKVQGSHSLSRGTVCHRTGVQPHEPKGHGWDYGIGGGWDHISVRANATRAPRSSSQEQEPSAPPEAHGPVCC

SEQ ID NO: 14814 - protein, 101 aa, Artificial Sequence
  Description of Artificial Sequence: Synthetic coding sequence
MPNSVLWAVDLFGRVYTLSTAGQYWEMCKDSQLEFKRVSATTQCCWGIACDNQVYVYVCASDVPIRRREEAYENQRWNPMGGFCEKLLLSDRWGWSDVSGL

SEQ ID NO: 14815 - protein, 1165 aa, Artificial Sequence
  Description of Artificial Sequence: Synthetic coding sequence
MPNSVLWAVDLFGRVYTLSTAGQYWEMCKDSQLEFKRVSATTQCCWGIACDNQVYVYVCASDVPIRRREEAYENQRWNPMGGFCEKLLLSDRWGWSDVSGLQHRPLDRVALPSPHWEWESDWYVDENFGGEPTEKGGWTYAIDFPATYTKDKKWNSCVRRRKWIRYRRYKSRDIWAKIPSKDDPKELPDPFNDLSVGGWEITEEPVGRLSVWAVSLQGKVWYREDVSHSNPEGSSWSLLDTPGEVVQISCGPHDLLWATLWEGQALVREGINRSNPKGSSWSIVEPPGSENGVMHISVGVSVVWAVTKDWKVWFRRGVNSHNPCGTSWIEMVGEMTMVNVGMNDQVWGIGCEDRAVYFRQGVTPSELSGKTWKAIIAARECDRSHSGSSSSLLSAGCFFGDEVRGSGESAPSDTDASSEVERPGPGQILPAEPLDDSKNATGNSASGLGAGRTAEDTVEDACPAEGSREARPNTHPGPAPTPAELPWTNIDLKEAKKVPSHSAAGFPETTSLSSLGLLPLGLEEPYGVDDHPLWAWVSGGGCVVEACAMPRWFTVQAGLSSSVHMLSLSITPAQTAAWRKQIFQQLTERTKRELENFRHYEQAVEQSVWVKTGALQWWCDWKPHKWVDVRLALEQFTGHDGVRDSILFIYYVVHEEKKYIHIFLNEVVALVPVLNETKHSFALYTPERTRQRWPVRLAAATEQDMNDWLALLSLSCCESRKVQGRPSPQAIWSITCKGDIFVSEPSPDLEAHEHPLPCDQMFWRQMGGHLRMVEANSRGVVWGIGYDHTAWVYTGGYGGGCFQGLASSTSNIYTQSDVKCVHIYENQRWNPVTGYTSRGLPTDRYMWSDASGLQECTKAGTKPPSLQWAWVSDWFVDFSVPGGTDQEGWQYASDFPASYHGSKTMKDFVRRRCWARKCKLVTSGPWLEVPPIALRDVSIIPESPGAEGSGHSIALWAVSDKGDVLCRLGVSELNPAGSSWLHVGTDQPFASISIGACYQVWAVARDGSAFYRGSVYPSQPAGDCWYHIPSPPRQRLKQVSAGQTSVYALDENGNLWYRQGITPSYPQGSSWEHVSNNVCRVSVGPLDQVWVIANKVQGSHSLSRGTVCHRTGVQPHEPKGHGWDYGIGGGWDHISVRANATRAPRSSSQEQEPSAPPEAHGPVCC

SEQ ID NO: 14816 - protein, 776 aa, Artificial Sequence
  Description of Artificial Sequence: Synthetic coding sequence
MGGFCEKLLLSDRWGWSDVSGLQHRPLDRVALPSPHWEWESDWYVDENFGGEPTEKGGWTYAIDFPATYTKDKKWNSCVRRRKWIRYRRYKSRDIWAKIPSKDDPKELPDPFNDLSVGGWEITEEPVGRLSVWAVSLQGKVLCPCLASQVWYREDVSHSNPEGSSWSLLDTPGEVVQISCGPHDLLWATLWEGQALVREGINRSNPKGSSWSIVEPPGSENGVMHISVGVSVVWAVTKDWKVWFRRGVNSHNPCGTSWIEMVGEMTMVNVGMNDQVWGIGCEDRAVYFRQGVTPSELSGKTWKAIIAARECDRSHSGSSSSLLSAGCFFGDEVRGSGESAPSDTDASSEVERPGPGQILPAEPLDDSKNATGNSASGLGAGRTAEDTVEDACPAEGSREARPNTHPGPAPTPAELPWTNIDLKEAKKVPSHSAAGFPETTSLSSLGLLPLGLEEPYGVDDHPLWAWVSGGGCVVEACAMPRWFTVQAGLSSSVHMLSLSITPAQTAAWRKQIFQQLTERTKRELENFRHYEQAVEQSVWVKTGALQWWCDWKPHKWVDVRLALEQFTGHDGVRDSILFIYYVVHEEKKYIHIFLNEVVALVPVLNETKHSFALYTPERTRQRWPVRLAAATEQDMNDWLALLSLSCCESRKVQGRPSPQAIWSITCKGDIFVSEPSPDLEAHEHPLPCDQMFWRQMGGHLRMVEANSRGVVWGIGYDHTAWVYTGGYGGGCFQGLASSTSNIYTQSDVKCVHIYENQRWNPVTGYTSSRDRISPCW

SEQ ID NO: 14817 - protein, 430 aa, Artificial Sequence
  Description of Artificial Sequence: Synthetic coding sequence
MATLSVKPSRRFQLPDWHTNSYLLSTNAQLQRDASHQIRQEARVLRNETNNQTIWDEHDNRTRLVERIDTVNRWKEMLDKCLTDLDAEIDALTQMKESAEQNLQAKNLPLDVAIECLTLRESRRDIDVVKDPVEDELHKEVEVIEATKKALQQKVSQAFEQLCLLQEVQQQLNSDHRGKMETLEIDRGCLSLNLRSPNISLKVDPTRVPDGSTTLQQWDDFSRFNKDRAEAEMKAATELREATALTIAETNNELEAQRVATEFAFRKRLREMEKVYSELKWQEKNTLEEIAELQEDIRHLEEDLRTKLLSLKLSHTRLEARTYRPNVELCRDQAQYGLTDEVHQLEATIAALKQKLAQAQDALDALCKHLARLQADIACKANSMLLDTKCMDTRRKLTVPAERFVPEVDTFTRTTNSTLSPLKSCQLELA

SEQ ID NO: 14818 - protein, 929 aa, Artificial Sequence
  Description of Artificial Sequence: Synthetic coding sequence
MTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 14819 - protein, 171 aa, Artificial Sequence
  Description of Artificial Sequence: Synthetic coding sequence
MQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKF

SEQ ID NO: 14820 - protein, 797 aa, Artificial Sequence
  Description of Artificial Sequence: Synthetic coding sequence
MTKKRKRQHDFQKVKLKVGKKKPKLQNATPTNFKTKTIHLPEQLKEDGTLPTNNRKLNIKDLLSQMHHYNAGVKQSALLGLKDLLSQFLAPKIRAEQISPFFPLALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 14821 - protein, 913 aa, Artificial Sequence
  Description of Artificial Sequence: Synthetic coding sequence
MSRMTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 14822 - protein, 433 aa, Artificial Sequence [sequence omitted]

SEQ ID NO: 14823 - protein, 1134 aa, Artificial Sequence
  Description of Artificial Sequence: Synthetic coding sequence
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASTSTLSSAKPFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPAPVFLAPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGCRPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 14824 - protein, 196 aa, Artificial Sequence
  Description of Artificial Sequence: Synthetic coding sequence
MWFMYLLSWLSLFIQVAFITLAVAAGLYYLAELIEEYTVATSRIIKYMIWFSTAVLIGLYVFERFPTSMIGVGLFTNLVYFGLLQTFPFIMLTSPNFILSCGLVVVNHYLAFQFFAEEYYPFSEVLAYFTFCLWIIPFAFFVSLSAGENVLPSTMQPGDDVVSNYFTKGKRGKRLGILVVFSFIKEAILPSRQKIY

SEQ ID NO: 14825 - protein, 410 aa, Artificial Sequence
  Description of Artificial Sequence: Synthetic coding sequence
MVLKAEHTRSPSATLPSNVPSCRSLSSSEDGPSGPSSLADGGLAHNLQDSVRHRILYLSEQLRVEKASRDGNTVSYLKLVSKADRHQVPHIQQAFEKVNQRASATIAQIEHRLHQCHQQLQELEEGCRPEGLLLMAESDPANCEPPSEKALLSEPPEPGGEDGPVNLPHASRPFILESRFQSLQQGTCLETEDVAQQQNLLLQKVKAELEEAKRFHISLQESYHSLKERSLTDLQLLLESLQEEKCRQALMEEQVNGRLQGQLNEIYNLKHNLACSEERMAYLSYERAKEIWEITETFKSRISKLEMLQQVTQLEAAEHLQSRPPQMLFKFLSPRLSLATVLLVFVSTLCACPSSLISSRLCTCTMLMLIGLGVLAWQRWRAIPATDWQEWVPSRCRLYSKDSGPPADGP

SEQ ID NO: 14826 - protein, 410 aa, Artificial Sequence; identical to SEQ ID NO: 14825
  Description of Artificial Sequence: Synthetic coding sequence

SEQ ID NO: 14827 - protein, 355 aa, Artificial Sequence
  Description of Artificial Sequence: Synthetic coding sequence
MEEGERSPLLSQETAGQKPLSVHRPPTSGCLGPVPREDQAEAWGCSCCPPETKHQALSGTPKKGPAPSLSPGSSCVKYLIFLSNFPFSLLGLLALAIGLWGLAVKGSLGSDLGGPLPADPMLGLALGGLVVSAVSLAGYLGALCENTCLLRGFSGGILAFLVLEAVAGALVVALWGPLQDSLEHTLRVAIAHYQDDPDLRFLLDQVQLGLRCCGAASYQDWQQNLYFNCSSPGVQACSLPASCCIDPREDGASVNDQCGFGVLRLDADAAQRVVYLEGCGPPLRRWLRANLAASGGYAIAVVLLQGAELLLAARLLGALAARRGAAYGPGARGEDRAGPQSPSPGAPPAAKPARG

SEQ ID NO: 14828 - protein, 235 aa, Artificial Sequence
  Description of Artificial Sequence: Synthetic coding sequence
MEEGERSPLLSQETAGQKPLSVHRPPTSGCLGPVPREDQAEAWGCSCCPPETKHQALSGTPKKGPAPSLSPGSSCVKYLIFLSNFPFSLLGLLALAIGLWGLAVKGSLGSDLGGPLPADPMLGLALGGLVVSAVSLAGYLGALCENTCLLRGFSGGILAFLVLEAVAGALVVALWGPLQDSLEHTLRVAIAHYQDDPDLRFLLDQVQLGLRCCGAASYQDWQQNLYCLSSPCSSQ

SEQ ID NO: 14829 - protein, 253 aa, Artificial Sequence
  Description of Artificial Sequence: Synthetic coding sequence
MAHYKTEQDDWLIIYLKYLLFVFNFFFWVGGAAVLAVGIWTLVEKSGYLSVLASSTFAASAYILIFAGVLVMVTGFLGFGAILWERKGCLSTYFCLLLVIFLVELVAGVLAHVYYQRLSDELKQHLNRTLAENYGQPGATQITASVDRLQQDFKCCGSNSSADWQHSTYILLREAEGRQVPDSCCKTVVVRCGQRAHPSNIYKVEGGCLTKLEQFLADHLLLMGAVGIGVACLQICGMVLTCCLHQRLQRHFY

SEQ ID NO: 14830 - protein, 243 aa, Artificial Sequence
  Description of Artificial Sequence: Synthetic coding sequence
MRSGGGRNAWDTRGACEQVGGAAVLAVGIWTLVEKSGYLSVLASSTFAASAYILIFAGVLVMVTGFLGFGAILWERKGCLSTYFCLLLVIFLVELVAGVLAHVYYQRLSDELKQHLNRTLAENYGQPGATQITASVDRLQQDFKCCGSNSSADWQHSTYILLREAEGRQVPDSCCKTVVVRCGQRAHPSNIYKVEGGCLTKLEQFLADHLLLMGAVGIGVACLQICGMVLTCCLHQRLQRHFY

SEQ ID NO: 14831 - protein, 253 aa, Artificial Sequence; identical to SEQ ID NO: 14829
  Description of Artificial Sequence: Synthetic coding sequence

SEQ ID NO: 14832 - protein, 213 aa, Artificial Sequence
  Description of Artificial Sequence: Synthetic coding sequence
MHYYRYSNAKVSCWYKYLLFSYNIIFWLAGVVFLGVGLWAWSEKGVLSDLTKVTRMHGIDPVVLVLMVGVVMFTLGFAGCVGALRENICLLNFNQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 14833 - protein, 270 aa, Artificial Sequence
  Description of Artificial Sequence: Synthetic coding sequence
MHYYRYSNAKVSCWYKYLLFSYNIIFWLAGVVFLGVGLWAWSEKGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 14834 - protein, 223 aa, Artificial Sequence
  Description of Artificial Sequence: Synthetic coding sequence
MERKVLPCFLCLFQGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFL

SEQ ID NO: 14835 - protein, 270 aa, Artificial Sequence; identical to SEQ ID NO: 14833
  Description of Artificial Sequence: Synthetic coding sequence

SEQ ID NO: 14836 - protein, 149 aa, Artificial Sequence
  Description of Artificial Sequence: Synthetic coding sequence
MHYYRYSNAKVSCWYKYLLFSYNIIFWLAGVVFLGVGLWAWSEKGVLSDLTKVTRMHGIDPVVLVHPLSGSCQRYFSCPVFLSLAFLSHPKNLPRPYGSLPFFPRQLLIWAVCTPSFAPPTMPHVAESCLSQLSTLAFFSLCSTRHCTS

SEQ ID NO: 14837 - protein, 253 aa, Artificial Sequence
  Description of Artificial Sequence: Synthetic coding sequence
MHYYRYSNAKVSCWYKYLLFSYNIIFWGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 14838 - protein, 270 aa, Artificial Sequence; identical to SEQ ID NO: 14833
  Description of Artificial Sequence: Synthetic coding sequence

SEQ ID NO: 14839 - protein, 147 aa, Artificial Sequence
  Description of Artificial Sequence: Synthetic coding sequence
MHYYRYSNAKVSCWYKYLLFSYNIIFWNQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 14840 - protein, 245 aa, Artificial Sequence
  Description of Artificial Sequence: Synthetic coding sequence
MAEIHTPYSSLKKLLSLLNGFVAVSGIILVGLGIGGKCGGASLTNVLGLSSAYLLHVGNLCLVMGCITVLLGCAGWYGATKESRGTLLFCILSMVIVLIMEVTAATVVLLFFPIVGDVALEHTFVTLRKNYRGYNEPDDYSTQWNLVMEKLKCCGVNNYTDFSGSSFEMTTGHTYPRSCCKSIGSVSCDGRDVSPNVIHQKGCFHKLLKITKTQSFTLSGSSLGAAVIQRWGSRYVAQAGLELLA

SEQ ID NO: 14841 - protein, 160 aa, Artificial Sequence
  Description of Artificial Sequence: Synthetic coding sequence
MAEIHTPYSSLKKLLSLLNGFVAVSGIILVGLGIGGKCGGASLTNVLGLSSAYLLHVGNLCLVMGCITVLLGCAGWYGATKESRGTLLFCILSMVIVLIMEVTAATVVLLFFPIVGDVALEHTFVTLRKNYRGYNEPDDYSTQWNLVMEKGLSKYFFSSL

SEQ ID NO: 14842 - protein, 332 aa, Artificial Sequence
  Description of Artificial Sequence: Synthetic coding sequence
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLVRGELEQQGFIHTKGCVGQFEKWLQDNLIVVAGVFMGIALLQIFGICLAQNLVSDIKAVKANWSKWNDDFENHWLTPTISEVLSTAGPQQNSLTGAPGPAPPSRHVFFGLGGLYPEPTFKNW

SEQ ID NO: 14843 - protein, 266 aa, Artificial Sequence
  Description of Artificial Sequence: Synthetic coding sequence
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLVRGELEQQGFIHTKGCVGQFEKWLQDNLIVVAGVFMGIALLQIFGICLAQNLEQME

SEQ ID NO: 14844 - protein, 329 aa, Artificial Sequence
  Description of Artificial Sequence: Synthetic coding sequence
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANWSKWNDDFENHWLTPTISEVLSTAGPQQNSLTGAPGPAPPSRHVFFGLGGLYPEPTFKNW

SEQ ID NO: 14845 - protein, 263 aa, Artificial Sequence
  Description of Artificial Sequence: Synthetic coding sequence
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLEQME

SEQ ID NO: 14846 - protein, 248 aa, Artificial Sequence
  Description of Artificial Sequence: Synthetic coding sequence
MEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITFGCCGVNGPEDFKFASVFRLLTLDSEEVPEACCRREPQSRDGVLLSREECLLGRSLFLNKQGCYTVILNTFETYVYLAGALAIGVLAIELFAMIFAMCLFRGIQ

SEQ ID NO: 14847 - protein, 271 aa, Artificial Sequence
  Description of Artificial Sequence: Synthetic coding sequence
  MOD_RES (1)..(1): Any amino acid
XWSTMEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITFGCCGVNGPEDFKFASVFRLLTLDSEEVPEACCRREPQSRDGVLLSREECLLGRSLFLNKQGCYTVILNTFETYVYLAGALAIGVLAIEEERAHSVSQATGILYQLPASPQAFQSPGTLGATA

SEQ ID NO: 14848 - protein, 248 aa, Artificial Sequence; identical to SEQ ID NO: 14846
  Description of Artificial Sequence: Synthetic coding sequence

SEQ ID NO: 14849 - protein, 79 aa, Artificial Sequence
  Description of Artificial Sequence: Synthetic coding sequence
MEGDCLSCMKYLMFVFNFFIFLGGACLLAIGIWVMVDPTGFREIVAANPLLLTGAYILLAMGGLLFLLGFLGCCGAVRE

SEQ ID NO: 14850 - protein, 146 aa, Artificial Sequence
  Description of Artificial Sequence: Synthetic coding sequence
MEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITVS

SEQ ID NO: 14851 - protein, 283 aa, Artificial Sequence
  Description of Artificial Sequence: Synthetic coding sequence
MARRPRAPAASGEEFSFVSPLVKYLLFFFNMLFWVISMVMVAVGVYARLMKHAEAALACLAVDPAILLIVVGVLMFLLTFCGCIGSLRENICLLQTFSLCLTAVFLLQLAAGILGFVFSDKARGKVSEIINNAIVHYRDDLDLQNLIDFGQKKFSCCGGISYKDWSQNMYFNCSEDNPSRERCSVPYSCCLPTPDQAVINTMCGQGMQAFDYLEASKVIYTNGCIDKLVNWIHSNLFLLGGVALGLAIPQLVGILLSQILVNQIKDQIKLQLYNQQHRADPWY

SEQ ID NO: 14852 - protein, 297 aa, Artificial Sequence
  Description of Artificial Sequence: Synthetic coding sequence
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDYAKAAFCLEELMMTNPHNHLYCQQYAEVKYTQGGLENLELSRKYFAQALKLNNRNMRALFGLYMSASHIASNPKASAKTKKDNMKYASWAASQINRAYQFAGRSKKETKYSLKAVEDMLETLQITQS

SEQ ID NO: 14853 - protein, 1861 aa, Artificial Sequence
  Description of Artificial Sequence: Synthetic coding sequence
MLKAVLKKSREGGKGGKKEAGSDFGPETSPVLHLDHSADSPVSSLPTAEDTYRVSLAKGVSMSLPSSPLLPRQSHLVQSRVNKKSPGPVRKPKYVESPRVPGDAVIMPFREVAKPTEPDEHEAKADNEPSCSPAAQELLTRLGFLLGEGIPSATHITIEDKNETMCTALSQGISPCSTLTSSTASPSTDSPCSTLNSCVSKTAANKSPCETISSPSSTLESKDSGIIATITSSSENDDRSGSSLEWNKDGNLRLGVQKGVLHDRRADNCSPVAEEETTGSAESTLPKAESSAGDGPVPYSQGSSSLIMPRPNSVAATSSTKLEDLSYLDGQRNAPLRTSIRLPWHNTAGGRAQEVKARFAPYKPQDILLKPLLFEVPSITTDSVFVGRDWLFHQIEENLRNTELAENRGAVVVGNVGFGKTAIISKLVALSCHGSRMRQIASNSPGSSPKTSDPTQDLHFTPLLSPSSSTSASSTAKTPLGSISAENQRPREDAVKYLASKVVAYHYCQADNTYTCLVPEFVHSIAALLCRSHQLAAYRDLLIKEPQLQSMLSLRSCVQDPVAAFKRGVLEPLTNLRNEQKIPEEEYIILIDGLNEAEFHKPDYGDTLSSFITKIISKFPAWLKLIVTVRANFQEIISALPFVKLSLDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPRNGHALLAFMFSRQEGKLNRQQTMELGHHILKAHIFKGLSKKTGISSSHLQALWIGYSTEGLSAALASLRNLYTPNVKVSRLLILGGANVNYRTEVLNNAPILCVQSHLGHEEVVTLLLEFGACLDGTSENGMTALCYAAAAGHMKLVCLLTKKGVRVDHLDKKGQCALVHSALRGHGDILQYLLTCEWSPGPPQPGTLRKSHALQQALTAAASMGHSSVVQCLLGMEKEHEVEVNGTDTLWGETALTAAAGRGKLEVCELLLGHGAAVSRTNRRGVPPLFCAARQGHWQIVRLLLERGCDVNLSDKQGRTPLMVAACEGHLSTVEFLLSKGAALSSLDKEGLSALSWACLKGHRAVVQYLVEEGAAIDQTDKNGRTPLDLAAFYGDAETVLYLVEKGAVIEHVDHSGMRPLDRAIGCRNTSVVVALLRKGAKLGNAAWAMATSKPDILIILLQKLMEEGNVMYKKGKMKEAAQRYQYALRKFPREGFGEDMRPFNELRVSLYLNLSRCRRKTNDFGMAEEFASKALELKPKSYEAFYARARAKRNSRQFVAALADLQEAVKLCPTNQEVKRLLARVEEECKQLQRSQQQKQQGPLPAPLNDSENEEDTPTPGLSDHFHSEETEEEETSPQEESVSPTPRSQPSSSVPSSYIRNLQEGLQSKGRPVSPQSRAGIGKSLREPVAQPGLLLQPSKQAQIVKTSQHLGSGQSAVRNGSMKVQISSQNPPPSPMPGRIAATPAGSRTQHLEGTGTFTTRAGCGHFGDRLGPSQNVRLQCGENGPAHPLPSKTKTTERLLSHSSVAVDAAPPNQGGLATCSDVRHPASLTSSGSSGSPSSSIKMSSSTSSLTSSSSFSDGFKVQGPDTRIKDKVVTHVQSGTAEHRPRNTPFMGIMDKTARFQQQSNPPSRSWHCPAPEGLLTNTSSAAGLQSANTEKPSLMQVGGYNNQAKTCSVSTLSASVHNGAQVKELEESKCQIPVHSQENRITKTVSHLYQESISKQQPHISNEAHRSHLTAAKPKRSFIESNV

SEQ ID NO: 14854 - protein, 1755 aa, Artificial Sequence
  Description of Artificial Sequence: Synthetic coding sequence
MLKAVLKKSREGGKGGKKEAGSDFGPETSPVLHLDHSADSPVSSLPTAEDTYRVSLAKGVSMSLPSSPLLPRQSHLVQSRVNKKSPGPVRKPKYVESPRVPGDAVIMPFREVAKPTEPDEHATITSSSENDDRSGSSLEWNKDGNLRLGVQKGVLHDRRADNCSPVAEEETTGSAESTLPKAESSAGDGPVPYSQGSSSLIMPRPNSVAATSSTKLEDLSYLDGQRNAPLRTSIRLPWHNTAGGRAQEVKARFAPYKPQDILLKPLLFEVPSITTDSVFVGRDWLFHQIEENLRNTELAENRGAVVVGNVGFGKTAIISKLVALSCHGSRMRQIASNSPGSSPKTSDPTQDLHFTPLLSPSSSTSASSTAKTPLGSISAENQRPREDAVKYLASKVVAYHYCQADNTYTCLVPEFVHSIAALLCRSHQLAAYRDLLIKEPQLQSMLSLRSCVQDPVAAFKRGVLEPLTNLRNEQKIPEEEYIILIDGLNEAEFHKPDYGDTLSSFITKIISKFPAWLKLIVTVRANFQEIISALPFVKLSLDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPRNGHALLAFMFSRQEGKLNRQQTMELGHHILKAHIFKGLSKKTGISSSHLQALWIGYSTEGLSAALASLRNLYTPNVKVSRLLILGGANVNYRTEVLNNAPILCVQSHLGHEEVVTLLLEFGACLDGTSENGMTALCYAAAAGHMKLVCLLTKKGVRVDHLDKKGQCALVHSALRGHGDILQYLLTCEWSPGPPQPGTLRKSHALQQALTAAASMGHSSVVQCLLGMEKEHEVEVNGTDTLWGETALTAAAGRGKLEVCELLLGHGAAVSRTNRRGVPPLFCAARQGHWQIVRLLLERGCDVNLSDKQGRTPLMVAACEGHLSTVEFLLSKGAALSSLDKEGLSALSWACLKGHRAVVQYLVEEGAAIDQTDKNGRTPLDLAAFYGDAETVLYLVEKGAVIEHVDHSGMRPLDRAIGCRNTSVVVALLRKGAKLGNAAWAMATSKPDILIILLQKLMEEGNVMYKKGKMKEAAQRYQYALRKFPREGFGEDMRPFNELRVSLYLNLSRCRRKTNDFGMAEEFASKALELKPKSYEAFYARARAKRNSRQFVAALADLQEAVKLCPTNQEVKRLLARVEEECKQLQRSQQQKQQGPLPAPLNDSENEEDTPTPGLSDHFHSEETEEEETSPQEESVSPTPRSQPSSSVPSSYIRNLQEGLQSKGRPVSPQSRAGIGKSLREPVAQPGLLLQPSKQAQIVKTSQHLGSGQSAVRNGSMKVQISSQNPPPSPMPGRIAATPAGSRTQHLEGTGTFTTRAGCGHFGDRLGPSQNVRLQCGENGPAHPLPSKTKTTERLLSHSSVAVDAAPPNQGGLATCSDVRHPASLTSSGSSGSPSSSIKMSSSTSSLTSSSSFSDGFKVQGPDTRIKDKVVTHVQSGTAEHRPRNTPFMGIMDKTARFQQQSNPPSRSWHCPAPEGLLTNTSSAAGLQSANTEKPSLMQVGGYNNQAKTCSVSTLSASVHNGAQVKELEESKCQIPVHSQENRITKTVSHLYQESISKQQPHISNEAHRSHLTAAKPKRSFIESNV

SEQ ID NO: 14855 - protein, 712 aa, Artificial Sequence
  Description of Artificial Sequence: Synthetic coding sequence
MAQSSPQLDIQVLHDLRQRFPEIPEGVVSQCMLQNNNNLEACCRALSQESSKYLYMEYHSPDDNRMNRNRLLHINLGIHSPSSYHPGDGAQLNGGRTLVHSSSDGHIDPQHAAGKQLICLVQEPHSAPAVVAATPNYNPFFMNEQNRSAATPPSQPPQQPSSMQTGMNPSAMQGPSPPPPPPSYMHIPRYSTNPITVTVSQNLPSGQTVPRALQILPQIPSNLYGSPGSIYIRQTSQSSSGRQTPQSTPWQSSPQGPVPHYSQRPLPVYPHQQNYQPSQYSPKQQQIPQSAYHSPPPSQCPSPFSSPQHQVQPSQLGHIFMPPSPSTTPPHPYQQGPPSYQKQGSHSVAYLPYTASSLSKGSMKKIEITVEPSQRPGTAINRSPSPISNQPSPWNQHSLYTATTPPSSSPSRGISSQPKPPFSVNPVYITYTQPTGPSCTPSPSPRVIPNPTTVFKITVGRATTENLLNLVDQEERSAAPEPIQPISVIPGSGGEKGSHKYQRSSSSGSDDYAYTQALLLHQRARMERLAKQLKLEKEELERLKSEVNGMEHDLMQRRLRRVSCTTAIPTPEEMTRLRSMNRQLQINVDCTLKEVDLLQSRGNFDPKAMNNFYDNIEPGPVVPPKPSKKDSSDPCTIERKARRISVTSKVQADIHDTQAAAADEHRTGSTQSPRTQPRDEDYEGAPWNCDSCTFLNHPALNRCEQCEMPRYT

SEQ ID NO: 14856 - protein, 83 aa, Artificial Sequence
  Description of Artificial Sequence: Synthetic coding sequence
MEHDLMQRRLRRVSCTTAIPTPEEMTRLRSMNRQLQINVDCTLKEVDLLQSREVYYSRSSLKLSFTQLTRLEMVFIFCGKYTD

SEQ ID NO: 14857 - protein, 712 aa, Artificial Sequence; identical to SEQ ID NO: 14855
  Description of Artificial Sequence: Synthetic coding sequence

SEQ ID NO: 14858 - protein, 684 aa, Artificial Sequence
  Description of Artificial Sequence: Synthetic coding sequence
MAQSSPQLDIQVLHDLRQRFPEIPEGVVSQCMLQNNNNLEACCRALSQESSKYLYMEYHSPDDNRMNRNRLLHINLGIHSPSSYHPGDGAQLNGGRTLVHSSSDGHIDPQHAAGKQLICLVQEPHSAPAVVAATPNYNPFFMNEQNRSAATPPSQPPQQPSSMQTGMNPSAMQGPSPPPPPPSYMHIPRYSTNPITVTVSQNLPSGQTVPRALQILPQIPSNLYGSPGSIYIRQTSQSSSGRQTPQSTPWQSSPQGPVPHYSQRPLPVYPHQQNYQPSQYSPKQQQIPQSAYHSPPPSQCPSPFSSPQHQVQPSQLGHIFMPPSPSTTPPHPYQQGPPSYQKQGSHSVAYLPYTASSLSKGSMKKIEITVEPSQRPGTAINRSPSPISNQPSPWNQHSLYTATTPPSSSPSRGISSQPKPPFSVNPVYITYTQPTGPSCTPSPSPRVIPNPTTVFKITVGRATTENLLNLVDQEERSAAPEPIQPISVIPGSGGEKGSHKYQRSSSSGSDDYAYTQALLLHQRARMERLAKQLKLEKEELERLKSEVNGMEHDLMQRRLRRVSCTTAIPTPEEMTRLRSMNRQLQINVDCTLKEVDLLQSRDSSDPCTIERKARRISVTSKVQADIHDTQAAAADEHRTGSTQSPRTQPRDEDYEGAPWNCDSCTFLNHPALNRCEQCEMPRYT

SEQ ID NO: 14859 - protein, 712 aa, Artificial Sequence; identical to SEQ ID NO: 14855
  Description of Artificial Sequence: Synthetic coding sequence

SEQ ID NO: 14860 - protein, 240 aa, Artificial Sequence
  Description of Artificial Sequence: Synthetic coding sequence
MLRSCAARLRTLGALCLPPVGRRLPGSEPRPELRSFSSEEVILKDCSVPNPSWNKDLRLLFDQFMKKCEDGSWKRLPSYKRTPTEWIQDFKTHFLDPKLMKEEQMSQAQLFTRSFDDGLGFEYVMFYNDIEKRMVCLFQGGPYLEGPPGFIHGGAIATMIDATVGMCAMMAGGIVMTANLNINYKRPIPLCSVVMINSQLDKVEGRKFFVSCNVQSVDEKTLYSEATSLFIKLNPAKSLT

SEQ ID NO: 14861 - protein, 247 aa, Artificial Sequence
  Description of Artificial Sequence: Synthetic coding sequence
MIRRCFQVAARLGHHRGLLEAPRILPRLNPASAFGSSTDSMFSRFLPEKTDLKDYALPNASWCSDMLSLYQEFLEKTKSSGWIKLPSFKSNRDHIRGLKLPSGLAVSSDKGDCRIFTRCIQVEGQGFEYVIFFQPTQKKSVCLFQPGSYLEGPPGFAHGGSLAAMMDETFSKTAFLAGEGLFTLSLNIRFKNLIPVDSLVVMDVELDKIEDQKLYMSCIAHSRDQQTVYAKSSGVFLQLQLEEESPQ

SEQ ID NO: 14862 - protein, 166 aa, Artificial Sequence
  Description of Artificial Sequence: Synthetic coding sequence
MAQRLLLRRFLASVISRKPSQGQWPPLTSRALQTPQCSPGGLTVTPNPARTIYTTRISLTTFNIQDGPDFQDRVVNSETPVVVDFHAQWCGPCKILGPRLEKMVAKQHGKVVMAKVDIDDHTDLAIEYEVSAVPTVLAMKNGDVVDKFVGIKDEDQLEAFLKKLIG

SEQ ID NO: 14863 - protein, 166 aa, Artificial Sequence; identical to SEQ ID NO: 14862
  Description of Artificial Sequence: Synthetic coding sequence

SEQ ID NO: 14864 - protein, 958 aa, Artificial Sequence
  Description of Artificial Sequence: Synthetic coding sequence
MSECGGRGGGSSSSEDAEDEGGGGGGPAGSDCLSSSPTLATASSAGRLRRGLRGAFLMARQRPELLCGAVALGCALLLALKFTCSRAKDVIIPAKPPVSFFSLRSPVLDLFQGQLDYAEYVRRDSEVVLLFFYAPWCGQSIAARAEIEQAASRLSDQVLFVAINCWWNQGKCRKQKHFFYFPVIYLYHRSFGPIEYKGPMSAVYIEKFVRRVMKPLLYIPSQSELLDFLSNYEPGVLGYFEFSGSPQPPGYLTFFTSALHSLKKDYLGTVRFGVITNKHLAKLVSLVHSGSVYLHRHFNTSLVFPREVLNYTAENICKWALENQETLFRWLRPHGGKSLLLNNELKKGPALFLFIPFNPLAESHPLIDEITEVALEYNNCHGDQVVERLLQHLRRVDAPVLESLALEVPAQLPDPPTITASPCCNTVVLPQWHSFSRTHNVCELCVNQTSGGMKPSSVSVPQCSFFEMAAALDSFYLKEQTFYHVASDSIECSNFLTSYSPFSYYTACCRTISRGVSGFIDSEQGVFEAPTVAFSSLEKKCEVDAPSSVPHIEENRYLFPEVDMTSTNFTGLSCRTNKTLNIYLLDSNLFWLYAERLGAPSSTQVKEFAAIVDVKEESHYILDPKQALMKLTLESFIQNFSVLYSPLKRHLIGSGSAQFPSQHLITEVTTDTFWEVVLQKQDVLLLYYAPWCGFCPSLNHIFIQLARNLPMDTFTVARIDVSQNDLPWEFMVDRLPTVLFFPCNRKDLSVKYPEDVPITLPNLLRFILHHSDPASSPQNVANSPTKECLQSEAVLQRGHISHLEREIQKLRAEISSLQRAQVQVESQLSSARRDEHRLRQQQRALEEQHSLLHAHSEQLQALYEQKTRELQELARKLQELADASENLLTENTWLKILVATMERKLEGRDGAESLAAQREVHPKQPEPSATPQLPGSSPPPANVSATLVSERNKENRTD

SEQ ID NO: 14865 - protein, 985 aa, Artificial Sequence
  Description of Artificial Sequence: Synthetic coding sequence
MSECGGRGGGSSSSEDAEDEGGGGGGPAGSDCLSSSPTLATASSAGRLRRGLRGAFLMARQRPELLCGAVALGCALLLALKFTCSRAKDVIIPAKPPVSFFSLRSPVLDLFQGQLDYAEYVRRDSEVVLLFFYAPWCGQSIAARAEIEQAASRLSDQVLFVAINCWWNQGKCRKQKHFFYFPVIYLYHRSFGPIEYKGPMSAVYIEKFVRRVMKPLLYIPSQSELLDFLSNYEPGVLGYFEFSGSPQPPGYLTFFTSALHSLKKALESTSSPRALVSFTGEWHLETKIYVLDYLGTVRFGVITNKHLAKLVSLVHSGSVYLHRHFNTSLVFPREVLNYTAENICKWALENQETLFRWLRPHGGKSLLLNNELKKGPALFLFIPFNPLAESHPLIDEITEVALEYNNCHGDQVVERLLQHLRRVDAPVLESLALEVPAQLPDPPTITASPCCNTVVLPQWHSFSRTHNVCELCVNQTSGGMKPSSVSVPQCSFFEMAAALDSFYLKEQTFYHVASDSIECSNFLTSYSPFSYYTACCRTISRGVSGFIDSEQGVFEAPTVAFSSLEKKCEVDAPSSVPHIEENRYLFPEVDMTSTNFTGLSCRTNKTLNIYLLDSNLFWLYAERLGAPSSTQVKEFAAIVDVKEESHYILDPKQALMKLTLESFIQNFSVLYSPLKRHLIGSGSAQFPSQHLITEVTTDTFWEVVLQKQDVLLLYYAPWCGFCPSLNHIFIQLARNLPMDTFTVARIDVSQNDLPWEFMVDRLPTVLFFPCNRKDLSVKYPEDVPITLPNLLRFILHHSDPASSPQNVANSPTKECLQSEAVLQRGHISHLEREIQKLRAEISSLQRAQVQVESQLSSARRDEHRLRQQQRALEEQHSLLHAHSEQLQALYEQKTRELQELARKLQELADASENLLTENTWLKILVATMERKLEGRDGAESLAAQREVHPKQPEPSATPQLPGSSPPPANVSATLVSERNKENRTD

SEQ ID NO: 14866 - protein, 221 aa, Artificial Sequence
  Description of Artificial Sequence: Synthetic coding sequence
MARQRPELLCGAVALGCALLLALKFTCSRAKDVIIPAKPPVSFFSLRSPVLDLFQGQLDYAEYVRRDSEVVLLFFYAPWCGQSIAARAEIEQAASRLSDQVLFVAINCWWNQGKCRKQKHFFYFPVIYLYHRSFGPIEYKGPMSAVYIEKFVRRVMKPLLYIPSQSELLDFLSNYEPGVLGYFEFSGSPQPPGYLTFFTSALHSLKKDGVSPCRPGWSAVA

SEQ ID NO: 14867 - protein, 360 aa, Artificial Sequence
  Description of Artificial Sequence: Synthetic coding sequence
MVPAAGRRPPRVMRLLGWWQVLLWVLGLPVRGVEVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 14868 - protein, 344 aa, Artificial Sequence
  Description of Artificial Sequence: Synthetic coding sequence
MVPAAGRRPPRVMRLLGWWQVLLWVLGLPVRGVEVAEESGRLWSEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 14869 - protein, 337 aa, Artificial Sequence
  Description of Artificial Sequence: Synthetic coding sequence
MEAGQQRVVEKVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 14870 - protein, 432 aa, Artificial Sequence
  Description of Artificial Sequence: Synthetic coding sequence
MPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 14871 - protein, 324 aa, Artificial Sequence
  Description of Artificial Sequence: Synthetic coding sequence
MEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 14872 - protein, 360 aa, Artificial Sequence
  Description of Artificial Sequence: Synthetic coding sequence
MTQSVDSNRGNRNEKRCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 14873 - protein, 280 aa, Artificial Sequence
  Description of Artificial Sequence: Synthetic coding sequence
MAPSGSLAVPLAVLVLLLWGAPWTHGRRSNVRVITDENWRELLEGDWMIEFYAPWCPACQNLQPEWESFAEWGEDLEVNIAKVDVTEQPGLSGRFIITALPTIYHCKDGEFRRYQGPRTKKDFINFISDKEWKSIEPVSSWFGPGSVLMSSMSALFQLSMWIRTCHNYFIEDLGLPVWGSYTVFALATLFSGLLLGLCMIFVADCLCPSKRRRPQPYPYPSKKLLSESAQPLKKVEEEQEADEEDVSEEEAESKEGTNKDFPQNAIRQRSLGPSLATDKS

SEQ ID NO: 14874 - protein, 296 aa, Artificial Sequence
  Description of Artificial Sequence: Synthetic coding sequence
MAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 14875 - protein, 258 aa, Artificial Sequence
  Description of Artificial Sequence: Synthetic coding sequence
MAVLAPLIALVYSVPRLSRWLAQPYYLLSALLSAAFLLVRKLPPLCHGLPTQREDGNPCDFDWREVEILMFLSAIVMMKNRRSMFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 14876 - protein, 454 aa, Artificial Sequence
  Description of Artificial Sequence: Synthetic coding sequence
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEYVTLKEMPAVLVFKDETYFVYDEYEDGDLSSWINRERFQNYLAMDGFLLYELGDTGKLVALAVIDEKNTSVEHTRLKSIIQEVARDYRDLFHRDFQFGHMDGNDYINTLLMDELTVPTVVVLNTSNQQYFLLDRQIKNVEDMVQFINNILDGTVEAQGGDSILQRLKRIVFDAKSTIVSIFKSSPLMGCFLFGLPLGVISIMCYGIYTADTDGGYIEERYEVSKSENENQEQIEESKEQQEPSSGGSVVPTVQEPKDVLEKKKD

SEQ ID NO: 14877 - protein, 197 aa, Artificial Sequence
  Description of Artificial Sequence: Synthetic coding sequence
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLALIRPLPSQQMFEHMQKRHRVFFVYVGGESPLKEKYIDAASELIVYTYFFSASEEVVPEYVTLKEMPAVLVFKDETYFVYDGKFQIFNSCKTF

SEQ ID NO: 14878 - protein, 418 aa, Artificial Sequence
  Description of Artificial Sequence: Synthetic coding sequence
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEYVTLKEMPAVLVFKDETYFVYDEYEDGDLSSWINRERFQNYLAMDGFLLYELGDTGKLVALAVIDEKNTSVEHTRLKSIIQEVARDYRDLFHRDFQFGHMDGNDYINTLLMDELTVPTVVVLNTSNQQYFLLDRQIKNVEDMVQFINNILDGTVEAQGGDSILQRLKRIVFDAKSTIVSIFKSSPLMGCFLFGLPLGVISIMCYGIYTADTDGGYIEERYEVSKKKKK

SEQ ID NO: 14879 - protein, 349 aa, Artificial Sequence
  Description of Artificial Sequence: Synthetic coding sequence
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGLSGRFFVTTLPAFFHAKDGIFRRYRGPGIFEDLQNYILEKKWQSVEPLTGWKSPASLTMSGMAGLFSISGKIWHLHNYFTVTLGIPAWCSYVFFVIATLVFGLFMGLVLVVISECFYVPLPRHLSERSEQNRRSEEAHRAEQLQDAEEEKDDSNEEENKDSLVDDEEEKEDLGDEDEAEEEEEEDNLAAGVDEERSEANDQGPPGEDGVTREEVEPEEAEEGISEQPCPADTEVVEDSLRQRKSQHADKGL

SEQ ID NO: 14880 - protein, 601 aa, Artificial Sequence
  Description of Artificial Sequence: Synthetic coding sequence
MDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKPRPPPLSPLGGPVPSALPNGPPSPRSGRDPLAILSEISKSVKPRLASFRSLRGSRGTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 14881 - protein, 545 aa, Artificial Sequence
  Description of Artificial Sequence: Synthetic coding sequence
MDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEGSSEGTISMAEGEDLSLMEEDKGDGWTRVRRKEGGEGYVPTSYLRVTLN

SEQ ID NO: 14882 - protein, 593 aa, Artificial Sequence
  Description of Artificial Sequence: Synthetic coding sequence
MDWGTELWDQFEVLERHTQWGLDLLDRYVKFVKERTEVEQAYAKQLRSLVKKYLPKRPAKDDPESKFSQQQSFVQILQEVNDFAGQRELVAENLSVRVCLELTKYSQEMKQERKMHFQEGRRAQQQLENGFKQLENSKRKFERDCREAEKAAQTAERLDQDINATKADVEKAKQQAHLRSHMAEESKNEYAAQLQRFNRDQAHFYFSQMPQIFDKLQDMDERRATRLGAGYGLLSEAELEVVPIIAKCLEGMKVAANAVDPKNDSHVLIELHKSGFARPGDVEFEDFSQPMNRAPSDSSLGTPSDGRPELRGPGRSRTKRWPFGKKNKTVVTEDFSHLPPEQQRKRLQQQLEERSRELQKEVDQREALKKMKDVYEKTPQMGDPASLEPQIAETLSNIERLKLEVQKYEAWLAEAESRVLSNRGDSLSRHARPPDPPASAPPDSSSNSASQDTKESSEEPPSEESQDTPIYTEFDEDFEEEPTSPIGHCVAIYHFEDLGPPPPPSQGPARALSLWPRVKTSVLWKKTKGTAGPGSGGKREARATCPPPTSESRSIEPCQRREEGGCRLLLLGHGEPQDLCTLFLTPWLRLRPV

SEQ ID NO: 14883 - protein, 432 aa, Artificial Sequence
  Description of Artificial Sequence: Synthetic coding sequence
MDEAVGDLKQALPCVAESPTVHVEVHQRGSSTAKKEDINLSVRKLLNRHNIVFGDYTWTEFDEPFLTRNVQSVSIIDTELKVKDSQPIDLSACTVALHIFQLNEDGPSSENLEEETENIIAANHWVLPAAEFHGLWDSLVYDVEVKSHLLDYVMTTLLFSDKNVNSNLITWNRVVLLHGPPGTGKTSLCKALAQKLTIRLSSRYRYGQLIEINSHSLFSKWFSESGKLVTKMFQKIQDLIDDKDALVFVLIDEVESLTAARNACRAGTEPSDAIRVVNAVLTQIDQIKRHSNVVILTTSNITEKIDVAFVDRADIKQYIGPPSAAAIFKIYLSCLEELMKCQIIYPRQQLLTLRELEMIGFIENNVSKLSLLLNDISRKSEGLSGRVLRKLPFLAHALYVQAPTVTIEGFLQALSLAVDKQFEERKKLAAYI

SEQ ID NO: 14884 - protein, 196 aa, Artificial Sequence
  Description of Artificial Sequence: Synthetic coding sequence
MDEAVGDLKQALPCVAESPTVHVEVHQRGSSTAKKEDINLSVRKLLNRHNIVFGDYTWTEFDEPFLTRNVQSVSIIDTELKVKDSQPIDLSACTVALHIFQLNEDGPSSENLEEETENIIAANHWVLPAAEFHGLWDSLVYDVEVKSHLLDYVMTTLLFSDKNVNSNLITIEGFLQALSLAVDKQFEERKKLAAYI

SEQ ID NO: 14885 - protein, 247 aa, Artificial Sequence
  Description of Artificial Sequence: Synthetic coding sequence
MPRLLHPALPLLLGATLTFRALRRALCRLPLPVHVRADPLRTWRWHNLLVSFAHSIVSGIWALLCVWQTPDMLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKYVNLVMYFLFRLAPQAYLTHFFLRYVNQRTLGTFLLGILLMLDVMIIIYFSRLLRSDFCPEHVPKKQHKDKFLTE

SEQ ID NO: 14886 - protein, 200 aa, Artificial Sequence
  Description of Artificial Sequence: Synthetic coding sequence
MGYSAVPKCPPRGRGRDSVWQTPDMLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKYVNLVMYFLFRLAPQAYLTHFFLRYVNQRTLGTFLLGILLMLDVMIIIYFSRLLRSDFCPEHVPKKQHKDKFLTE

SEQ ID NO: 14887 - protein, 207 aa, Artificial Sequence
  Description of Artificial Sequence: Synthetic coding sequence
MAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGLLKFCTVGFCGIGSLIDFILISMQIVGPSDGSSYIIDYYGTRLTRLSITNETFRKTQLYP

SEQ ID NO: 14888 - protein, 186 aa, Artificial Sequence
  Description of Artificial Sequence: Synthetic coding sequence
MAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGKETVTREVKGFTESRGFPLFCDIFVVIIFVLWIGKLSRD

SEQ ID NO: 14889 - protein, 176 aa, Artificial Sequence
  Description of Artificial Sequence: Synthetic coding sequence
MAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGLLKFCTVGFCGIGSLIDFILISMQVSFSI

SEQ ID NO: 14890 - protein, 269 aa, Artificial Sequence
  Description of Artificial Sequence: Synthetic coding sequence
MHILKGSPNVIPRAHGQKNTRRDGTGLYPMRGPFKNLALLPFSLPLLGGGGSGSGEKVSVSKMAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGLLKFCTVGFCGIGSLIDFILISMQIVGPSDGSSYIIDYYGTRLTRLSITNETFRKTQLYP

SEQ ID NO: 14891 - protein, 171 aa, Artificial Sequence
  Description of Artificial Sequence: Synthetic coding sequence
MKKCLLPVLITCMQTAICKDRMMMIMILLVNYRPDEFIECEDPVDHVGNATASQELGYGCLKFGGQAYSDVEHTSVQCHALDGIECASPRTFLRENKPCIKYTGHYFITTLLYSFFLGCFGVDRFCLGHTGTAVGKLLTLGGLGIWWFVDLILLITGGLMPSDGSNWCTVY

SEQ ID NO: 14892 - protein, 171 aa, Artificial Sequence; identical to SEQ ID NO: 14891
  Description of Artificial Sequence: Synthetic coding sequence

SEQ ID NO: 14893 - protein, 214 aa, Artificial Sequence
  Description of Artificial Sequence: Synthetic coding sequence
MVLGGCPVSYLLLCGQAALLLGNLLLLHCVSRSHSQNATAEPELTSAGAAQPEGPGGAASWEYGDPHSPVILCSYLPDEFIECEDPVDHVGNATASQELGYGCLKFGGQAYSDVEHTSVQCHALDGIECASPRTFLRENKPCIKYTGHYFITTLLYSFFLGCFGVDRFCLGHTGTAVGKLLTLGGLGIWWFVDLILLITGGLMPSDGSNWCTVY

SEQ ID NO: 14894 - protein, 171 aa, Artificial Sequence; identical to SEQ ID NO: 14891
  Description of Artificial Sequence: Synthetic coding sequence

SEQ ID NO: 14895 - protein, 63 aa, Artificial Sequence
  Description of Artificial Sequence: Synthetic coding sequence
MKKCLLPVLITCMQTAICKDRMMMIMILLVNYRPDEFIECEDPVDHVGNATASQELGYGCLKV

SEQ ID NO: 14896 - protein, 45 aa, Artificial Sequence
  Description of Artificial Sequence: Synthetic coding sequence
MKKCLLPVLITCMQTAICKDRMMMIMILLVNYRPDEFIECEDPVD

SEQ ID NO: 14897 - protein, 121 aa, Artificial Sequence
  Description of Artificial Sequence: Synthetic coding sequence
MKKCLLPVLITCMQTAICKDRMMMIMILLVNYRPDEFIECEDPVDHVGNATASQELGYGCLKFGGQAYSDVEHTSVQCHALDGIECASPRTFLRENKPCIKYTGHYFITTLLYSFFLGCFG

SEQ ID NO: 14898 - protein, 404 aa, Artificial Sequence
  Description of Artificial Sequence: Synthetic coding sequence
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWHSVDTSPGYHESDSKKSEDLSLCNVAEHSNTTEGPTGKQEGAQSVEEMFEEEAEEEVFLKFVILHAEDDTDEALRVQNLLQDDFGIKPGIIFAEMPCGRQHLQNLDDAVNGSAWTILLLTENFLRDTWCNFQFYTSLMNSVNRQHKYNSVIPMRPLNNPLPRERTPFALQTINALEEESRGFPTQVERIFQESVYKTQQTIWKETRNMVQRQFIA

SEQ ID NO: 14899 - protein, 188 aa, Artificial Sequence
  Description of Artificial Sequence: Synthetic coding sequence
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAY

SEQ ID NO: 14900 - protein, 124 aa, Artificial Sequence
  Description of Artificial Sequence: Synthetic coding sequence
MPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYAQQRWKLQVQEQRKSVFDRHVVLS

SEQ ID NO: 14901 - protein, 124 aa, Artificial Sequence; identical to SEQ ID NO: 14900
  Description of Artificial Sequence: Synthetic coding sequence

SEQ ID NO: 14902 - protein, 198 aa, Artificial Sequence
  Description of Artificial Sequence: Synthetic coding sequence
MATLWGGLLRLGSLLSLSCLALSVLLLAQLSDAAKNFEDVRCKCICPPYKENSGHIYNKNISQKDCDCLHVVEPMPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYAQQRWKLQVQEQRKSVFDRHVVLS

SEQ ID NO: 14903 - protein, 105 aa, Artificial Sequence [sequence omitted]

SEQ ID NO: 14904 - protein, 470 aa, Artificial Sequence
  Description of Artificial Sequence: Synthetic coding sequence
MPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 14905 - protein, 195 aa, Artificial Sequence
  Description of Artificial Sequence: Synthetic coding sequence
MPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESSLGFGYPKFISHQDIRKRNYVRDDAVFIRAAVELPRKILS

SEQ ID NO: 14906 - protein, 167 aa, Artificial Sequence
  Description of Artificial Sequence: Synthetic coding sequence
MPGFDYKFLEKPKRRLLCPLCGKPMREPVQVSTCGHRFCDTCLQVSAFLNGNGSGEGTHLSLYIRVLPGAFDNLLEWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 14907 - protein, 144 aa, Artificial Sequence
  Description of Artificial Sequence: Synthetic coding sequence
MPGFDYKFLEKPKRRLLCPLCGKPMREPVQVSTCGHRFCDTCLQEFLSEGVFKWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 14908 - protein, 182 aa, Artificial Sequence
  Description of Artificial Sequence: Synthetic coding sequence
MPGFDYKFLEKPKRRLLCPLCGKPMREPVQVSTCGHRFCDTCLQEFLSEGVFKCPEDQLPLDYAKFPHPYPQIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARM

SEQ ID NO: 14909 - protein, 392 aa, Artificial Sequence [sequence omitted]

SEQ ID NO: 14910 - protein, 198 aa, Artificial Sequence
  Description of Artificial Sequence: Synthetic coding sequence
MPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHESSLGFGYPKFISHQDIRKRNYVRDDAVFIRAAVELPRKILS

SEQ ID NO: 14911 - protein, 811 aa, Artificial Sequence
  Description of Artificial Sequence: Synthetic coding sequence
MRLIRNIYIFCSIVMTAEGDAPELPEERELMTNCSNMSLRKVPADLTPATTTLDLSYNLLFQLQSSDFHSVSKLRVLILCHNRIQQLDLKTFEFNKELRYLDLSNNRLKSVTWYLLAGLRYLDLSFNDFDTMPICEEAGNMSHLEILGLSGAKIQKSDFQKIAHLHLNTVFLGFRTLPHYEEGSLPILNTTKLHIVLPMDTNFWVLLRDGIKTSKILEMTNIDGKSQFVSYEMQRNLSLENAKTSVLLLNKVDLLWDDLFLILQFVWHTSVEHFQIRNVTFGGKAYLDHNSFDYSNTVMRTIKLEHVHFRVFYIQQDKIYLLLTKMDIENLTISNAQMPHMLFPNYPTKFQYLNFANNILTDELFKRTIQLPHLKTLILNGNKLETLSLVSCFANNTPLEHLDLSQNLLQHKNDENCSWPETVVNMNLSYNKLSDSVFRCLPKSIQILDLNNNQIQTVPKETIHLMALRELNIAFNFLTDLPGCSHFSRLSVLNIEMNFILSPSLDFVQSCQEVKTLNAGRNPFRCTCELKNFIQLETYSEVMMVGWSDSYTCEYPLNLRGTRLKDVHLHELSCNTALLIVTIVVIMLVLGLAVAFCCLHFDLPWYLRMLGQCTQTWHRVRKTTQEQLKRNVRFHAFISYSEHDSLWVKNELIPNLEKEDGSILICLYESYFDPGKSISENIVSFIEKSYKSIFVLSPNFVQNEWCHYEFYFAHHNLFHENSDHIILILLEPIPFYCIPTRYHKLKALLEKKAYLEWPKDRRKCGLFWANLRAAINVNVLATREMYELQTFTELNEESRGSTISLMRTDCL

SEQ ID NO: 14912 - protein, 811 aa, Artificial Sequence; identical to SEQ ID NO: 14911
  Description of Artificial Sequence: Synthetic coding sequence

SEQ ID NO: 14913 - protein, 811 aa, Artificial Sequence; identical to SEQ ID NO: 14911
  Description of Artificial Sequence: Synthetic coding sequence

SEQ ID NO: 14914 - protein, 811 aa, Artificial Sequence; identical to SEQ ID NO: 14911
  Description of Artificial Sequence: Synthetic coding sequence

SEQ ID NO: 14915 - protein, 404 aa, Artificial Sequence; identical to SEQ ID NO: 14898
  Description of Artificial Sequence: Synthetic coding sequence

SEQ ID NO: 14916 - protein, 235 aa, Artificial Sequence
  Description of Artificial Sequence: Synthetic coding sequence
MGIGKSKINSCPLSLSWGKRHSVDTSPGYHESDSKKSEDLSLCNVAEHSNTTEGPTGKQEGAQSVEEMFEEEAEEEVFLKFVILHAEDDTDEALRVQNLLQDDFGIKPGIIFAEMPCGRQHLQNLDDAVNGSAWTILLLTENFLRDTWCNFQFYTSLMNSVNRQHKYNSVIPMRPLNNPLPRERTPFALQTINALEEESRGFPTQVERIFQESVYKTQQTIWKETRNMVQRQFIA

SEQ ID NO: 14917 - protein, 378 aa, Artificial Sequence
  Description of Artificial Sequence: Synthetic coding sequence
MAGDGRRAEAVREGWGVYVTPRAPIREGRGRLAPQNGGSSDAPAYRTPPSRQGRREVRFSDEPPEVYGDFEPLVAKERSPVGKRTRLEEFRSDSAKEEVRESAYYLRSRQRRQPRPQETEEMKTRRTTRLQQQHSEQPPLQPSPVMTRRGLRDSHSSEEDEASSQTDLSQTISKKTVRSIQEAPVSEDLVIRLRRPPLRYPRYEATSVQQKVNFSEEGETEEDDQDSSHSSVTTVKARSRDSDESGDKTTRSSSQYIESFWQSSQSQNFTAHDKQPSVLSKGSTLIFYKYCDHENAAFKDVALVLTVLLEEETLGTSLGLKEVEEKVRDFLKVKFTNSNTPNSYNHMDPDKLNGLWSRISHLVLPVQPENALKRGICL

SEQ ID NO: 14918 - protein, 583 aa, Artificial Sequence
  Description of Artificial Sequence: Synthetic coding sequence
MAGDGRRAEAVREGWGVYVTPRAPIREGRGRLAPQNGGSSDAPAYRTPPSRQGRREVRFSDEPPEVYGDFEPLVAKERSPVGKRTRLEEFRSDSAKEEVRESAYYLRSRQRRQPRPQETEEMKTRRTTRLQQQHSEQPPLQPSPVMTRRGLRDSHSSEEDEASSQTDLSQTISKKTVRSIQEAPVSEDLVIRLRRPPLRYPRYEATSVQQKVNFSEEGETEEDDQDSSHSSVTTVKARSRDSDESGDKTTRSSSQYIESFWQSSQSQNFTAHDKQPSVLSSGYQKTPQEWAPQTARIRTRMQNDSILKSELGNQSPSTSSRQVTGQPQNASFVKRNRWWLLPLIAALASGSFWFFSTPEVETTAVQEFQNQMNQLKNKYQGQDEKLWKRSQTFLEKHLNSSHPRSQPAILLLTAARDAEEALRCLSEQIADAYSSFRSVRAIRIDGTDKATQDSDTVKLEVDQELSNGFKNGQNAAVVHRFESFPAGSTLIFYKYCDHENAAFKDVALVLTVLLEEETLGTSLGLKEVEEKVRDFLKVKFTNSNTPNSYNHMDPDKLNGLWSRISHLVLPVQPENALKRGICL

SEQ ID NO: 14919 - protein, 470 aa, Artificial Sequence
  Description of Artificial Sequence: Synthetic coding sequence
MADSGLREPQEDSQKDLENDPSVNSQAQETTIIASNAEEAEILHSACGLSKDHQEVETEGPESADTGDKSESPDEANVGKHPKDKTEDENKQSFLDGGKGHHLPSENLGKEPLDPDPSHSPSDKVGRADAHLGSSSVALPKEASDGTGASQEPPTTDSQEAQSPGHSSAGQEGEDTLRRRLLAPEAGSHPQQTQKLEEIKENAQDTMRQINKKGFWSYGPVILVVLVVAVVASSVNSYYSSPAQQVPKNPALEAFLAQFSQLEDKFPGQSSFLWQRGRKFLQKHLNASNPTEPATIIFTAAREGRETLKCLSHHVADAYTSSQKVSPIQIDGAGRTWQDSDTVKLLVDLELSYGFENGQKAAVVHHFESFPAGSTLIFYKYCDHENAAFKDVALVLTVLLEEETLEASVGPRETEEKVRDLLWAKFTNSDTPTSFNHMDSDKLSGLWSRISHLVLPVQPVSSIEEQGCLF

SEQ ID NO: 14920 - protein, 337 aa, Artificial Sequence
  Description of Artificial Sequence: Synthetic coding sequence
MRAVFIQGAEEHPAAFCYQVNGSCPRTVHTLGIQLVIYLACAAGMLIIVLGNVFVAFAVSYFKALHTPTNFLLLSLALADMFLGLLVLPLSTIRSVESCWFFGDFLCRLHTYLDTLFCLTSIFHLCFISIDRHCAICDPLLYPSKFTVRVALRYILAGWGVPAAYTSLFLYTDVVETRLSQWLEEMPCVGSCQLLLNKFWGWLNFPLFFVPCLIMISLYVKIFVVATRQAQQITTLSKSLAGAAKHERKAAKTLGIAVGIYLLCWLPFTIDTMVDSLLHFITPPLVFDIFIWFAYFNSACNPIIYVFSYQWFRKALKLTLSQKVFSPQTRTVDLYQE

SEQ ID NO: 14921 - protein, 342 aa, Artificial Sequence
  Description of Artificial Sequence: Synthetic coding sequence
MTSNFSQPVVQLCYEDVNGSCIETPYSPGSRVILYTAFSFGSLLAVFGNLLVMTSVLHFKQLHSPTNFLIASLACADFLVGVTVMLFSMVRTVESCWYFGAKFCTLHSCCDVAFCYSSVLHLCFICIDRYIVVTDPLVYATKFTVSVSGICISVSWILPLTYSGAVFYTGVNDDGLEELVSALNCVGGCQIIVSQGWVLIDFLLFFIPTLVMIILYSKIFLIAKQQAIKIETTSSKVESSSESYKIRVAKRERKAAKTLGVTVLAFVISWLPYTVDILIDAFMGFLTPAYIYEICCWSAYYNSAMNPLIYALFYPWFRKAIKLILSGDVLKASSSTISLFLE

SEQ ID NO: 14922 - protein, 1259 aa, Artificial Sequence
  Description of Artificial Sequence: Synthetic coding sequence
MDASEEPLPPVIYTMENKPIVTCAGDQNLFTSVYPTLSQQLPREPMEWRRSYGRAPKMIHLESNFVQFKEELLPKEGNKALLTFPFLHIYWTECCDTEVYKATVKDDLTKWQNVLKAHSSVDWLIVIVENDAKKKNKTNILPRTSIVDKIRNDFCNKQSDRCVVLSDPLKDSSRTQESWNAFLTKLRTLLLMSFTKNLGKFEDDMRTLREKRTEPGWSFCEYFMVQEELAFVFEMLQQFEDALVQYDELDALFSQYVVNFGAGDGANWLTFFCQPVKSWNGLILRKPIDMEKRESIQRREATLLDLRSYLFSRQCTLLLFLQRPWEVAQRALELLHNCVQELKLLEVSVPPGALDCWVFLSCLEVLQRIEGCCDRAQIDSNIAHTVGLWSYATEKLKSLGYLCGLVSEKGPNSEDLNRTVDLLAGLGAERPETANTAQSPYKKLKEALSSVEAFEKHYLDLSHATIEMYTSIGRIRSAKFVGKDLAEFYMRKKAPQKAEIYLQGALKNYLAEGWALPITHTRKQLAECQKHLGQIENYLQTSSLLASDHHLTEEERKHFCQEILDFASQPSDSPGHKIVLPMHSFAQLRDLHFDPSNAVVHVGGVLCVEITMYSQMPVPVHVEQIVVNVHFSIEKNSYRKTAEWLTKHKTSNGIINFPPETAPFPVSQNSLPALELYEMFERSPSDNSLNTTGIICRNVHMLLRRQESSSSLEMPSGVALEEGAHVLRCSHVTLEPGANQITFRTQAKEPGTYTLRQLCASVGSVWFVLPHIYPIVQYDVYSQEPQLHVEPLADSLLAGIPQRVKFTVTTGHYTIKNGDSLQLSNAEAMLILCQAESRAVVYSNTREQSSEAALRIQSSDKVTSISLPVAPAYHVIEFELEVLSLPSAPALGGESDMLGMAEPHRKHKDKQRTGRCMVTTDHKVSIDCPWSIYSTVIALTFSVPFRTTHSLLSSGTRKYVQVCVQNLSELDFQLSDSYLVDTGDSTDLQLVPLNTQSQQPIYSKQSVFFVWELKWTEEPPPSLHCRFSVGFSPASEEQLSISLKPYTYEFKVENFFTLYNVKAEIFPPSGMEYCRTGSLCSLEVLITRLSDLLEVDKDEALTESDEHFSTKLMYEVVDNSSNWAVCGKSCGVISMPVAARATHRVHMEVMPLFAGYLPLPDVRLFKYLPHHSAHSSQLDADSWIENDSLSVDKHGDDQPDSSSLKSRGSVHSACSSEHKGLPMPRLQALPAGQVFNSSSGTQVLVIPSQDDHVLEVSVT

SEQ ID NO: 14923 - protein, 390 aa, Artificial Sequence
  Description of Artificial Sequence: Synthetic coding sequence
MLILCQAESRAVVYSNTRAPALGGESDMLGMAEPHRKHKDKQRTGRCMVTTDHKVSIDCPWSIYSTVIALTFSVPFRTTHSLLSSGTRKYVQVCVQNLSELDFQLSDSYLVDTGDSTDLQLVPLNTQSQQPIYSKQSVFFVWELKWTEEPPPSLHCRFSVGFSPASEEQLSISLKPYTYEFKVENFFTLYNVKAEIFPPSGMEYCRTGSLCSLEVLITRLSDLLEVDKDEALTESDEHFSTKLMYEVVDNSSNWAVCGKSCGVISMPVAARATHRVHMEVMPLFAGYLPLPDVRLFKYLPHHSAHSSQLDADSWIENDSLSVDKHGDDQPDSSSLKSRGSVHSACSSEHKGLPMPRLQALPAGQVFNSSSGTQVLVIPSQDDHVLEVSVT

SEQ ID NO: 14924 - protein, 140 aa, Artificial Sequence [sequence omitted]

SEQ ID NO: 14925 - protein, 188 aa, Artificial Sequence
  Description of Artificial Sequence: Synthetic coding sequence
MEARFTRGKSALLERALARPRTEVSLSAFALLFSELVQHCQSRVFSVAELQSRLAALGRQVGARVLDALVAREKGARRETKVLGALLFVKGAVWKALFGKEADKLEQANDDARTFYIIEREPLINTYISVPKENSTLNCASFTAGIVEAVLTHSGFPAKVTAHWHKGTTLMIKFEEAVIARDRALEGR

SEQ ID NO: 14926 - protein, 188 aa, Artificial Sequence; identical to SEQ ID NO: 14925
  Description of Artificial Sequence: Synthetic coding sequence

SEQ ID NO: 14927 - protein, 188 aa, Artificial Sequence; identical to SEQ ID NO: 14925
  Description of Artificial Sequence: Synthetic coding sequence

SEQ ID NO: 14928 - protein, 173 aa, Artificial Sequence
  Description of Artificial Sequence: Synthetic coding sequence
MADTVLFEFLHTEMVAELWAHDPDPGPGVSAGLRGEEAGATKGQKMSLSVLEGMGFRVGQALGERLPRETLAFREELDVLKFLCKDLWVAVFQKQMDSLRTNHQGTYVLQDNSFPLLLPMASGLQYLEEAPKFLAFTCGLLRGALYTLGIESVVTASVAALPVCKFQVVIPKS

SEQ ID NO: 14929 - protein, 159 aa, Artificial Sequence
  Description of Artificial Sequence: Synthetic coding sequence
MADTVLFEFLHTEMVAELWAHDPDPGPGGQKMSLSVLEGMGFRVGQALGERLPRETLAFREELDVLKFLCKDLWVAVFQKQMDSLRTNHQGTYVLQDNSFPLLLPMASGLQYLEEAPKFLAFTCGLLRGALYTLGIESVVTASVAALPVCKFQVVIPKS

SEQ ID NO: 14930 - protein, 113 aa, Artificial Sequence
  Description of Artificial Sequence: Synthetic coding sequence
MADTVLFEFLHTEMVAELWAHDPDPGPGAAPGDAGLQGGAGCPQVLVQRPVGGGVPEADGQPAHQSPGDLRPARQQLPPPPPDGLWPAVSGGSTQVPGLHLRPPARRPLYPGH

SEQ ID NO: 14931 - protein, 158 aa, Artificial Sequence
  Description of Artificial Sequence: Synthetic coding sequence
MADEALFLLLHNEMVSGVYKSAEQGEVENGRCITKLENMGFRVGQGLIERFTKDTARFKDELDIMKFICKDFWTTVFKKQIDNLRTNHQGIYVLQDNKFRLLTQMSAGKQYLEHASKYLAFTCGLIRGGLSNLGIKSIVTAEVSSMPACKFQVMIQKL

SEQ ID NO: 14932 - protein, 130 aa, Artificial Sequence
  Description of Artificial Sequence: Synthetic coding sequence
MADEALFLLLHNEMVSGVYKSAEQGEVENGRCITKLENMGFRVGQGLIERFTKDTARFKDELDIMKFICKDFWTTVFKKQIDNLRTNHQYLAFTCGLIRGGLSNLGIKSIVTAEVSSMPACKFQVMIQKL

SEQ ID NO: 14933 - protein, 363 aa, Artificial Sequence
  Description of Artificial Sequence: Synthetic coding sequence
MFKRHKSLASERKRALLSQRATRFILKDDMRNFHFLSKLVLSAGPLRPTPAVKHSKTTHFEIEIFDAQTRKQICILDKVTQSSTIHDVKQKFHKACPKWYPSRVGLQLECGGPFLKDYITIQSIAASSIVTLYATDLGQQVSWTTVFLAEYTGPLLIYLLFYLRIPCIYDGKESARRLRHPVVHLACFCHCIHYIRYLLETLFVHKVSAGHTPLKNLIMSCAFYWGFTSWIAYYINHPLYTPPSFGNRQITVSAINFLICEAGNHFINVMLSHPNHTGNNACFPSPNYNPFTWMFFLVSCPNYTYEIGSWISFTVMTQTLPVGIFTLLMSIQMSLWAQKKHKIYLRKFNSYIHRKSAMIPFIL

SEQ ID NO: 14934 - protein, 753 aa, Artificial Sequence
  Description of Artificial Sequence: Synthetic coding sequence
MAAGSTTLHAVEKLQVRLATKTEPKKLEKYLQKLSALPMTADILAETGIRKTVKRLRKHQHVGDFARDLAARWKKLVLVDRNTRPGPQDPEESASRQRFGEALQDQEKAWGFPENATAPRSPSHSPEHRRTARRTPPGQQRPHPRSHSREPRAERKCPRIAPADSGRYRASPTRTAPLRMPEGPEPAAPGKQPGRGHTHAAQGGPLLCPGCQGQPQGKAVVSHSKGHKSSRQEKRPLCAQGDWHSPTLIREKSCGACLREETPRMPSWASARDRQPSDFKTDKEGGQAGSGQRVPALEEAPDSHQKRPQHSHSNKKRPSLDGRDPGNGTHGLSPEEKEQLSNDRETQEGKPPTAHLDRTSVSSLSEVEEVDMAEEFEQPTLSCEKYLTYDQLRKQKKKTGKSATTALGDKQRKANESKGTRESWDSAKKLPPVQESQSERLQAAGADSAGPKTVPSHVFSELWDLSEAWMQANYDPLSDSDSMTSQAKPEALSSPKFREEAAFPGRRVNAKMPVYSGSRPACQLQVPTLRQQCAQVLRNNPDALSDVGEVPYWVLEPVLEGWRPDQLYRRKKDNHALVRETDELRRNHCFQDFKEEKPQENKTWREQYLRLPDAPEQRLRVMTTNIRSARGNNPNGREAKMICFKSVAKTPYDTSRRQEKSAGDADPENGEIKPASKPAGSSHTPSSQSSSGGGRDSSSSILRWLPEKRANPCLSSSNEHAAPAAKTRKQAAKKVAPLMAKAIRDYKRRFSRR

SEQ ID NO: 14935 - protein, 546 aa, Artificial Sequence
  Description of Artificial Sequence: Synthetic coding sequence
MAAGSTTLRAVGKLQVRLATKTEPKKLEKYLQKLSALPMTADILAETGIRKTVKRLRKHQHVGDFARDLAARWKKLVLVDRNTGPDPQDPEESASRQRFGEALQEREKAWGFPENATAPRSPSHSPEHRRTARRTPPGQQRPHPRSPSREPRAERKRPRMAPADSGPHRDPPTRTAPLPMPEGPEPAVPGEQPGRGHAHAAQGGPLLGQGCQGQPQGEAVGSHSKGHKSSRGASAQKSPPVQESQSERLQAAGADSAGPKTVPSHVFSELWDPSEAWMQANYDLLSAFEAMTSQANPEALSAPALQEEAAFPGRRVNAKMPVYSGSRPACQLQVPTLRQQCLRVPRNNPDALGDVEGVPYSVLEPVLEGWTPDQLYRTEKDNAALARETDELWRIHCLQDFKEEKPQEHESWRELYLRLRDAREQRLRVVTTKIRSARENKPSGRQTKMICFNSVAKTPYDASRRQEKSAGAADPGNGEMEPAPKPAGSSQAPSGLGDGDGGSVSGGGSSNRHAAPADKTRKQAAKKVAPLMAKAIRDYKGRFSRR

SEQ ID NO: 14936 - protein, 546 aa, Artificial Sequence
  Description of Artificial Sequence: Synthetic coding sequence
MAAGSTTLRAVGKLQVRLATKTEPKKLEKYLQKLSALPMTADILAETGIRKTVKRLRKHQHVGDFARDLAARWKKLVLVDRNTGPDPQDPEESASRQRFGEALQEREKAWGFPENATAPRSPSHSPEHRRTARRTPPGQQRPHPRSPSREPRAERKRPRMAPADSGPHRDPPTRTAPLPMPEGPEPAVPGEQPGRGHAHAAQGGPLLGQGCQGQPQGEAVGSHSKGHKSSRGASAQKSPPVQESQSERLQAAGADSAGPKTVPSHVFSELWDPSEAWMQANYDLLSAFEAMTSQANPEALSAPTLQEEAAFPGRRVNAKMPVYSGSRPACQLQVPTLRQQCLRVPRNNPDALGDVEGVPYSVLEPVLEGWTPDQPYRTEKDNAALARETDELWRIHCLQDFKEEKPQEHESWRELYLRLRDAREQRLRVVTTKIRSARENKPSGRQTKMICFNSVAKTPYDASRRQEKSAGAADPGNGEMEPAPKPAGSSQAPSGLGDGDGGSVSGGGSSNRHAAPADKTRKQAAKKVAPLMAKAIRDYKGRFSRR

SEQ ID NO: 14937 - protein, 360 aa, Artificial Sequence
  Description of Artificial Sequence: Synthetic coding sequence
MSGSVLFTAGERWRCFLTPSRSSLYWALHNFCCRKKSTTPKKITPNVTFCDENAKEPENALDKLFSSEQQASILHVLNTASTKELEAFRLLRGRRSINIVEHRENFGPFQNLESLMNVPLFKYKSTVQVCNSILCPKTGREKRKSPENRFLRKLLKPDIERERLKAVNSIISIVFGTRRIAWAHLDRKLTVLDWQQSDRWSLMRGIYSSSVYLEEISSIISKMPKADFYVLEKTGLSIQNSSLFPILLHFHIMEAMLYALLNKTFAQDGQHQVLSMNRNAVGKHFELMIGDSRTSGKELVKQFLFDSILKADPRVFFPSDKIVHYRQMFLSTELQRVEELYDSLLQAIAFYELAVFDSQP

SEQ ID NO: 14938 - protein, 360 aa, Artificial Sequence; identical to SEQ ID NO: 14937
  Description of Artificial Sequence: Synthetic coding sequence

SEQ ID NO: 14939 - protein, 181 aa, Artificial Sequence
  Description of Artificial Sequence: Synthetic coding sequence
MSGSVLFTAGERWRCFLTPSRSSLYWALHNFCCRKKSTTPKKITPNVTFCDENAKEPENALDKLFSSEQQASILHVLNTASTKELEAFRLLRGRRSINIVEHRENFGPFQNLESLMNVPLFKYKSTVQVCNSILCPKTGREKRKSPENRFLRKLLKPDIERERLKVYSSCLLYCLIFENLL

SEQ ID NO: 14940 - protein, 396 aa, Artificial Sequence
  Description of Artificial Sequence: Synthetic coding sequence
MWIPVVGLPRRLRLSALAGAGRFCILGSEAATRKHLPARNHCGLSDSSPQLWPEPDFRNPPRKASKASLDFKRYVTDRRLAETLAQIYLGKPSRPPHLLLECNPGPGILTQALLEAGAKVVALESDKTFIPHLESLGKNLDGKLRVIHCDFFKLDPRSGGVIKPPAMSSRGLFKNLGIEAVPWTADIPLKVVGMFPSRGEKRALWKLAYDLYSCTSIYKFGRIEVNMFIGEKEFQKLMADPGNPDLYHVLSVIWQLACEIKVLHMEPWSSFDIYTRKGPLENPKRRELLDQLQQKLYLIQMIPRQNLFTKNLTPMNYNIFFHLLKHCFGRRSATVIDHLRSLTPLDARDILMQIGKQEDEKVVNMHPQDFKTLFETIERSKDCAYKWLYDETLEDR

SEQ ID NO: 14941 - protein, 137 aa, Artificial Sequence
  Description of Artificial Sequence: Synthetic coding sequence
MWIPVVGLPRRLRLSALAGAGRFCILGSEAATRKHLPARNHCGLSDSSPQLWPEPDFRNPPRKASKASLDFKRYVTDRRLAETLAQIYLGKPSRPPHLLLECNPGPGILTQALLEAGAKVVALESDKTFIPHLETSL

SEQ ID NO: 14942 - protein, 631 aa, Artificial Sequence
  Description of Artificial Sequence: Synthetic coding sequence
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 14943 - protein, 521 aa, Artificial Sequence
  Description of Artificial Sequence: Synthetic coding sequence
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 14944 - protein, 521 aa, Artificial Sequence; identical to SEQ ID NO: 14943
  Description of Artificial Sequence: Synthetic coding sequence

SEQ ID NO: 14945 - protein, 128 aa, Artificial Sequence
  Description of Artificial Sequence: Synthetic coding sequence
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFH

SEQ ID NO: 14946 - protein, 118 aa, Artificial Sequence
  Description of Artificial Sequence: Synthetic coding sequence
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDK

SEQ ID NO: 14947 - protein, 631 aa, Artificial Sequence; identical to SEQ ID NO: 14942
  Description of Artificial Sequence: Synthetic coding sequence

SEQ ID NO: 14948 - protein, 103 aa, Artificial Sequence
  Description of Artificial Sequence: Synthetic coding sequence
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMV

SEQ ID NO: 14949 - protein, 848 aa, Artificial Sequence
  Description of Artificial Sequence: Synthetic coding sequence
MEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKFVAHPNCQQQLLTIWYENLSGLREQTIAIKCLVVLVVALGLPFLAIGYWIAPCSRLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 14950 - protein, 921 aa, Artificial Sequence
  Description of Artificial Sequence: Synthetic coding sequence
MSTKVRKCKEQARVTFPAPEEEEDEGEDEGAEPQRRRRGWRGVNGGLEPRSAPSQREPHGYCPPPFSHGPDLSMEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKFVAHPNCQQQLLTIWYENLSGLREQTIAIKCLVVLVVALGLPFLAIGYWIAPCSRLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 14951 - protein, 93 aa, Artificial Sequence
  Description of Artificial Sequence: Synthetic coding sequence
MEGSPSLRRMTVMREKGRRQAVRGPAFMFNDRGTSLTAEEERFLDAAEYGNIPVVRKMLEESKTLNVNCVDYMGQNALQLAVGNEHLEVTELL

SEQ ID NO: 14952 - protein, 793 aa, Artificial Sequence
  Description of Artificial Sequence: Synthetic coding sequence
MEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 14953 - protein, 248 aa, Artificial Sequence
  Description of Artificial Sequence: Synthetic coding sequence
MICTFLRAVQYTEKLHRSSAKRLLLPYIVLNKACLKTEPSLRCGLQYQKKTLRPRCILGVTQKTIWTQGPSPRKAKEDGSKQVSVHRSQRGGTAVPTSQKVKEAGRDFTYLIVVLFGISITGGLFYTIFKELFSSSSPSKIYGRALEKCRSHPEVIGVFGESVKGYGEVTRRGRRQHVRFTEYVKDGLKHTCVKFYIEGSEPGKQGTVYAQVKENPGSGEYDFRYIFVEIESYPRRTIIIEDNRSQDD

SEQ ID NO: 14954 - protein, 134 aa, Artificial Sequence
  Description of Artificial Sequence: Synthetic coding sequence
MEGGGGSGNKTTGGLAGFFGAGGAGYSHADLAGVPLTGMNPLSPYLNVDPRYLVQDTDEFILPTGANKTRGRFELAFFTIGGCCMTGALWANTLGSLALLYSAFGVIIEKTRGAEDDLNTVAAGTMTGMLYKCT

SEQ ID NO: 14955 - protein, 171 aa, Artificial Sequence
  Description of Artificial Sequence: Synthetic coding sequence
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVQILNMVTRQGALWANTLGSLALLYSAFGVIIEKTRGAEDDLNTVAAGTMTGMLYKCT

SEQ ID NO: 14956 - protein, 149 aa, Artificial Sequence
  Description of Artificial Sequence: Synthetic coding sequence
MTGAAFGAMNGLRLGLKETQNMAWSKPRNVQILNMVTRQGALWANTLGSLALLYSAFGVIIEKTRGAEDDLNTVAAGTMTGMLYKCTASASQGAGIADGVSFTQCSMLPRLECSGVISASYNLHLPAACLGLPKCRDCSLCPAATPSGK

SEQ ID NO: 14957 - protein, 123 aa, Artificial Sequence
  Description of Artificial Sequence: Synthetic coding sequence
MEGGGGSGNKTTGGLAGFFGAGGAGYSHADLAGVPLTGMNPLSPYLNVDPRYLVQDTDEFILPTGANKTRGRFELAFFTIGGCCMTALLYSAFGVIIEKTRGAEDDLNTVAAGTMTGMLYKCT

SEQ ID NO: 14958 - protein, 456 aa, Artificial Sequence
  Description of Artificial Sequence: Synthetic coding sequence
MASALSLGNKCDPFLRCVLCRGGGALQGPRGRGPDDFESQLSPPGSARRLVRSKRACGNPPDAFGLSRASVHPPLPRVSIGCSSGPGRAKRERVGGAAWRQRKMAASAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 14959 - protein, 240 aa, Artificial Sequence
  Description of Artificial Sequence: Synthetic coding sequence
MVPRFLMSSTMMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 14960 - protein, 83 aa, Artificial Sequence
  Description of Artificial Sequence: Synthetic coding sequence
MAELGEADEAELQRLVAAEQQKAQFTAQVHHFMELCWDKCVEKPGNRLDSRTENCLSSCVDRFIDTTLAITSRFAQIVQKGGQ

SEQ ID NO: 14961 - protein, 98 aa, Artificial Sequence
  Description of Artificial Sequence: Synthetic coding sequence
MRKHSCRKVASLRRTMAELGEADEAELQRLVAAEQQKAQFTAQVHHFMELCWDKCVEKPGNRLDSRTENCLSSCVDRFIDTTLAITSRFAQIVQKGGQ

SEQ ID NO: 14962 - protein, 285 aa, Artificial Sequence
  Description of Artificial Sequence: Synthetic coding sequence
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGAVTGSLFRINVGLRGLVAGGIIGALLGTPVGGLLMAFQKYSGETVQERKQKDRKALHELKLEEWKGRLQVTEHLPEKIESSLQEDEPENDAKKIEALLNLPRNPSVIDKQDKD

SEQ ID NO: 14963 - protein, 145 aa, Artificial Sequence
  Description of Artificial Sequence: Synthetic coding sequence
MVGRNSAIAAGVCGALFIGYCIYFDRKRRSDPNFKNRLRERRKKQKLAKERAGLSKLPDLKDAEAVQKFFLEEIQLGEELLAQGEYEKGVDHLTNAIAVCGQPQQLLQVLQQTLPPPVFQMLLTKLPTISQRIVSAQSLAEDDVE

SEQ ID NO: 14964 - protein, 152 aa, Artificial Sequence
  Description of Artificial Sequence: Synthetic coding sequence
MPSVRSLLRLLAAAAACGAFAFLGYCIYLNRKRRGDPAFKRRLRDKRRAEPQKAEEQGTQLWDPTKNKKLQELFLQEVRMGELWLSRGEHRMGIQHLGNALLVCEQPRELLKVFKHTLPPKVFEMLLHKIPLICQQFEADMNEQDCLEDDPD

SEQ ID NO: 14965 - protein, 309 aa, Artificial Sequence
  Description of Artificial Sequence: Synthetic coding sequence
MAPKFPDSVEELRAAGNESFRNGQYAEASALYGRALRVLQAQGSSDPEEESVLYSNRAACHLKDGNCRDCIKDCTSALALVPFSIKPLLRRASAYEALEKYPMAYVDYKTVLQIDDNVTSAVEGINRMTRALMDSLGPEWRLKLPSIPLVPVSAQKRWNSLPSENHKEMAKSKSKETTATKNRVPSAGDVEKARVLKEEGNELVKKGNHKKAIEKYSESLLCSNLESATYSNRALCYLVLKQYTEAVKDCTEALKLDGKNVKAFYRRAQAHKALKDYKSSFADISNLLQIEPRNGPAQKLRQEVKQNLH

SEQ ID NO: 14966 - protein, 308 aa, Artificial Sequence
  Description of Artificial Sequence: Synthetic coding sequence
MGNTLGLAPMGTLPRRSPRREEPLPNPGSFDELHRLCKDVFPAQMEGVKLVVNKVLSSHFQVAHTIHMSALGLPGYHLHAAYAGDWQLSPTEVFPTVVGDMDSSGSLNAQVLLLLAERLRAKAVFQTQQAKFLTWQFDGEYRGDDYTATLTLGNPDLIGESVIMVAHFLQSLTHRLVLGGELVYHRRPGEEGAILTLAGKYSAVHWVATLNVGSGGAHASYYHRANEQVQVGVEFEANTRLQDTTFSFGYHLTLPQANMVFRGLVDSNWCVGAVLEKKMPPLPVTLALGAFLNHWRNRFHCGFSITVG

SEQ ID NO: 14967 - protein, 308 aa, Artificial Sequence; identical to SEQ ID NO: 14966
  Description of Artificial Sequence: Synthetic coding sequence

SEQ ID NO: 14968 - protein, 210 aa, Artificial Sequence
  Description of Artificial Sequence: Synthetic coding sequence
MSCTVYAKVAHTIHMSALGLPGYHLHAAYAGDWQLSPTEVFPTVVGDMDSSGSLNAQVLLLLAERLRAKAVFQTQQAKFLTWQFDGEYRGDDYTATLTLAGKYSAVHWVATLNVGSGGAHASYYHRANEQVQVGVEFEANTRLQDTTFSFGYHLTLPQANMVFRGLVDSNWCVGAVLEKKMPPLPVTLALGAFLNHWRNRFHCGFSITVG

SEQ ID NO: 14969 - protein, 274 aa, Artificial Sequence
  Description of Artificial Sequence: Synthetic coding sequence
MGNTLGLAPMGTLPRRSPRREEPLPNPGSFDELHRLCKDVFPAQMEGVKLVVNKVLSSHFQVAHTIHMSALGLPGYHLHAAYAGDWQLSPTETQQAKFLTWQFDGEYRGDDYTATLTLGNPDLIGESVIMVAHFLQSLTHRLVLGGELVYHRRPGEEGAILTLAGKYSAVHWVATLNVGSGGAHASYYHRANEQVQVGVEFEANTRLQDTTFSFGYHLTLPQANMVFRGLVDSNWCVGAVLEKKMPPLPVTLALGAFLNHWRNRFHCGFSITVG

SEQ ID NO: 14970 - protein, 51 aa, Artificial Sequence
  Description of Artificial Sequence: Synthetic coding sequence
MFRIEGLAPKLDPEEMKRKMREDVISSIRNFLIYVALLRVTPFILKKLDSI

SEQ ID NO: 14971 - protein, 85 aa, Artificial Sequence
  Description of Artificial Sequence: Synthetic coding sequence
MFRIEGLAPKLDPEEMKRKMREDVISSIRNFLIYVALLRVSECLPGCDCETSGELTDGHPLTLRGHRGLRTELNAPFILKKLDSI

SEQ ID NO: 14972 - protein, 92 aa, Artificial Sequence
  Description of Artificial Sequence: Synthetic coding sequence
MFRIEGLAPKLDPEEMKRKMREDVISSIRNFLIYVALLRVSECLPGCDCETSGELTDGHPLTLRGHRGLRTELNGSGEQGGCALKATGICAV

SEQ ID NO: 14973 - protein, 74 aa, Artificial Sequence
  Description of Artificial Sequence: Synthetic coding sequence
MASSTVPVSAAGSANETPEIPDNVGDWLRGVYRFATDRNDFRRNLILNLGLFAAGVWLARNLSDIDLMAPQPGV

SEQ ID NO: 14974 - protein, 74 aa, Artificial Sequence; identical to SEQ ID NO: 14973
  Description of Artificial Sequence: Synthetic coding sequence

SEQ ID NO: 14975 - protein, 55 aa, Artificial Sequence
  Description of Artificial Sequence: Synthetic coding sequence
MVKLSKEAKQRLQQLFKGSQFAIRWGFIPLVIYLGFKRGADPGMPEPTVLSLLWG

SEQ ID NO: 14976 - protein, 608 aa, Artificial Sequence
  Description of Artificial Sequence: Synthetic coding sequence
MAASKPVEAAVVAAAVPSSGSGVGGGGTAGPGTGGLPRWQLALAVGAPLLLGAGAIYLWSRQQRRREARGRGDASGLKRNSERKTPEGRASPAPGSGHPEGPGAHLDMNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGEALEVKENSGYLKAKQYMEEENYDKIISECSKEIDAEGKYMAEALLLRATFYLLIGNANAAKPDLDKVISLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQALTDQQQFGKADEMYDKCIDLEPDNATTYVHKGLLQLQWKQDLDRGLELISKAIEIDNKCDFAYETMGTIEVQRGNMEKAIDMFNKAINLAKSEMEMAHLYSLCDAAHAQTEVAKKYGLKPPTL

SEQ ID NO: 14977 - protein, 501 aa, Artificial Sequence
  Description of Artificial Sequence: Synthetic coding sequence
MNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGEALEVKENSGYLKAKQYMEEENYDKIISECSKEIDAEGKYMAEALLLRATFYLLIGNANAAKPDLDKVISLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQALTDQQQFGKADEMYDKCIDLEPDNATTYVHKGLLQLQWKQDLDRGLELISKAIEIDNKCDFAYETMGTIEVQRGNMEKAIDMFNKAINLAKSEMEMAHLYSLCDAAHAQTEVAKKYGLKPPTL

SEQ ID NO: 14978 - protein, 374 aa, Artificial Sequence
  Description of Artificial Sequence: Synthetic coding sequence
MAIRKKSTKSPPVLSHEFVLQNHADIVSCVAMVFLLGLMFEITAKASIIFVTLQYNVTLPATEEQATESVSLYYYGIKDLATVFFYMLVAIIIHAVIQEYMLDKINRRMHFSKTKHSKFNESGQLSAFYLFACVWGTFILISENYISDPTILWRAYPHNLMTFQMKFFYISQLAYWLHAFPELYFQKTKKEDIPRQLVYIGLYLFHIAGAYLLNLNHLGLVLLVLHYFVEFLFHISRLFYFSNEKYQKGFSLWAVLFVLGRLLTLILSVLTVGFGLARAENQKLDFSTGNFNVLAVRIAVLASICVTQAFMMWKFINFQLRRWREHSAFQAPAVKKKPTVTKGRSSKKGTENGVNGTLTSNVADSPRNKKEKSS

SEQ ID NO: 14979 - protein, 343 aa, Artificial Sequence
  Description of Artificial Sequence: Synthetic coding sequence
MVFLLGLMFEITAKASIIFVTLQYNVTLPATEEQATESVSLYYYGIKDLATVFFYMLVAIIIHAVIQEYMLDKINRRMHFSKTKHSKFNESGQLSAFYLFACVWGTFILISENYISDPTILWRAYPHNLMTFQMKFFYISQLAYWLHAFPELYFQKTKKEDIPRQLVYIGLYLFHIAGAYLLNLNHLGLVLLVLHYFVEFLFHISRLFYFSNEKYQKGFSLWAVLFVLGRLLTLILSVLTVGFGLARAENQKLDFSTGNFNVLAVRIAVLASICVTQAFMMWKFINFQLRRWREHSAFQAPAVKKKPTVTKGRSSKKGTENGVNGTLTSNVADSPRNKKEKSS

SEQ ID NO: 14980 - protein, 369 aa, Artificial Sequence
  Description of Artificial Sequence: Synthetic coding sequence
MGLRKKSTKNPPVLSQEFILQNHADIVSCVGMFFLLGLVFEGTAEASIVFLTLQHSVAVPAAEEQATGSKSLYYYGVKDLATVFFYMLVAIIIHATIQEYVLDKINKRMQFTKAKQNKFNESGQFSVFYFFSCIWGTFILISENCLSDPTLIWKARPHSMMTFQMKFFYISQLAYWFHAFPELYFQKTKKQDIPRQLVYIGLHLFHITGAYLLYLNHLGLLLLVLHYFVELLSHMCGLFYFSDEKYQKGISLWAIVFILGRLVTLIVSVLTVGFHLAGSQNRNPDALTGNVNVLAAKIAVLSSSCTIQAYVTWNLITLWLQRWVEDSNIQASCMKKKRSRSSKKRTENGVGVETSNRVDCPPKRKEKSS

SEQ ID NO: 14981 - protein, 370 aa, Artificial Sequence
  Description of Artificial Sequence: Synthetic coding sequence
MAFRRRTKSYPLFSQEFVIHNHADIGFCLVLCVLIGLMFEVTAKTAFLFILPQYNISVPTADSETVHYHYGPKDLVTILFYIFITIILHAVVQEYILDKISKRLHLSKVKHSKFNESGQLVVFHFTSVIWCFYVVVTEGYLTNPRSLWEDYPHVHLPFQVKFFYLCQLAYWLHALPELYFQKVRKEEIPRQLQYICLYLVHIAGAYLLNLSRLGLILLLLQYSTEFLFHTARLFYFADENNEKLFSAWAAVFGVTRLFILTLAVLAIGFGLARMENQAFDPEKGNFNTLFCRLCVLLLVCAAQAWLMWRFIHSQLRHWREYWNEQSAKRRVPATPRLPARLIKRESGYHENGVVKAENGTSPRTKKLKSP

SEQ ID NO: 14982 - protein, 170 aa, Artificial Sequence
  Description of Artificial Sequence: Synthetic coding sequence
MRLQGAIFVLLPHLGPILVWLFTRDHMSGWCEGPRMLSWCPFYKVLLLVQTAIYSVVGYASYLVWKDLGGGLGWPLALPLGLYAVQLTISWTVLVLFFTVHNPGLALLHLLLLYGLVVSTALIWHPINKLAALLLLPYLAWLTVTSALTYHLWRDSLCPVHQPQPTEKSD

SEQ ID NO: 14983 - protein, 170 aa, Artificial Sequence; identical to SEQ ID NO: 14982
  Description of Artificial Sequence: Synthetic coding sequence

SEQ ID NO: 14984 - protein, 348 aa, Artificial Sequence
  Description of Artificial Sequence: Synthetic coding sequence
MRLGLLSVALLFVGSSHLYSDHYSPSGRHRLGPSPEPAASSQQAEAVRKRLRRRREGGAHAEDCGTAPLKDVLQGSRIIGGTEAQAGAWPWVVSLQIKYGRVLVHVCGGTLVRERWVLTAAHCTKDASDPLMWTAVIGTNNIHGRYPHTKKIKIKAIIIHPNFILESYVNDIALFHLKKAVRYNDYIQPICLPFDVFQILDGNTKCFISGWGRTKEEGNATNILQDAEVHYISREMCNSERSYGGIIPNTSFCAGDEDGAFDTCRGDSGGPLMCYLPEYKRFFVMGITSYGHGCGRRGFPGVYIGPSFYQKWLTEHFFHASTQGILTINILRGQILIALCFVILLATT

SEQ ID NO: 14985 - protein, 201 aa, Artificial Sequence
  Description of Artificial Sequence: Synthetic coding sequence
MGSRKCGGCLSCLLIPLALWSIIVNILLYFPNGQTSYASSNKLTNYVWYFEGICFSGIMMLIVTTVLLVLENNNNYKCCQSENCSKKYVTLLSIIFSSLGIAFSGYCLVISALGLVQGPYCRTLDGWEYAFEGTAGRFLTDSSIWIQCLEPAHVVEWNIILFSILITLSGLQVIICLIRVVMQLSKILCGSYSVIFQPGII

SEQ ID NO: 14986 - protein, 201 aa, Artificial Sequence; identical to SEQ ID NO: 14985
  Description of Artificial Sequence: Synthetic coding sequence

SEQ ID NO: 14987 - protein, 159 aa, Artificial Sequence
  Description of Artificial Sequence: Synthetic coding sequence
MGSRKCGGCLSCLLIPLALWSIIVNILLYFPNGQTSYASSNKLTNYVWYFEGICFSGIMMLIVTTVLLVLENNNNYKCCQSENCSKKYVTLLSIIFSSLGIAFSGYCLVISALGLVQGPYCRTLDGWEYAFEGTAGRFLTDSSIWIQCLEPAHVVEWNI

SEQ ID NO: 14988 - protein, 209 aa, Artificial Sequence
  Description of Artificial Sequence: Synthetic coding sequence
MVSSPCTQASSRTCSRILGLSLGTAALFAAGANVALLLPNWDVTYLLRGLLGRHAMLGTGLWGGGLMVLTAAILISLMGWRYGCFSKSGLCRSVLTALLSGGLALLGALICFVTSGVALKDGPFCMFDVSSFNQTQAWKYGYPFKDLHSRNYLYDRSLWNSVCLEPSAAVVWHVSLFSALLCISLLQLLLVVVHVINSLLGLFCSLCEK

SEQ ID NO: 14989 - protein, 209 aa, Artificial Sequence; identical to SEQ ID NO: 14988
  Description of Artificial Sequence: Synthetic coding sequence

SEQ ID NO: 14990 - protein, 183 aa, Artificial Sequence
  Description of Artificial Sequence: Synthetic coding sequence
MVSSPCTQASSRTCSRILGLSLGTAALFAAGANVALLLPNWDVTYLLRGLLGRHAMLGTGLWGGGLMVLTALLSGGLALLGALICFVTSGVALKDGPFCMFDVSSFNQTQAWKYGYPFKDLHSRNYLYDRSLWNSVCLEPSAAVVWHVSLFSALLCISLLQLLLVVVHVINSLLGLFCSLCEK

SEQ ID NO: 14991 - protein, 229 aa, Artificial Sequence
  Description of Artificial Sequence: Synthetic coding sequence
MTCCEGWTSCNGFSLLVLLLLGVVLNAIPLIVSLVEEDQFSQNPISCFEWWFPGIIGAGLMAIPATTMSLTARKRACCNNRTGMFLSSLFSVITVIGALYCMLISIQALLKGPLMCNSPSNSNANCEFSLKNISDIHPESFNLQWFFNDSCAPPTGFNKPTSNDTMASGWRASSFHFDSEENKHRLIHFSVFLGLLLVGILEVLFGLSQIVIGFLGCLCGVSKRRSQIV

SEQ ID NO: 14992 - protein, 14 aa, Artificial Sequence
  Description of Artificial Sequence: Synthetic coding sequence
MTCCEGWTSCNGFS

SEQ ID NO: 14993 - protein, 606 aa, Artificial Sequence
  Description of Artificial Sequence: Synthetic coding sequence
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 14994 - protein, 489 aa, Artificial Sequence
  Description of Artificial Sequence: Synthetic coding sequence
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFRYPPFIPWLLLSGS

SEQ ID NO: 14995 - protein, 242 aa, Artificial Sequence
  Description of Artificial Sequence: Synthetic coding sequence
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINS

SEQ ID NO: 14996 - protein, 210 aa, Artificial Sequence
  Description of Artificial Sequence: Synthetic coding sequence
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSE

SEQ ID NO: 14997 - protein, 301 aa, Artificial Sequence
  Description of Artificial Sequence: Synthetic coding sequence
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFP

SEQ ID NO: 14998 - protein, 257 aa, Artificial Sequence
  Description of Artificial Sequence: Synthetic coding sequence
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVIL

SEQ ID NO: 14999 - protein, 815 aa, Artificial Sequence
  Description of Artificial Sequence: Synthetic coding sequence
MSGLGRLFGKGKKEKGPTPEEAIQKLKETEKILIKKQEFLEQKIQQELQTAKKYGTKNKRAALQALRRKKRFEQQLAQTDGTLSTLEFQREAIENATTNAEVLRTMELAAQSMKKAYQDMDIDKVDELMTDITEQQEVAQQISDAISRPMGFGDDVDEDELLEELEELEQEELAQELLNVGDKEEEPSVKLPSVPSTHLPAGPGSTALRMTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 15000 - protein, 815 aa, Artificial Sequence; identical to SEQ ID NO: 14999
  Description of Artificial Sequence: Synthetic coding sequence

SEQ ID NO: 15001 - protein, 663 aa, Artificial Sequence
  Description of Artificial Sequence: Synthetic coding sequence
MSARLPVLSPPRWPRLLLLSLLLLGAVPGPRRSGAFYLPGLAPVNFCDEEKKSDECKAEIELFVNRLDSVESVLPYEYTAFDFCQASEGKRPSENLGQVLFGERIEPSPYKFTFNKKETCKLVCTKTYHTEKAEDKQKLEFLKKSMLLNYQHHWIVDNMPVTWCYDVEDGQRFCNPGFPIGCYITDKGHAKDACVISSDFHERDTFYIFNHVDIKIYYHVVETGSMGARLVAAKLEPKSFKHTHIDKPDCSGPPMDISNKASGEIKIAYTYSVSFEEDDKIRWASRWDYILESMPHTHIQWFSIMNSLVIVLFLSGMVAMIMLRTLHKDIARYNQMDSTEDAQEEFGWKLVHGDIFRPPRKGMLLSVFLGSGTQILIMTFVTLFFACLGFLSPANRGALMTCAVVLWVLLGTPAGYVAARFYKSFGGEKWKTNVLLTSFLCPGIVFADFFIMNLILWGEGSSAAIPFGTLVAILALWFCISVPLTFIGAYFGFKKNAIEHPVRTNQIPRQIPEQSFYTKPLPGIIMGGILPFGCIFIQLFFILNSIWSHQMYYMFGFLFLVFIILVITCSEATILLCYFHLCAEDYHWQWRSFLTSGFTAVYFLIYAVHYFFSKLQITGTASTILYFGYTMIMVLIFFLFTGTIGFFACFWFVTKIYSVVKVD

SEQ ID NO: 15002 - protein, 589 aa, Artificial Sequence
  Description of Artificial Sequence: Synthetic coding sequence
MRPLPGALGVAAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 15003 - protein, 254 aa, Artificial Sequence
  Description of Artificial Sequence: Synthetic coding sequence
MNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSG

SEQ ID NO: 15004 - protein, 625 aa, Artificial Sequence
  Description of Artificial Sequence: Synthetic coding sequence
MCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDQEHTYRVVRFEVIPQSIRLEDLKADEKSSCTLPEGTNSSPQEIDPTKENQLYFTYSVHWEESDIKWASRWDTYLTMSDVQIHWFSIINSVVVVFFLSGILSMIIIRTLRKDIANYNKEDDIEDTMEESGWKLVHGDVFRPPQYPMILSSLLGSGIQLFCMILIVIFVAMLGMLSPSSRGALMTTACFLFMFMGVFGGFSAGRLYRTLKGHRWKKGAFCTATLYPGVVFGICFVLNCFIWGKHSSGAVPFPTMVALLCMWFGISLPLVYLGYYFGFRKQPYDNPVRTNQIPRQIPEQRWYMNRFVGILMAGILPFGAMFIELFFIFSAIWENQFYYLFGFLFLVFIILVVSCSQISIVMVYFQLCAEDYRWWWRNFLVSGGSAFYVLVYAIFYFVNKLDIVEFIPSLLYFGYTALMVLSFWLLTGTIGFYAAYMFVRKIYAAVKID

SEQ ID NO: 15005 - protein, 642 aa, Artificial Sequence
  Description of Artificial Sequence: Synthetic coding sequence
MATAMDWLPWSLLLFSLMCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDQEHTYRVVRFEVIPQSIRLEDLKADEKSSCTLPEGTNSSPQEIDPTKENQLYFTYSVHWEESDIKWASRWDTYLTMSDVQIHWFSIINSVVVVFFLSGILSMIIIRTLRKDIANYNKEDDIEDTMEESGWKLVHGDVFRPPQYPMILSSLLGSGIQLFCMILIVIFVAMLGMLSPSSRGALMTTACFLFMFMGVFGGFSAGRLYRTLKGHRWKKGAFCTATLYPGVVFGICFVLNCFIWGKHSSGAVPFPTMVALLCMWFGISLPLVYLGYYFGFRKQPYDNPVRTNQIPRQIPEQRWYMNRFVGILMAGILPFGAMFIELFFIFSAIWENQFYYLFGFLFLVFIILVVSCSQISIVMVYFQLCAEDYRWWWRNFLVSGGSAFYVLVYAIFYFVNKLDIVEFIPSLLYFGYTALMVLSFWLLTGTIGFYAAYMFVRKIYAAVKID

SEQ ID NO: 15006 - protein, 244 aa, Artificial Sequence
  Description of Artificial Sequence: Synthetic coding sequence
MAQMFLEPLADKFIYCQVLMNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDQEHTYRVVRFEVIPQSIRLEDLKADEKSSCTLPEGTNSSPQEIDPTKENQLYFTYSVHWEESDIKWASRWDTYLTMSDVQIHWFSIINSVVVVFFLSGILSMIIIRTLRKDIANYNKEDDI

SEQ ID NO: 15007 - protein, 474 aa, Artificial Sequence
  Description of Artificial Sequence: Synthetic coding sequence
MVQRFSLRRQLSKIERLEVSSLAQTSSAVASSTDGSIHTDSVDGTPDPQRTKAAIAHLQQKILKLTEQIKIAQTARDDNVAEYLKLANSADKQQAARIKQVFEKKNQKSAQTILQLQKKLEHYHRKLREVEQNGIPRQPKDVFRDMHQGLKDVGAKVTGFSEGVVDSVKGGFSSFSQATHSAAGAVVSKPREIASLIRNKFGSADNIPNLKDSLEEGQVDDAGKALGVISNFQSSPKYGSEEDCSSATSGSVGANSTTGGIAVGASSSKTNTLDMQSSGFDALLHEIQEIRETQARLEESFETLKEHYQRDYSLIMQTLQEERYRCERLEEQLNDLTELHQNEILNLKQELASMEEKIAYQSYERARDIQEALEACQTRISKMELQQQQQQVVQLEGLENATARNLLGKLINILLAVMAVLLVFVSTVANCVVPLMKTRNRTFSTLFLVVFIAFLWKHWDALFSYVERFFSSPR

SEQ ID NO: 15008 - protein, 653 aa, Artificial Sequence
  Description of Artificial Sequence: Synthetic coding sequence
MEPSGSEQLFEDPDPGGKSQDAEARKQTESEQKLSKMTHNALENINVIGQGLKHLFQHQRRRSSVSPHDVQQIQADPEPEMDLESQNACAEIDGVPTHPTALNRVLQQIRVPPKMKRGTSLHSRRGKPEAPKGSPQINRKSGQEMTAVMQSGRPRSSSTTDAPTSSAMMEIACAAAAAAAACLPGEEGTAERIERLEVSSLAQTSSAVASSTDGSIHTDSVDGTPDPQRTKAAIAHLQQKILKLTEQIKIAQTARDDNVAEYLKLANSADKQQAARIKQVFEKKNQKSAQTILQLQKKLEHYHRKLREVEQNGIPRQPKDVFRDMHQGLKDVGAKVTGFSEGVVDSVKGGFSSFSQATHSAAGAVVSKPREIASLIRNKFGSADNIPNLKDSLEEGQVDDAGKALGVISNFQSSPKYGSEEDCSSATSGSVGANSTTGGIAVGASSSKTNTLDMQSSGFDALLHEIQEIRETQARLEESFETLKEHYQRDYSLIMQTLQEERYRCERLEEQLNDLTELHQNEILNLKQELASMEEKIAYQSYERARDIQEALEACQTRISKMELQQQQQQVVQLEGLENATARNLLGKLINILLAVMAVLLVFVSTVANCVVPLMKTRNRTFSTLFLVVFIAFLWKHWDALFSYVERFFSSPR

SEQ ID NO: 15009 - protein, 539 aa, Artificial Sequence
  Description of Artificial Sequence: Synthetic coding sequence
MKRGTSLHSRRGKPEAPKGSPQINRKSGQEMTAVMQSGRPRSSSTTDAPTSSAMMEIACAAAAAAAACLPGEEGTAERIERLEVSSLAQTSSAVASSTDGSIHTDSVDGTPDPQRTKAAIAHLQQKILKLTEQIKIAQTARDDNVAEYLKLANSADKQQAARIKQVFEKKNQKSAQTILQLQKKLEHYHRKLREVEQNGIPRQPKDVFRDMHQGLKDVGAKVTGFSEGVVDSVKGGFSSFSQATHSAAGAVVSKPREIASLIRNKFGSADNIPNLKDSLEEGQVDDAGKALGVISNFQSSPKYGSEEDCSSATSGSVGANSTTGGIAVGASSSKTNTLDMQSSGFDALLHEIQEIRETQARLEESFETLKEHYQRDYSLIMQTLQEERYRCERLEEQLNDLTELHQNEILNLKQELASMEEKIAYQSYERARDIQEALEACQTRISKMELQQQQQQVVQLEGLENATARNLLGKLINILLAVMAVLLVFVSTVANCVVPLMKTRNRTFSTLFLVVFIAFLWKHWDALFSYVERFFSSPR

SEQ ID NO: 15010 - protein, 329 aa, Artificial Sequence
  Description of Artificial Sequence: Synthetic coding sequence
MHQGLKDVGAKVTGFSEGVVDSVKGGFSSFSQATHSAAGAVVSKPREIASLIRNKFGSADNIPNLKDSLEEGQVDDAGKALGVISNFQSSPKYGSEEDCSSATSGSVGANSTTGGIAVGASSSKTNTLDMQSSGFDALLHEIQEIRETQARLEESFETLKEHYQRDYSLIMQTLQEERYRCERLEEQLNDLTELHQNEILNLKQELASMEEKIAYQSYERARDIQEALEACQTRISKMELQQQQQQVVQLEGLENATARNLLGKLINILLAVMAVLLVFVSTVANCVVPLMKTRNRTFSTLFLVVFIAFLWKHWDALFSYVERFFSSPR

SEQ ID NO: 15011 - protein, 469 aa, Artificial Sequence
  Description of Artificial Sequence: Synthetic coding sequence
MKSKEEETAVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 15012 - protein, 484 aa, Artificial Sequence
  Description of Artificial Sequence: Synthetic coding sequence
MNQVVQPLMSRHSACRGSQAHLSWVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 15013 - protein, 709 aa, Artificial Sequence
  Description of Artificial Sequence: Synthetic coding sequence
MKRCRSDELQQQQGEEDGAGLEDAASHLPGADLRPGETTGANSAGGPTSDAGAAAAPNPGPRSKPPDLKKIQQLSEGSMFGHGLKHLFHSRRRSREREHQTSQDSQQHQQQQGMSDHDSPDEKERSPEMHRVSYAMSLHDLPARPTAFNRVLQQIRSRPSIKRGASLHSSSGGGSSGSSSRRTKSSSLEPQRGSPHLLRKAPQDSSLAAILHQHQCRPRSSSTTDTALLLADGSNVYLLAEEAEGIGDKVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 15014 - protein, 256 aa, Artificial Sequence
  Description of Artificial Sequence: Synthetic coding sequence
MNQVVQPLMSRHSACRGSQAHLSWLWTSVPLCWPLTEFPAGTVKMKSKEEETAVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDG

SEQ ID NO: 15015 - protein, 631 aa, Artificial Sequence
  Description of Artificial Sequence: Synthetic coding sequence
MFGHGLKHLFHSRRRSREREHQTSQDSQQHQQQQGMSDHDSPDEKERSPEMHRVSYAMSLHDLPARPTAFNRVLQQIRSRPSIKRGASLHSSSGGGSSGSSSRRTKSSSLEPQRGSPHLLRKAPQDSSLAAILHQHQCRPRSSSTTDTALLLADGSNVYLLAEEAEGIGDKVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 15016 - protein, 477 aa, Artificial Sequence
  Description of Artificial Sequence: Synthetic coding sequence
MPGSDTALTVDRTYSYPGRHHRCKSRVERHDMNTLSLPLNIRRGGSDTNLNFDVPDGILDFHKVKLTADSLKQKILKVTEQIKIEQTSRDGNVAEYLKLVNNADKQQAGRIKQVFEKKNQKSAHSIAQLQKKLEQYHRKLREIEQNGASRSSKDISKDHLKDIHRSLKDAHVKSRTAPHCMESSKSGMPGVSLTPPVFVFNKSREFANLIRNKFGSADNIAHLKNSLEEFRPEASARAYGGSATIVNKPKYGSDDECSSGTSGSADSNGNQSFGAGGASTLDSQGKLAVILEELREIKDTQAQLAEDIEALKVQFKREYGFISQTLQEERYRYERLEDQLHDLTDLHQHETANLKQELASIEEKVAYQAYERSRDIQEALESCQTRISKLELHQQEQQALQTDTVNAKVLLGRCINVILAFMTVILVCVSTIAKFVSPMMKSRCHILGTFFAVTLLAIFCKNWDHILCAIERMIIPR

SEQ ID NO: 15017 - protein, 182 aa, Artificial Sequence
  Description of Artificial Sequence: Synthetic coding sequence
MSTSSSSSWDNLLESLSLSTVWNWIQASFLGETSAPQQTSLGLLDNLAPAVQIILRISFLILLGIGIYALWKRSIQSIQKTLLFVITLYKLYKKGSHIFEALLANPEGSGLRIQDNNNLFLSLGLQEKILKKLKTVENKMKNLEGIIVAQKPATKRDCSSEPYCSCSDCQSPLSTSGFTSPI

SEQ ID NO: 15018 - protein, 677 aa, Artificial Sequence
  Description of Artificial Sequence: Synthetic coding sequence
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSSIVVEVLRILVLIGQILFSLAAVFLLCLVIKKYLIGPYYRKLHMESKGNKEILILGISAFIFLMLTVTELLDVSMELGCFLAGALVSSQGPVVTEEIATSIEPIRDFLAIVFFASIGLHVFPTFVAYELTVLVFLTLSVVVMKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 15019 - protein, 634 aa, Artificial Sequence
  Description of Artificial Sequence: Synthetic coding sequence
MAMWNRPCQRLPQQPLVAEPTAEGEPHLPTGRELTEANRFAYAALCGISLSQLFPEPEHSSFCTEFMAGLVQWLELSEAVLPTMTAFASGLGGEGADVFVQILLKDPILKDDPTVITQDLLSFSLKDGHYDARARVLVCHMTSLLQVPLEELDVLEEMFLESLKEIKEEESEMAEASRKKKENRRKWKRYLLIGLATVGGGTVIGVTGGLAAPLVAAGAATIIGSAGAAALGSAAGIAIMTSLFGAAGAGLTGYKMKKRVGAIEEFTFLPLTEGRQLHITIAVTGWLASGKYRTFSAPWAALAHSREQYCLAWEAKYLMELGNALETILSGLANMVAQEALKYTVLSGIVAALTWPASLLSVANVIDNPWGVCLHRSAEVGKHLAHILLSRQQGRRPVTLIGFSLGARVIYFCLQEMAQEKDCQGIIEDVILLGAPVEGEAKHWEPFRKVVSGRIINGYCRGDWLLSFVYRTSSVQLRVAGLQPVLLQDRRVENVDLTSVVSGHLDYAKQMDAILKAVGIRTKPGWDEKGLLLAPGCLPSEEPRQAAAAASSGETPHQVGQTQGPISGDTSKLAMSTDPSQAQVPVGLDQSEGASLPAAASPERPPICSHGMDPNPLGCPDCACKTQGPSTGLD

SEQ ID NO: 15020 - protein, 594 aa, Artificial Sequence
  Description of Artificial Sequence: Synthetic coding sequence
MAMWNRPCQRLPQQPLVAEPTAEGEPHLPTGRELTEANRFAYAALCGISLSQLFPEPEHSSFCTEFMAGLVQWLELSEAVLPTMTAFASGLGGEGADVFVQILLKDPILKDDPTVITQDLLSFSLKDGHYDARARVLVCHMTSLLQVPLEELDVLEEMFLESLKEIKEEESEMAEASRKKKENRRKWKRYLLIGLATVGGGTVIGVTGGLAAPLVAAGAATIIGSAGAAALGSAAGIAIMTSLFGAAGAGLTGTFSAPWAALAHSREQYCLAWEAKYLMELGNALETILSGLANMVAQEALKYTVLSGIVAALTWPASLLSVANVIDNPWGVCLHRSAEVGKHLAHILLSRQQGRRPVTLIGFSLGARVIYFCLQEMAQEKDCQGIIEDVILLGAPVEGEAKHWEPFRKVVSGRIINGYCRGDWLLSFVYRTSSVQLRVAGLQPVLLQDRRVENVDLTSVVSGHLDYAKQMDAILKAVGIRTKPGWDEKGLLLAPGCLPSEEPRQAAAAASSGETPHQVGQTQGPISGDTSKLAMSTDPSQAQVPVGLDQSEGASLPAAASPERPPICSHGMDPNPLGCPDCACKTQGPSTGLD

SEQ ID NO: 15021 - protein, 580 aa, Artificial Sequence
  Description of Artificial Sequence: Synthetic coding sequence
MAMWNRPCQRLPQQPLVAEPTAEGEPHLPTGRELTEANRFAYAALCGISLSQLFPEPEHSSFCTEFMAGLVQWLELSEAVLPTMTAFASGLGGEGADVFVQILLKDPILKDDPTVITQDLLSFSLKDGHYDARARVLVCHMTSLLQVPLEELDVLEEMFLESLKEIKEEESEMAEASRKKKENRRKWKRYLLIGLATVGGGTVIGVTGGLAAPLVAAGAATIIGSAGAAALGSAAGIAIMTSLFGAAGAGLTGYKMKKRVGAIEEFTFLPLTEGRQLHITIAVTGWLASGKYRTFSAPWAALAHSREQYCLAWEAKYLMELGNALETILSGLANMVAQEALKYTVLSGIVAALTWPASLLSVANVIDNPWGVCLHRSAEVGKHLAHILLSRQQGRRPVTLIGFSLGARVIYFCLQEMAQEKDCQGIIEDVILLGAPVEGEAKHWEPFRKVVSGRIINGYCRGDWLLSFVYRTSSVQLRVAGLQPVLLQDRRVENVDLTSVVSGHLDYAKQMDAILKAVGIRTKPGWDEKGLLLAPGCLPSEEPRQAAAAASSALESGCPSGGPEGSLGPEAPTPALPWPQ

SEQ ID NO: 15022 - protein, 288 aa, Artificial Sequence
  Description of Artificial Sequence: Synthetic coding sequence
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKLTRKSQKITNCEQSSPDGALEETKVKLQQLEASYACQEKELLKVMKEYAFVTQLCEDQALYIKKYQETLKKIEEELEALFLEREVSKLVSMNPVEKEHTSQNNEGTPTQKTARLFSKKIFCCLFFITLFFIRLLSYMFFHVRFINPDLLVNVLPKVLGRSTLWKLRCFFFPSLTLETEDMLPH

SEQ ID NO: 15023 - protein, 228 aa, Artificial Sequence
  Description of Artificial Sequence: Synthetic coding sequence
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKLTRKSQKITNCEQSSPDGALEETKVKLQQLEASYACQEKELLKVMKEYAFVTQLCEDQALYIKKYQETLKKIEEELEALFLEREVSKLVSMNPVEKEHTSQNNEGTPTQKTARLFSKNWHHSF

SEQ ID NO: 15024 - protein, 81 aa, Artificial Sequence
  Description of Artificial Sequence: Synthetic coding sequence
MEISRLAQSKRNIISLNMDLERDTQRIDEANQKLLLKIQEREDKIQRLESEIIQTRGLVEDEEWEKENRTTMERERALQEL

SEQ ID NO: 15025 - protein, 144 aa, Artificial Sequence
  Description of Artificial Sequence: Synthetic coding sequence
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKLTRKSQKITNCEQSSPDGALEETKVKLQQLEASYACQEK

SEQ ID NO: 15026 - protein, 228 aa, Artificial Sequence
  Description of Artificial Sequence: Synthetic coding sequence
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKLTRKSQKITNCEQSSPDGALEETKVKLQQLEASYACQEKELLKVMKEYAFVTQLCEDQALYIKKYQETLKKIEEELEALFLEREVSKLVSMNPVEKEHTSQNNEGTPTQKTARLFSKKWASSF

SEQ ID NO: 15027 - protein, 71 aa, Artificial Sequence
  Description of Artificial Sequence: Synthetic coding sequence
MEISRLAQSKRNIISLNMDLERDTQRIDEANQKLLLKIQEREDKIQRLESEIIQTRGLVEDEEWEKENRTT

SEQ ID NO: 15028 - protein, 1094 aa, Artificial Sequence
  Description of Artificial Sequence: Synthetic coding sequence
MAARQAVGSGAQETCGLDRILEALKLLLSPGGSGSSSLQVTKHDVLLATLKSNLSALEDKFLKDPQWKNLKLLRDEIADKAEWPQNSVDVTWSFTSQTLLLLLCLKETMIRLAANFNPGKPNPRTPEVAPALSPDALSISQQKTVQFVLQFVVTLGICPYLMPGVGVPLRYRTEFGAVVQDVVCFDAAPDATRRLYTSCKALLNVAQHTSLGSLIFCHHFGDIAAGLCQLGFCPTKRKLLTPAEEVLTEEERTLSRGALRDMLDQVYQPLAVRELLILQGGPPQSCTDVKTQMRCRAPAWLRRLCGQLLSERLMRPNGVQAVVRGILEGAGAGAAGGSDAEVTAADWKKCDLIAKILASCPQQSLSPENYYRDICPQVLDLFHFQDKLTARQFQRVATTTFITLSRERPHLAAKYLLQPVLAPLHRCLNTAELSESDMVPGTILVTEEELSRCIEDVFKVYVVGNEPLTVLMDSLLPVLGVLFLLYCFTKQSVSHIRSLCQEILLWILGKLERKKAIASLKGFAGLDKAVPSLHSLCQFRVATQGGIMITIKEAISDEDEDEALYQKVSSEQGRVEHLGDLLSHCQECGLAGDFFIFCLKELTHVASENETELKTEPFSSKSLLELEQHQTLLVEGQERKLLVLQLMAVLCERMSEQIFTNVTQVVDFVAATLQRACASLAHQAESTVESQTLSMSMGLVAVMLGGAVQLKSSDFAVLKQLLPLLEKVSNTYPDPVIQELAVDLRITISTHGAFATEAVSMAAQSTLNRKDLEGKIEEQQQTSHERPTDVAHSHLEQQQSHETAPQTGLQSNAPIIPQGVNEPSTTTSQKSGSVTTEQLQEVLLSAYDPQIPTRAAALRTLSHWIEQREAKALEMQEKLLKIFLENLEHEDTFVYLSAIQGVALLSDVYPEKILPDLLAQYDSSKDKHTPETRMKVGEVLMRIVRALGDMVSKYREPLIHTFLRGVRDPDGAHRASSLANLGELCQRLDFLLGSVVHEVTACLIAVAKTDGEVQVRRAAIHVVVLLLRGLSQKATEVLSAVLKDLYHLLKHVVCLEPDDVAKLHAQLALEELDDIMKNFLFPPQKLEKKIMVLP

SEQ ID NO: 15029 - protein, 262 aa, Artificial Sequence
  Description of Artificial Sequence: Synthetic coding sequence
MAWKSSVIMQMGRFLLLVILFLPREMTSSVLTVNGKTENYILDTTPGSQASLICAVQNHTREEELLWYREEGRVDLKSGNKINSSSVCVSSISENDNGISFTCRLGRDQSVSVSVVLNVTFPPLLSGNDFQTVEEGSNVKLVCNVKANPQAQMMWYKNSSLLDLEKSRHQIQQTSESFQLSITKVEKPDNGTYSCIAKSSLKTESLDFHLIVKDKTVGVPIEPIIAACVVIFLTLCFGLIARRKKIMKLCMKDKDPHSETAL

SEQ ID NO: 15030 - protein, 218 aa, Artificial Sequence
  Description of Artificial Sequence: Synthetic coding sequence
MAWKSSVIMQMGRFLLLVILFLPREMTSSVLTVNGKTENYILDTTPGSQASLICAVQNHTREEELLWYREEGRVDLKSGNKINSSSVCVSSISENDNGISFTCRLGRDQSVSVSVVLNVTFPPLLSGNDFQTVEEGSNVKLVCNVKANPQAQMMWYKNSSLLDLEKSRHQIQQTSESFQLSITKVEKPDNGTYSCIAKSSLKTESLDFHLIVKALQQG

SEQ ID NO: 15031 - protein, 282 aa, Artificial Sequence
  Description of Artificial Sequence: Synthetic coding sequence
MGSPGMVLGLLVQIWALQEASSLSVQQGPNLLQVRQGSQATLVCQVDQATAWERLRVKWTKDGAILCQPYITNGSLSLGVCGPQGRLSWQAPSHLTLQLDPVSLNHSGAYVCWAAVEIPELEEAEGNITRLFVDPDDPTQNRNRIASFPGFLFVLLGVGSMGVAAIVWGAWFWGRRSCQQRDSGNSPGNAFYSNVLYRPRGAPKKSEDCSGEGKDQRGQSIYSTSFPQPAPRQPHLASRPCPSPRPCPSPRPGHPVSMVRVSPRPSPTQQPRPKGFPKVGEE

SEQ ID NO: 15032 - protein, 774 aa, Artificial Sequence
  Description of Artificial Sequence: Synthetic coding sequence
MNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 15033 - protein, 574 aa, Artificial Sequence
  Description of Artificial Sequence: Synthetic coding sequence
MNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRYLRASSNRNFLLTMRPFLKRAILVLSYVLVILYFRLWIMGGSMPLFSEQDNPASFSPYILTRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQVIVSHSSFFQCYCYMYKLMLHRFLY

SEQ ID NO: 15034 - protein, 882 aa, Artificial Sequence
  Description of Artificial Sequence: Synthetic coding sequence
MVVTTSARGGGGDRTPSRRRGCGLAPAGAAALLAGASCLCYGRSLQGEFVHDDVWAIVNNPDVRPGAPLRWGIFTNDFWGKGMAENTSHKSYRPLCVLTFKLNIFLTGMNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 15035 - protein, 645 aa, Artificial Sequence
  Description of Artificial Sequence: Synthetic coding sequence
VTERDSVSKKKKKRYLRASSNRNFLLTMRPFLKRAILVLSYVLVILYFRLWIMGGSMPLFSEQDNPASFSPYILTRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 15036 - protein, 944 aa, Artificial Sequence
  Description of Artificial Sequence: Synthetic coding sequence
MVVTTSARGGGGDRTPSRRRGCGLAPAGAAALLAGASCLCYGRSLQGEFVHDDVWAIVNNPDVRPGAPLRWGIFTNDFWGKGMAENTSHKSYRPLCVLTFKLNIFLTGMNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRYLRASSNRNFLLTMRPFLKRAILVLSYVLVILYFRLWIMGGSMPLFSEQDNPASFSPYILTRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 15037 - protein, 836 aa, Artificial Sequence
  Description of Artificial Sequence: Synthetic coding sequence
MIAELVSSALGLALYLNTLSADFCYDDSRAIKTNQDLLPETPWTHIFYNDFWGTLLTHSGSHKSYRPLCTLSFRLNHAIGGLNPWSYHLVNVLLHAAVTGLFTSFSKILLGDGYWTFMAGLMFASHPIHTEAVAGIVGRADVGASLFFLLSLLCYIKHCSTRGYSARTWGWFLGSGLCAGCSMLWKEQGVTVLAVSAVYDVFVFHRLKIKQILPTIYKRKNLSLFLSISLLIFWGSSLLGARLYWMGNKPPSFSNSDNPAADSDSLLTRTLTFFYLPTKNLWLLLCPDTLSFDWSMDAVPLLKTVCDWRNLHTVAFYTGLLLLAYYGLKSPSVDRECNGKTVTNGKQNANGHSCLSDVEYQNSETKSSFASKVENGIKNDVSQRTQLPSTENIVVLSLSLLIIPFVPATNLFFYVGFVIAERVLYIPSMGFCLLITVGARALYVKVQKRFLKSLIFYATATLIVFYGLKTAIRNGDWQNEEMLYRSGIKVNPAKAWGNLGNVLKSQSKISEAESAYRNALYYRSNMADMLYNLGLLLQENSRFAEALHYYKLAIGSRPTLASAYLNTGIILMNQGRTEEARRTFLKCSEIPDENLKDPHAHKSSVTSCLYNLGKLYHEQGHYEEALSVYKEAIQKMPRQFAPQSLYNMMGEAYMRLSKLPEAEHWYMESLRSKTDHIPAHLTYGKLLALTGRKSEAEKLFLKAIELDPTKGNCYMHYGQFLLEEARLIEAAEMAKKAAELDSTEFDVVFNAAHMLRQASLNEAAEKYYDLAARLRPNYPAALMNLGAILHLNGRLQKAEANYLRALQLKPDDVITQSNLRKLWNIMEKQGLKTSKT

SEQ ID NO: 15038 - protein, 914 aa, Artificial Sequence
  Description of Artificial Sequence: Synthetic coding sequence
MANINLKEITLIVGVVTACYWNSLFCGFVFDDVSAILDNKDLHPSTPLKTLFQNDFWGTPMSEERSHKSYRPLTVLTFRLNYLLSELKPMSYHLLNMIFHAVVSVIFLKVCKLFLDNKSSVIASLLFAVHPIHTEAVTGVVGRAELLSSIFFLAAFLSYTRSKGPDNSIIWTPIALTVFLVAVATLCKEQGITVVGICCVYEVFIAQGYTLPLLCTTAGQFLRGKGSIPFSMLQTLVKLIVLMFSTLLLVVIRVQVIQSQLPVFTRFDNPAAVSPTPTRQLTFNYLLPVNAWLLLNPSELCCDWTMGTIPLIESLLDIRNLATFTFFCFLGMLGVFSIRYSGDSSKTVLMALCLMALPFIPASNLFFPVGFVVAERVLYVPSMGFCILVAHGWQKISTKSVFKKLSWICLSMVILTHSLKTFHRNWDWESEYTLFMSALKVNKNNAKLWNNVGHALENEKNFERALKYFLQATHVQPDDIGAHMNVGRTYKNLNRTKEAEESYMMAKSLMPQIIPGKKYAARIAPNHLNVYINLANLIRANESRLEEADQLYRQAISMRPDFKQAYISRGELLLKMNKPLKAKEAYLKALELDRNNADLWYNLAIVHIELKEPNEALKNFNRALELNPKHKLALFNSAIVMQESGEVKLRPEARKRLLSYINEEPLDANGYFNLGMLAMDDKKDNEAEIWMKKAIKLQADFRSALFNLALLYSQTAKELKALPILEELLRYYPDHIKGLILKGDILMNQKKDILGAKKCFERILEMDPSNVQGKHNLCVVYFEEKDLLKAERCLLETLALAPHEEYIQRHLNIVRDKISSSSFIEPIFPTSKISSVEGKKIPTESVKEIRGESRQTQIVKTSDNKSQSKSNKQLGKNGDEETPHKTTKDIKEIEKKRVAALKRLEEIERILNGE

SEQ ID NO: 15039 - protein, 148 aa, Artificial Sequence
  Description of Artificial Sequence: Synthetic coding sequence
MANINLKEITLIVGVVTACYWNSLFCGFVFDDVSAILDNKDLHPSTPLKTLFQNDFWGTPMSEERSHKSYRPLTVLTFRLNYLLSELKPMSYHLLNMIFHAVVSVIFLKVCKLFLDNKSSVIASLLFAVHPIHTEAVTGVVGRAELLS

SEQ ID NO: 15040 - protein, 630 aa, Artificial Sequence
  Description of Artificial Sequence: Synthetic coding sequence
MAVLDTDLDHILPSSVLPPFWAKLVVGSVAIVCFARSYDGDFVFDDSEAIVNNKVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 15041 - protein, 760 aa, Artificial Sequence
  Description of Artificial Sequence: Synthetic coding sequence
MIPNQHNAGAGSHQPAVFRMAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 15042 - protein, 741 aa, Artificial Sequence
  Description of Artificial Sequence: Synthetic coding sequence
MAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 15043 - protein, 54 aa, Artificial Sequence
  Description of Artificial Sequence: Synthetic coding sequence
MAVLDTDLDHILPSSVLPPFWAKLVVGSVAIVCFARSYDGDFVFDDSEAIVNNK

SEQ ID NO: 15044 - protein, 73 aa, Artificial Sequence
  Description of Artificial Sequence: Synthetic coding sequence
MIPNQHNAGAGSHQPAVFRMAVLDTDLDHILPSSVLPPFWAKLVVGSVAIVCFARSYDGDFVFDDSEAIVNNK

SEQ ID NO: 15045 - protein, 246 aa, Artificial Sequence
  Description of Artificial Sequence: Synthetic coding sequence
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDDTQTLGSLHLPPNCVLHCHVSTRVGPPNPPCPPGSEPGPSGLEIGSLLLPLLLLLLLLLWYCQIQYRPFFPLTATLGLAGFTLLLSLLAFAMYRP

SEQ ID NO: 15046 - protein, 246 aa, Artificial Sequence; identical to SEQ ID NO: 15045
  Description of Artificial Sequence: Synthetic coding sequence

SEQ ID NO: 15047 - protein, 246 aa, Artificial Sequence; identical to SEQ ID NO: 15045
  Description of Artificial Sequence: Synthetic coding sequence

SEQ ID NO: 15048 - protein, 246 aa, Artificial Sequence; identical to SEQ ID NO: 15045
  Description of Artificial Sequence: Synthetic coding sequence

SEQ ID NO: 15049 - protein, 246 aa, Artificial Sequence; identical to SEQ ID NO: 15045
  Description of Artificial Sequence: Synthetic coding sequence

SEQ ID NO: 15050 - protein, 171 aa, Artificial Sequence
  Description of Artificial Sequence: Synthetic coding sequence
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDDTQTLGSLHLPPNCVLHCHV

SEQ ID NO: 15051 - protein, 152 aa, Artificial Sequence
  Description of Artificial Sequence: Synthetic coding sequence
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDD

SEQ ID NO: 15052 - protein, 301 aa, Artificial Sequence
  Description of Artificial Sequence: Synthetic coding sequence
MELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 15053 - protein, 301 aa, Artificial Sequence; identical to SEQ ID NO: 15052
  Description of Artificial Sequence: Synthetic coding sequence

SEQ ID NO: 15054 - protein, 264 aa, Artificial Sequence
  Description of Artificial Sequence: Synthetic coding sequence
MELSDVTLIEGVGNEVMVVAGVVVLILALVLAWLSTYVADSGSNQLLGAIVSAGDTSVLHLGHVDHLVAGQGNPEPTELPHPSEGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 15055 - protein, 321 aa, Artificial Sequence
  Description of Artificial Sequence: Synthetic coding sequence
MISRHLQNNLMSVDPASSQAMELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 15056 - protein, 311 aa, Artificial Sequence
  Description of Artificial Sequence: Synthetic coding sequence
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIILLTLFTFAMGFMTGTISSMYQTKAVIIAMIITAVVSISVTIFCFQTKVDFTSCTGLFCVLGIVLLVTGIVTSIVLYFQYVYWLHMLYAALGAICFTLFLAYDTQLVLGNRKHTISPEDYITGALQIYTDIIYIFTFVLQLMGDRN

SEQ ID NO: 15057 - protein, 311 aa, Artificial Sequence; identical to SEQ ID NO: 15056
  Description of Artificial Sequence: Synthetic coding sequence

SEQ ID NO: 15058 - protein, 46 aa, Artificial Sequence
  Description of Artificial Sequence: Synthetic coding sequence
MSNPSAPPPYEDRNPLYPGPPPPGGYGQPSVLPGGYPAYPGYPQPG

SEQ ID NO: 15059 - protein, 151 aa, Artificial Sequence
  Description of Artificial Sequence: Synthetic coding sequence
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLIL

SEQ ID NO: 15060 - protein, 8 aa, Artificial Sequence
  Description of Artificial Sequence: Synthetic coding sequence
MSNPSAPP

SEQ ID NO: 15061 - protein, 167 aa, Artificial Sequence
  Description of Artificial Sequence: Synthetic coding sequence
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIIL

SEQ ID NO: 15062 - protein, 171 aa, Artificial Sequence
  Description of Artificial Sequence: Synthetic coding sequence
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIILLTLF

SEQ ID NO: 15063 - protein, 68 aa, Artificial Sequence
  Description of Artificial Sequence: Synthetic coding sequence
MSNPSAPPPYEDRNPLYPGPPPPGGYGQPSVLPGGYPAYPGYPQPGYGHPAGYPQPMPPTHPMPMNYG

SEQ ID NO: 15064 - protein, 215 aa, Artificial Sequence
  Description of Artificial Sequence: Synthetic coding sequence
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKGTCQRLCEEKCGCLLRVLCCLRCHLPDPCLLPGTQTPFPMEHHSADPFYFCHGLHDGHHFQYVPNQSRHHCNDHHCGGIHFSHHLLLSDQGGLHLVHRPLLCPGNCAPGDWDCH

SEQ ID NO: 15065 - protein, 107 aa, Artificial Sequence
  Description of Artificial Sequence: Synthetic coding sequence
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIIS

SEQ ID NO: 15066 - protein, 90 aa, Artificial Sequence
  Description of Artificial Sequence: Synthetic coding sequence
MSNPSAPPPYEDRNPLYPGPPPPGGYGQPSVLPGGYPAYPGYPQPGYGHPAGYPQPMPPTHPMPMNYGPGHGYDGEERAVSDSFGPGEWD

SEQ ID NO: 15067 - protein, 106 aa, Artificial Sequence
  Description of Artificial Sequence: Synthetic coding sequence
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSII

SEQ ID NO: 15068 - protein, 311 aa, Artificial Sequence; identical to SEQ ID NO: 15056
  Description of Artificial Sequence: Synthetic coding sequence

SEQ ID NO: 15069 - protein, 137 aa, Artificial Sequence
  Description of Artificial Sequence: Synthetic coding sequence
MGFMTGTISSMYQTKAVIIAMIITAVVSISVTIFCFQTKVDFTSCTGLFCVLGIVLLVTGIVTSIVLYFQYVYWLHMLYAALGAICFTLFLAYDTQLVLGNRKHTISPEDYITGALQIYTDIIYIFTFVLQLMGDRN

SEQ ID NO: 15070 - protein, 73 aa, Artificial Sequence
  Description of Artificial Sequence: Synthetic coding sequence
MSNPSAPPPYEDRNPLYPGPPPPGGYGQPSVLPGGYPAYPGYPQPGYGHPAGYPQPMPPTHPMPMNYGPGHGY

SEQ ID NO: 15071 - protein, 84 aa, Artificial Sequence
  Description of Artificial Sequence: Synthetic coding sequence
MSNPSAPPPYEDRNPLYPGPPPPGGYGQPSVLPGGYPAYPGYPQPGYGHPAGYPQPMPPTHPMPMNYGPGHGYDGEERAVSDSF

SEQ ID NO: 15072 - protein, 92 aa, Artificial Sequence
  Description of Artificial Sequence: Synthetic coding sequence
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDR

SEQ ID NO: 15073 - protein, 249 aa, Artificial Sequence
  Description of Artificial Sequence: Synthetic coding sequence
MPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIILLTLFTFAMGFMTGTISSMYQTKAVIIAMIITAVVSISVTIFCFQTKVDFTSCTGLFCVLGIVLLVTGIVTSIVLYFQYVYWLHMLYAALGAICFTLFLAYDTQLVLGNRKHTISPEDYITGALQIYTDIIYIFTFVLQLMGDRN

SEQ ID NO: 15074 - protein, 238 aa, Artificial Sequence
  Description of Artificial Sequence: Synthetic coding sequence
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 15075 - protein, 211 aa, Artificial Sequence
  Description of Artificial Sequence: Synthetic coding sequence
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGQSALLVDIVPVRILEVFFYSEIMELVLAAAGALLFCGFIIYDTHSLMHKLSPKSTY

SEQ ID NO: 15076 - protein, 283 aa, Artificial Sequence
  Description of Artificial Sequence: Synthetic coding sequence
MADRPPVPSLSIEDDFNYGSSVASATVHIRMVLQRDCTFSKQYMRIPSAPSATLNIIRFFHLRQSGRSGMVNIFYKGPTFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILCLSGLEVFFYSEIMELVLAAAGALLFCGFIIYDTHSLMHKLSPEEYVLAAISLYLDIINLFLHLLRFLEAVNKK

SEQ ID NO: 15077 - protein, 168 aa, Artificial Sequence
  Description of Artificial Sequence: Synthetic coding sequence
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGRCRSPSFLWIHHL

SEQ ID NO: 15078 - protein, 237 aa, Artificial Sequence
  Description of Artificial Sequence: Synthetic coding sequence
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTQLIIEKAEHGDQDYIWHCIDLFLDFITVFRKLMMILAMNEKDKKKEKK

SEQ ID NO: 15079 - protein, 237 aa, Artificial Sequence; identical to SEQ ID NO: 15078
  Description of Artificial Sequence: Synthetic coding sequence

SEQ ID NO: 15080 - protein, 295 aa, Artificial Sequence
  Description of Artificial Sequence: Synthetic coding sequence
MSHSSVTREAPQLLSQRQRREVRGVWGWGCLPGPRGGPALFGLVTFGQSGDCCTDSGTMNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTQLIIEKAEHGDQDYIWHCIDLFLDFITVFRKLMMILAMNEKDKKKEKK

SEQ ID NO: 15081 - protein, 126 aa, Artificial Sequence [sequence omitted]

SEQ ID NO: 15082 - protein, 237 aa, Artificial Sequence; identical to SEQ ID NO: 15078
  Description of Artificial Sequence: Synthetic coding sequence

SEQ ID NO: 15083 - protein, 145 aa, Artificial Sequence
  Description of Artificial Sequence: Synthetic coding sequence
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGG

SEQ ID NO: 15084 - protein, 96 aa, Artificial Sequence
  Description of Artificial Sequence: Synthetic coding sequence
MNIFDRKINFDALLKFSHITPSTQQHLKKVYASFALCMFVAAAGAYVHMVTHFIQAGLLSALGSLILMIWLMATPHSHETEQKRLGLLAGFAFLTG

SEQ ID NO: 15085 - protein, 96 aa, Artificial Sequence; identical to SEQ ID NO: 15084
  Description of Artificial Sequence: Synthetic coding sequence

SEQ ID NO: 15086 - protein, 138 aa, Artificial Sequence
  Description of Artificial Sequence: Synthetic coding sequence
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRR

SEQ ID NO: 15087 - protein, 130 aa, Artificial Sequence
  Description of Artificial Sequence: Synthetic coding sequence
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTL

SEQ ID NO: 15088 - protein, 10 aa, Artificial Sequence
  Description of Artificial Sequence: Synthetic coding sequence
MNIFDRKINF

SEQ ID NO: 15089 - protein, 11 aa, Artificial Sequence
  Description of Artificial Sequence: Synthetic coding sequence
MNIFDRKINFD

SEQ ID NO: 15090 - protein, 16 aa, Artificial Sequence
  Description of Artificial Sequence: Synthetic coding sequence
MNIFDRKINFDALLKF

SEQ ID NO: 15091 - protein, 89 aa, Artificial Sequence
  Description of Artificial Sequence: Synthetic coding sequence
MNIFDRKINFDALLKFSHITPSTQQHLKKVYASFALCMFVAAAGAYVHMVTHFIQAGLLSALGSLILMIWLMATPHSHETEQKRLGLLA

SEQ ID NO: 15092 - protein, 237 aa, Artificial Sequence; identical to SEQ ID NO: 15078
  Description of Artificial Sequence: Synthetic coding sequence

SEQ ID NO: 15093 - protein, 96 aa, Artificial Sequence; identical to SEQ ID NO: 15084
  Description of Artificial Sequence: Synthetic coding sequence

SEQ ID NO: 15094 - protein, 108 aa, Artificial Sequence
  Description of Artificial Sequence: Synthetic coding sequence
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIA

SEQ ID NO: 15095 - protein, 145 aa, Artificial Sequence; identical to SEQ ID NO: 15083
  Description of Artificial Sequence: Synthetic coding sequence

SEQ ID NO: 15096 - protein, 44 aa, Artificial Sequence
  Description of Artificial Sequence: Synthetic coding sequence
MNIFDRKINFDALLKFSHITPSTQQHLKKVYASFALCMFVAAAG

SEQ ID NO: 15097 - protein, 41 aa, Artificial Sequence
  Description of Artificial Sequence: Synthetic coding sequence
MNIFDRKINFDALLKFSHITPSTQQHLKKVYASFALCMFVA

SEQ ID NO: 15098 - protein, 205 aa, Artificial Sequence
  Description of Artificial Sequence: Synthetic coding sequence
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTQLIIEKAEHGDQDYIW

SEQ ID NO: 15099 - protein, 295 aa, Artificial Sequence; identical to SEQ ID NO: 15080
  Description of Artificial Sequence: Synthetic coding sequence

SEQ ID NO: 15100 - protein, 1100 aa, Artificial Sequence
  Description of Artificial Sequence: Synthetic coding sequence
MKTSKASQRYRGIRRNASQCYLYQESLLLSNLDDSFSADETGDSNDPEQIFQNIQFQKDLMANIRCRPWTMGQKLRALRQAKNIVLKFEGRLTRTRGYQAAGAELWRKFARLACNFVVIFIPWEMRIKKIESHFGSGVASYFIFLRWLFGINIVLTIMTGAFIVIPELIAGQPFGSTARKTIPKEQVSSAQDLDTVWSLGGYLQYSVLFYGYYGRERKIGRAGYRLPLAYFLVGMAVFAYSFIILLKKMAKNSRTSLASASNENYTFCWRVFCAWDYLIGNPEAAESKTAAIVNSIREAILEEQEKKKSKNLAVTICLRIIANILVLLSLAGSIYLIYFVVDRSQKLEQSKKELTLWEKNEVSVVVSLVTMIAPSAFDLIAALEMYHPRTTLRFQLARVLVLYLGNLYSLIIALLDKVNSMSIEEMATKNNTSHWIDSTTFFATRTAPEEEKWSTSRPGMGLRRNNTWALEETSISAYTMPLIKANKTSLHTQSPQDQCWETYVGQEMLKLSIIDMLFTVASILLIDFFRGLFVRYLSDYWCWDLESKFPEYGEFKIAENVLHLVYNQGMIWMGAFFSPCLPAFNVLKLIGLMYLRSWAVLTCNVPHQQVFRASRSNNFYLAMLLFMLFLCMLPTIFAIVRYKPSLNCGPFSGQEKIYDIVSETIEKDFPVWFGSVVGHISSPVVILPAVLLLFMLIYYLQSIARSLKLSNHQLKMQIQNARSEDKKKVAQMVEARIQTQEESTKKLPNDSDLTSQLSSAHSGTPQNNGNVAHFDSGSSKSGRIETVAQSMPQSPRPGDRAPSSPLPGVPKSRLEHETNRYLHGLCASTSDLHRNRSRTPMTFTTHIEDVHSEPLFRKDFQQINPPHRGPQASTLLAQGPRPHAPRYYVINECDSYKKKHLNVWPERHFKIDASGDIVELYPRNVRQYASRVPRQPPSPQLSEEEEETPSRDWIKRSLPPRSLIDLRRAPHFYIGERSESQTRDPEHQGRVHYKSWNEDFEGHLERPAYVPRKPRSRNFQYPQPPLKPRGKPRFEPSLTESDSVSAASSSDQQNSSADQYLQVTHSQGRFPRSVGQPSRRKAKSGQELTVDLDDLICSDV

SEQ ID NO: 15101 - protein, 1101 aa, Artificial Sequence
  Description of Artificial Sequence: Synthetic coding sequence
MKTSKASQRYRGIRRNASQCYLYQESLLLSNLDDSFSADETGDSNDPEQIFQNIQFQKDLMANIRCRPWTMGQKLRALRQAKNIVLKFEGRLTRTRGYQAAGAELWRKFARLACNFVVIFIPWEMRIKKIESHFGSGVASYFIFLRWLFGINIVLTIMTGAFIVIPELIAGQPFGSTARKTIPKEQVSSAQDLDTVWSLGGYLQYSVLFYGYYGRERKIGRAGYRLPLAYFLVGMAVFAYSFIILLKKMAKNSRTSLASASNENYTFCWRVFCAWDYLIGNPEAAESKTAAIVNSIREAILEEQEKKKSKNLAVTICLRIIANILVLLSLAGSIYLIYFVVDRSQKLEQSKKELTLWEKNEQVSVVVSLVTMIAPSAFDLIAALEMYHPRTTLRFQLARVLVLYLGNLYSLIIALLDKVNSMSIEEMATKNNTSHWIDSTTFFATRTAPEEEKWSTSRPGMGLRRNNTWALEETSISAYTMPLIKANKTSLHTQSPQDQCWETYVGQEMLKLSIIDMLFTVASILLIDFFRGLFVRYLSDYWCWDLESKFPEYGEFKIAENVLHLVYNQGMIWMGAFFSPCLPAFNVLKLIGLMYLRSWAVLTCNVPHQQVFRASRSNNFYLAMLLFMLFLCMLPTIFAIVRYKPSLNCGPFSGQEKIYDIVSETIEKDFPVWFGSVVGHISSPVVILPAVLLLFMLIYYLQSIARSLKLSNHQLKMQIQNARSEDKKKVAQMVEARIQTQEESTKKLPNDSDLTSQLSSAHSGTPQNNGNVAHFDSGSSKSGRIETVAQSMPQSPRPGDRAPSSPLPGVPKSRLEHETNRYLHGLCASTSDLHRNRSRTPMTFTTHIEDVHSEPLFRKDFQQINPPHRGPQASTLLAQGPRPHAPRYYVINECDSYKKKHLNVWPERHFKIDASGDIVELYPRNVRQYASRVPRQPPSPQLSEEEEETPSRDWIKRSLPPRSLIDLRRAPHFYIGERSESQTRDPEHQGRVHYKSWNEDFEGHLERPAYVPRKPRSRNFQYPQPPLKPRGKPRFEPSLTESDSVSAASSSDQQNSSADQYLQVTHSQGRFPRSVGQPSRRKAKSGQELTVDLDDLICSDV

SEQ ID NO: 15102 - protein, 706 aa, Artificial Sequence
  Description of Artificial Sequence: Synthetic coding sequence
MEENPTLESEAWGSSRGWLAPREARGGPSLSSVLNELPSAATLRYRDPGVLPWGALEEEEEDGGRSRKAFTEVTQTELQDPHPSRELPWPMQARRAHRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRQTEAQNKVFLARRAVALTSTKPAL

SEQ ID NO: 15103 - protein, 712 aa, Artificial Sequence
  Description of Artificial Sequence: Synthetic coding sequence
MEENPTLESEAWGSSRGWLAPREARGAPCSSPGPSLSSVLNELPSAATLRYRDPGVLPWGALEEEEEDGGRSRKAFTEVTQTELQDPHPSRELPWPMQARRAHRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRQTEAQNKVFLARRAVALTSTKPAL

SEQ ID NO: 15104 - protein, 294 aa, Artificial Sequence
  Description of Artificial Sequence: Synthetic coding sequence
MKGGGGQRDVGADRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRQTEAQNKVFLARRAVALTSTKPAL

SEQ ID NO: 15105 - protein, 760 aa, Artificial Sequence
  Description of Artificial Sequence: Synthetic coding sequence
MLSDDHVNEIIIQVENVSSGVQSHPSSNQIFQEKVLLDSSINMVLSISDIDVIDSQTVSKRNDQKGNQVLRFSTSLNESMSQTLHSLECMGIDTPGSSHETVQGQKLIASLIPMTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHGNSGASYNMQLAYIFTIGACLTTCFFSLLFSMAKYFRNNFINPHIYSGGITKLIFCWDFTVTHEKAVKLKQKNLSTEIRENLSELRQENSKLTFNQLLTRFSAYMVAWVVSTGVAIACCAAVYYLAEYNLEFLKTHSNPGAVLLLPFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 15106 - protein, 948 aa, Artificial Sequence
  Description of Artificial Sequence: Synthetic coding sequence
MSAYYRNNWSEEDPDYPDYSGSQNRTQGYLKTQGYPDVPGPLNNPDYPGTRSNPYSVASRTRPDYPGSLAEPNYPRSLSNPDYSGTRSNAYSAASRTSPDHPTSLPEPDYSEFQSHPYHRASSRQPDYPGSQRNPDFAGSSSSGNYAGSRTHPDHFGSLEPDYPGAQSNSDHPGPRANLNHPGSRKNLEHTSFRINPYADSLGKPDYPGADIQPNSPPFFGEPDYPSAEDNQNLPSTWREPDYSDAENGHDYGSSETPKMTRGVLSRTSSIQPSFRHRSDDPVGSLWGENDYPEGIEMASMEMANSYGHSLPGAPGSGYVNPAYVGESGPVHAYGNPPLSECDWHKSPQGQKLIASLIPMTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHGNSGASYNMQLAYIFTIGACLTTCFFSLLFSMAKYFRNNFINPHIYSGGITKLIFCWDFTVTHEKAVKLKQKNLSTEIRENLSELRQENSKLTFNQLLTRFSAYMVAWVVSTGVAIACCAAVYYLAEYNLEFLKTHSNPGAVLLLPFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 15107 - protein, 1006 aa, Artificial Sequence
  Description of Artificial Sequence: Synthetic coding sequence
MSAYYRNNWSEEDPDYPDYSGSQNRTQGYLKTQGYPDVPGPLNNPDYPGTRSNPYSVASRTRPDYPGSLAEPNYPRSLSNPDYSGTRSNAYSAASRTSPDHPTSLPEPDYSEFQSHPYHRASSRQPDYPGSQRNPDFAGSSSSGNYAGSRTHPDHFGSLEPDYPGAQSNSDHPGPRANLNHPGSRKNLEHTSFRINPYADSLGKPDYPGADIQPNSPPFFGEPDYPSAEDNQNLPSTWREPDYSDAENGHDYGSSETPKMTRGVLSRTSSIQPSFRHRSDDPVGSLWGENDYPEGIEMASMEMANSYGHSLPGAPGSGYVNPAYVGESGPVHAYGNPPLSECDWHKSPQGQKLIASLIPMTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHGNSGASYNMQLAYIFTIGACLTTCFFSLLFSMAKYFRNNFINPHIYSGGITKLIFCWDFTVTHEKAVKLKQKNLSTEIRENLSELRQENSKLTFNQLLTRFSAYMVAWVVSTGVAIACCAAVYYLAEYNLEFLKTHSNPGAVLLLPFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 15108 - protein, 700 aa, Artificial Sequence
  Description of Artificial Sequence: Synthetic coding sequence
MLSDDHVNEIIIQKLIASLIPMTSRDRIKAIRNQPRTMEEKRNLSRGGLTITTEDEGRAKAHLTWWKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHGNSGASYNMQLAYIFTIGACLTTCFFSLLFSMAKYFRNNFINPHIYSGGITKLIFCWDFTVTHEKAVKLKQKNLSTEIRENLSELRQENSKLTFNQLLTRFSAYMVAWVVSTGVAIACCAAVYYLAEYNLEFLKTHSNPGAVLLLPFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFCIWGNMMAVLTCDLEDQFKKVIQGPDDSFGNQTPIK

SEQ ID NO: 15109 - protein, 954 aa, Artificial Sequence
  Description of Artificial Sequence: Synthetic coding sequence
MSAYYRNNWSEEDPDYPDYSGSQNRTQGYLKTQGYPDVPGPLNNPDYPGTRSNPYSVASRTRPDYPGSLAEPNYPRSLSNPDYSGTRSNAYSAASRTSPDHPTSLPEPDYSEFQSHPYHRASSRQPDYPGSQRNPDFAGSSSSGNYAGSRTHPDHFGSLEPDYPGAQSNSDHPGPRANLNHPGSRKNLEHTSFRINPYADSLGKPDYPGADIQPNSPPFFGEPDYPSAEDNQNLPSTWREPDYSDAENGHDYGSSETPKMTRGVLSRTSSIQPSFRHRSDDPVGSLWGENDYPEGIEMASMEMANSYGHSLPGAPGSGYVNPAYVGESGPVHAYGNPPLSECDWHKSPQGQKLIASLIPMTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHGNSGASYNMQLAYIFTIGACLTTCFFSLLFSMAKYFRNNFINPHIYSGGITKLIFCWDFTVTHEKAVKLKQKNLSTEIRFLKTHSNPGAVLLLPFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 15110 - protein, 1006 aa, Artificial Sequence; identical to SEQ ID NO: 15107
  Description of Artificial Sequence: Synthetic coding sequence

SEQ ID NO: 15111 - protein, 723 aa, Artificial Sequence
  Description of Artificial Sequence: Synthetic coding sequence
MSESSGSALQPGRPSRQPAVHPENLSLDSSCFSSPPVNFLQELPSYRSIARRRTTVHSRDKQSGTLLKPTDSYSSQLEDRIAENLSSHSLRNYALNISEKRRLRDIQETQMKYLSEWDQWKRYSSKSWKRFLEKAREMTTHLELWREDIRSIEGKFGTGIQSYFSFLRFLVLLNLVIFLIIFMLVLLPVLLTKYKITNSSFVLIPFKDMDKQCTVYPVSSSGLIYFYSYIIDLLSGTGFLEETSLFYGHYTIDGVKFQNFTYDLPLAYLLSTIASLALSLLWIVKRSVEGFKINLIRSEEHFQSYCNKIFAGWDFCITNRSMADLKHSSLRYELRADLEEERMRQKIAERTSEETIRIYSLRLFLNCIVLAVLGACFYAIYVATVFSQEHMKKEIDKMVFGENLFILYLPSIVITLANFITPMIFAKIIRYEDYSPGFEIRLTILRCVFMRLATICVLVFTLGSKITSCDDDTCDLCGYNQKLYPCWETQVGQEMYKLMIFDFIIILAVTLFVDFPRKLLVTYCSSCKLIQCWGQQEFAIPDNVLGIVYGQTICWIGAFFSPLLPAIATLKFIIIFYVKEWSLLYTCRPSPRPFRASNSNFFFLLVLLIGLCLAIIPLTISISRIPSSKACGPFTNFNTTWEVIPKTVSTFPSSLQSFIHGVTSEAFAVPFFMIICLIMFYFIALAGAHKRVVIQLREQLSLESRDKCYLIQKLTEAQRDMRN

SEQ ID NO: 15112 - protein, 613 aa, Artificial Sequence
  Description of Artificial Sequence: Synthetic coding sequence
MKYLSEWDQWKRYSSKSWKRFLEKAREMTTHLELWREDIRSIEGKFGTGIQSYFSFLRFLVLLNLVIFLIIFMLVLLPVLLTKYKITNSSFVLIPFKDMDKQCTVYPVSSSGLIYFYSYIIDLLSGTGFLEETSLFYGHYTIDGVKFQNFTYDLPLAYLLSTIASLALSLLWIVKRSVEGFKINLIRSEEHFQSYCNKIFAGWDFCITNRSMADLKHSSLRYELRADLEEERMRQKIAERTSEETIRIYSLRLFLNCIVLAVLGACFYAIYVATVFSQEHMKKEIDKMVFGENLFILYLPSIVITLANFITPMIFAKIIRYEDYSPGFEIRLTILRCVFMRLATICVLVFTLGSKITSCDDDTCDLCGYNQKLYPCWETQVGQEMYKLMIFDFIIILAVTLFVDFPRKLLVTYCSSCKLIQCWGQQEFAIPDNVLGIVYGQTICWIGAFFSPLLPAIATLKFIIIFYVKEWSLLYTCRPSPRPFRASNSNFFFLLVLLIGLCLAIIPLTISISRIPSSKACGPFTNFNTTWEVIPKTVSTFPSSLQSFIHGVTSEAFAVPFFMIICLIMFYFIALAGAHKRVVIQLREQLSLESRDKCYLIQKLTEAQRDMRN

SEQ ID NO: 15113 - protein, 201 aa, Artificial Sequence
  Description of Artificial Sequence: Synthetic coding sequence
MVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEAHQNKLEEMINELAVAMTAVKHEQEYMEVRERIHRAINDNTNSRVVLWSFFEALVLVAMTLGQIYYLKRFFEVRRVV

SEQ ID NO: 15114 - protein, 169 aa, Artificial Sequence
  Description of Artificial Sequence: Synthetic coding sequence
MVTLAELLVLLAALLATVSGYFVSIDVEITGPDNKGIYKGDRESSGKYTFAAHMDGTYKFCFSNRMSTMTPKIVMFTIDIGEAPKGQDMETEAHQNKLEEMINELAVAMTAVKHEQEYMEVRERIHRAINDNTNSRVVLWSFFEALVLVAMTLGQIYYLKRFFEVRRVV

SEQ ID NO: 15115 - protein, 151 aa, Artificial Sequence
  Description of Artificial Sequence: Synthetic coding sequence
MVTLAELLVLLAALLATVSGYFVSIDAHAEECFFERVTSGTKMGLIFEVAEGGFLDIDVEITGPDNKGQDMETEAHQNKLEEMINELAVAMTAVKHEQEYMEVRERIHRAINDNTNSRVVLWSFFEALVLVAMTLGQIYYLKRFFEVRRVV

SEQ ID NO: 15116 - protein, 217 aa, Artificial Sequence
  Description of Artificial Sequence: Synthetic coding sequence
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQMESACVTIHEALKTVIDSQTHYRLREAQDRARAEDLNSRVSYWSVGETIALFVVSFSQVLLLKSFFTEKRPISRAVHS

SEQ ID NO: 15117 - protein, 173 aa, Artificial Sequence
  Description of Artificial Sequence: Synthetic coding sequence
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQRFRGAYWKEVDKMVDYMQPGGTPATEGLGRLAPS

SEQ ID NO: 15118 - protein, 162 aa, Artificial Sequence
  Description of Artificial Sequence: Synthetic coding sequence
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILVSMVF

SEQ ID NO: 15119 - protein, 229 aa, Artificial Sequence
  Description of Artificial Sequence: Synthetic coding sequence
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILESINSIKSRLSKSGHIQTLLRAFEARDRNIQESNFDRVNFWSMVNLVVMVVVSAIQVYMLKSLFEDKRKSRT

SEQ ID NO: 15120 - protein, 193 aa, Artificial Sequence
  Description of Artificial Sequence: Synthetic coding sequence
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILDPIIKIASDVQIRLHLGIHQQHQVQTKQKWAHTNSA

SEQ ID NO: 15121 - protein, 178 aa, Artificial Sequence [sequence omitted]

SEQ ID NO: 15122 - protein, 240 aa, Artificial Sequence
  Description of Artificial Sequence: Synthetic coding sequence
MSPLLFGAGLVVLNLVTSARSQKTEPLSGSGDQPLFRGADRYDFAIMIPPGGTECFWQFAHQTGYFYFSYEVQRTVGMSHDRHVAATAHNPQGFLIDTSQGVRGQINFSTQETGFYQLCLSNQHNHFGSVQVYLNFGVFYEGPETDHKQKERKQLNDTLDAIEDGTQKVQNNIFHMWRYYNFARMRKMADFFLIQSNYNYVNWWSTAQSLVIILSGILQLYFLKRLFNVPTTTDTKKPRC

SEQ ID NO: 15123 - protein, 224 aa, Artificial Sequence
  Description of Artificial Sequence: Synthetic coding sequence
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWSVGEALILLVVSIGQVFLLKSFFSDKRTTTTRVGS

SEQ ID NO: 15124 - protein, 82 aa, Artificial Sequence
  Description of Artificial Sequence: Synthetic coding sequence
MPRPGSAQRWAAVAGRWGCRLLALLLLVPGPGGASEITFELPDNAKQCFYEDIAQGTKCTLEFQVITGGHYDVDCRLEDPDG

SEQ ID NO: 15125 - protein, 325 aa, Artificial Sequence
  Description of Artificial Sequence: Synthetic coding sequence
MSDLQAAEGPGSWSPTARPGSAGGVGDCQGVEGSQAAASENEDLENKDTSLLASATDPEPCSSPHRPQMVSPVSKDATEDLRKATGPLEAQALVKQDLLPADQAQVLNEMAKYQVPQRSGDIVMIQSEHTGAIDVLSADLESADLLGDHRKVSPPLMAPPCIWTFAKVKEFKSKLGKEKNSRLVVKRGEVVTIRVPTHPEGKRVCWEFATDDYDIGFGVYFDWTPVTSTDITVQVSDSSDDEDEEEEEEEEIEEPVPAGDVERGSRSSLRGRYGEVMPVYRRDSHRDVQAGSHDYPGEGIYLLKFDNSYSLLRNKTLYFHIYYTS

SEQ ID NO: 15126 - protein, 235 aa, Artificial Sequence
  Description of Artificial Sequence: Synthetic coding sequence
MAVELGVLLVRPRPGTGLGRVMRTLLLVLWLATRGSALYFHIGETEKKCFIEEIPDETMVIGNYRTQLYDKQREEYQPATPGLGMFVEVKDPEDKVILARQYGSEGRFTFTSHTPGEHQICLHSNSTKFSLFAGGMLRVHLDIQVGEHANDYAEIAAKDKLSELQLRVRQLVEQVEQIQKEQNYQRWREERFRQTSESTNQRVLWWSILQTLILVAIGVWQMRHLKSFFEAKKLV

SEQ ID NO: 15127 - protein, 273 aa, Artificial Sequence
  Description of Artificial Sequence: Synthetic coding sequence
MILKGCLLYPLCSPRNKQRCARLWKIAYGGLLKIVTGSLLTFYVVLCLDGGMVLMRKQVPSRFMYPKEWQHLTMFILLTLNGCVDFMSKNVLPQRCVGLEKGTLVLIIYELLLLMVSHVKDSEGVELHVYSLLILVVFLLLLVLTAELWAPNMCHLQLMETFLILMMGSWLMQAGFILYRPVSGYPWQDDDISDIMFVTTFFCWHVMINASFLLGIYGFSSFWYHCFRPSLKLTGPKEAPYYASTPGPLYKLLQEVEQSEKEDQALLLPKSSP

SEQ ID NO: 15128 - protein, 445 aa, Artificial Sequence
  Description of Artificial Sequence: Synthetic coding sequence
MNESPQTNEFKGTTEEAPAKESPHTSEFKGAALVSPISKRIFGVFLVLLDVTLLLADLIFTDSKLYIPLEYRSISLAIGLFFLMDVLLRVFVEGWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSILHDIETDKILINVYDGPPLYDDVKVQFFSSNLPKYYDNCPFFFWFNTSFIQNNRLCLPRNELDNPHKQKAWKIYPPEFAVEILFGEK

SEQ ID NO: 15129 - protein, 488 aa, Artificial Sequence
  Description of Artificial Sequence: Synthetic coding sequence
MNTSPQTNEFKGTTEEAPAKESPHTSEFKGAALVSPISKSMLERLSKFEVEDAENVASYDSKIKKIVHSIVSSFAFGIFGVFLVLLDVTLLLADLIFTDSKLYIPLEYRSISLAIGLFFLMDVLLRVFVEGRQQYFSDLFNILDTAIIVIPLLVDVIYIFFDIKLLRNIPRWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSILHDIETDKILINVYDGPPLYDDVKVQFFSSRAEKRAAHRANWKGEPSRRPVLD

SEQ ID NO: 15130 - protein, 482 aa, Artificial Sequence
  Description of Artificial Sequence: Synthetic coding sequence
MNESPQTNEFKGTTEEAPAKESPHTSEFKGAALVSPISKSMLERLSKFEVEDAENVASYDSKIKKIVHSIVSSFAFGIFGVFLVLLDVTLLLADLIFTDSKLYIPLEYRSISLAIGLFFLMDVLLRVFVEGWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSILHDIETDKILINVYDGPPLYDDVKVQFFSSNLPKYYDNCPFFFWFNTSFIQNNRLCLPRNELDNPHKQKAWKIYPPEFAVEILFGEK

SEQ ID NO: 15131 - protein, 522 aa, Artificial Sequence [sequence omitted]

SEQ ID NO: 15132 - protein, 445 aa, Artificial Sequence; identical to SEQ ID NO: 15128
  Description of Artificial Sequence: Synthetic coding sequence

SEQ ID NO: 15133 - protein, 411 aa, Artificial Sequence
  Description of Artificial Sequence: Synthetic coding sequence
MNESPQTNEFKGTTEEAPAKESPHTSEFKGAALVSPISKSMLERLSKFEVEDAENVASYEWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSILHDIETDKILINVYDGPPLYDDVKVQFFSSNLPKYYDNCPFFFWFNTSFIQNNRLCLPRNELDNPHKQKAWKIYPPEFAVEILFGEK

SEQ ID NO: 15134 - protein, 522 aa, Artificial Sequence [sequence omitted]

SEQ ID NO: 15135 - protein, 324 aa, Artificial Sequence
  Description of Artificial Sequence: Synthetic coding sequence
MNESPQTNEFKGTTEEAPAKESPHTSEFKGAALVSPISKRWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSREEGSTRANWKGEPSRRPVLD

SEQ ID NO: 15136 - protein, 411 aa, Artificial Sequence; identical to SEQ ID NO: 15133
  Description of Artificial Sequence: Synthetic coding sequence

SEQ ID NO: 15137 - protein, 418 aa, Artificial Sequence
  Description of Artificial Sequence: Synthetic coding sequence
MYRPARVTSTSRFLNPYVVCFIVVAGVVILAVTIALLVYFLAFDQKSYFYRSSFQLLNVEYNSQLNSPATQEYRTLSGRIESLITKTFKESNLRNQFIRAHVAKLRQDGSGVRADVVMKFQFTRNNNGASMKSRIESVLRQMLNNSGNLEINPSTEITSLTDQAAANWLINECGAGPDLITLSEQRILGGTEAEEGSWPWQVSLRLNNAHHCGGSLINNMWILTAAHCFRSNSNPRDWIATSGISTTFPKLRMRVRNILIHNNYKSATHENDIALVRLENSVTFTKDIHSVCLPAATQNIPPGSTAYVTGWGAQEYAGHTVPELRQGQVRIISNDVCNAPHSYNGAILSGMLCAGVPQGGVDACQGDSGGPLVQEDSRRLWFIVGIVSWGDQCGLPDKPGVYTRVTAYLDWIRQQTGI

SEQ ID NO: 15138 - protein, 301 aa, Artificial Sequence
  Description of Artificial Sequence: Synthetic coding sequence
MKFQFTRNNNGASMKSRIESVLRQMLNNSGNLEINPSTEITSLTDQAAANWLINECGAGPDLITLSEQRILGGTEAEEGSWPWQVSLRLNNAHHCGGSLINNMWILTAAHCFRSNSNPRDWIATSGISTTFPKLRMRVRNILIHNNYKSATHENDIALVRLENSVTFTKDIHSVCLPAATQNIPPGSTAYVTGWGAQEYAGHTVPELRQGQVRIISNDVCNAPHSYNGAILSGMLCAGVPQGGVDACQGDSGGPLVQEDSRRLWFIVGIVSWGDQCGLPDKPGVYTRVTAYLDWIRQQTGI

SEQ ID NO: 15139 - protein, 1019 aa, Artificial Sequence
  Description of Artificial Sequence: Synthetic coding sequence
MGSKRGISSRHHSLSSYEIMFAALFAILVVLCAGLIAVSCLTIKESQRGAALGQSHEARATFKITSGVTYNPNLQDKLSVDFKVLAFDLQQMIDEIFLSSNLKNEYKNSRVLQFENGSIIVVFDLFFAQWVSDENVKEELIQGLEANKSSQLVTFHIDLNSVDILDKLTTTSHLATPGNVSIECLPGSSPCTDALTCIKADLFCDGEVNCPDGSDEDNKMCATVCDGRFLLTGSSGSFQATHYPKPSETSVVCQWIIRVNQGLSIKLSFDDFNTYYTDILDIYEGVGSSKILRASIWETNPGTIRIFSNQVTATFLIESDESDYVGFNATYTAFNSSELNNYEKINCNFEDGFCFWVQDLNDDNEWERIQGSTFSPFTGPNFDHTFGNASGFYISTPTGPGGRQERVGLLSLPLDPTLEPACLSFWYHMYGENVHKLSINISNDQNMEKTVFQKEGNYGDNWNYGQVTLNETVKFKVAFNAFKNKILSDIALDDISLTYGICNGSLYPEPTLVPTPPPELPTDCGGPFELWEPNTTFSSTNFPNSYPNLAFCVWILNAQKGKNIQLHFQEFDLENINDVVEIRDGEEADSLLLAVYTGPGPVKDVFSTTNRMTVLLITNDVLARGGFKANFTTGYHLGIPEPCKADHFQCKNGECVPLVNLCDGHLHCEDGSDEADCVRFFNGTTNNNGLVRFRIQSIWHTACAENWTTQISNDVCQLLGLGSGNSSKPIFPTDGGPFVKLNTAPDGHLILTPSQQCLQDSLIRLQCNHKSCGKKLAAQDITPKIVGGSNAKEGAWPWVVGLYYGGRLLCGASLVSSDWLVSAAHCVYGRNLEPSKWTAILGLHMKSNLTSPQTVPRLIDEIVINPHYNRRRKDNDIAMMHLEFKVNYTDYIQPICLPEENQVFPPGRNCSIAGWGTVVYQGTTANILQEADVPLLSNERCQQQMPEYNITENMICAGYEEGGIDSCQGDSGGPLMCQENNRWFLAGVTSFGYKCALPNRPGVYARVSRFTEWIQSFLH

SEQ ID NO: 15140 - protein, 717 aa, Artificial Sequence
  Description of Artificial Sequence: Synthetic coding sequence
MFRITNIEFLPEYRQKESREFLSVSRTVQQVINLVYTTSAFSKFYEQSVVADVSNNKGGLLVHFWIVFVMPRAKGHIFCEDCVAAILKDSIQTSIINRTSVGSLQGLAVDMDSVVLNDKGCSQYFYAEHLSLHYPLEISAASGRLMCHFKLVAIVGYLIRLSIKSIQIEADNCVTDSLTIYDSLLPIRSSILYRICEPTRTLMSFVSTNNLMLVTFKSPHIRRLSGIRAYFEVIPEQKCENTVLVKDITGFEGKISSPYYPSYYPPKCKCTWKFQTSLSTLGIALKFYNYSITKKSMKGCEHGWWEINEHMYCGSYMDHQTIFRVPSPLVHIQLQCSSRLSDKPLLAEYGSYNISQPCPVGSFRCSSGLCVPQAQRCDGVNDCFDESDELFCVSPQPACNTSSFRQHGPLICDGFRDCENGRDEQNCTQSIPCNNRTFKCGNDICFRKQNAKCDGTVDCPDGSDEEGCTCSRSSSALHRIIGGTDTLEGGWPWQVSLHFVGSAYCGASVISREWLLSAAHCFHGNRLSDPTPWTAHLGMYVQGNAKFVSPVRRIVVHEYYNSQTFDYDIALLQLSIAWPETLKQLIQPICIPPTGQRVRSGEKCWVTGWGRRHEADNKGSLVLQQAEVELIDQTLCVSTYGIITSRMLCAGIMSGKRDACKGDSGGPLSCRRKSDGKWILTGIVSWGHGSGRPNFPGVYTRVSNFVPWIHKYVPSLL

SEQ ID NO: 15141 - protein, 817 aa, Artificial Sequence
  Description of Artificial Sequence: Synthetic coding sequence
MDKENSDVSAAPADLKISNISVQVVSAQKKLPPGRRPPQRPIGKAKPKKQSKKKVPFWNVQNKIILFTVFLFILAVIAWTLLWLYISKTESKDAFYFAGMFRITNIEFLPEYRQKESREFLSVSRTVQQVINLVYTTSAFSKFYEQSVVADVSSNNKGGLLVHFWIVFVMPRAKGHIFCEDCVAAILKDSIQTSIINRTSVGSLQGLAVDMDSVVLNDKGCSQYFYAEHLSLHYPLEISAASGRLMCHFKLVAIVGYLIRLSIKSIQIEADNCVTDSLTIYDSLLPIRSSILYRICEPTRTLMSFVSTNNLMLVTFKSPHIRRLSGIRAYFEVIPEQKCENTVLVKDITGFEGKISSPYYPSYYPPKCKCTWKFQTSLSTLGIALKFYNYSITKKSMKGCEHGWWEINEHMYCGSYMDHQTIFRVPSPLVHIQLQCSSRLSDKPLLAEYGSYNISQPCPVGSFRCSSGLCVPQAQRCDGVNDCFDESDELFCVSPQPACNTSSFRQHGPLICDGFRDCENGRDEQNCTQSIPCNNRTFKCGNDICFRKQNAKCDGTVDCPDGSDEEGCTCSRSSSALHRIIGGTDTLEGGWPWQVSLHFVGSAYCGASVISREWLLSAAHCFHGNRLSDPTPWTAHLGMYVQGNAKFVSPVRRIVVHEYYNSQTFDYDIALLQLSIAWPETLKQLIQPICIPPTGQRVRSGEKCWVTGWGRRHEADNKGSLVLQQAEVELIDQTLCVSTYGIITSRMLCAGIMSGKRDACKGDSGGPLSCRRKSDGKWILTGIVSWGHGSGRPNFPGVYTRVSNFVPWIHKYVPSLL

SEQ ID NO: 15142 - protein, 831 aa, Artificial Sequence
  Description of Artificial Sequence: Synthetic coding sequence
MDKENSDVSAAPADLKISNISVQVVSAQKKLPPGRRPPQRPIGKAKPKKQSKKKVPFWNVQNKIILFTVFLFILAVIAWTLLWLYISKTESKDAFYFAGMFRITNIEFLPEYRQKESREFLSVSRTVQQVINLVYTTSAFSKFYEQSVVADVSSNNKGGLLVHFWIVFVMPRAKGHIFCEDCVAAILKDSIQTSIINRTSVGSLQGLAVDMDSVVNAAGLRSDYSSTIGSADKGCSQYFYAEHLSLHYPLEISAASGRLMCHFKLVAIVGYLIRLSIKSIQIEADNCVTDSLTIYDSLLPIRSSILYRICEPTRTLMSFVSTNNLMLVTFKSPHIRRLSGIRAYFEVIPEQKCENTVLVKDITGFEGKISSPYYPSYYPPKCKCTWKFQTSLSTLGIALKFYNYSITKKSMKGCEHGWWEINEHMYCGSYMDHQTIFRVPSPLVHIQLQCSSRLSDKPLLAEYGSYNISQPCPVGSFRCSSGLCVPQAQRCDGVNDCFDESDELFCVSPQPACNTSSFRQHGPLICDGFRDCENGRDEQNCTQSIPCNNRTFKCGNDICFRKQNAKCDGTVDCPDGSDEEGCTCSRSSSALHRIIGGTDTLEGGWPWQVSLHFVGSAYCGASVISREWLLSAAHCFHGNRLSDPTPWTAHLGMYVQGNAKFVSPVRRIVVHEYYNSQTFDYDIALLQLSIAWPETLKQLIQPICIPPTGQRVRSGEKCWVTGWGRRHEADNKGSLVLQQAEVELIDQTLCVSTYGIITSRMLCAGIMSGKRDACKGDSGGPLSCRRKSDGKWILTGIVSWGHGSGRPNFPGVYTRVSNFVPWIHKYVPSLL

SEQ ID NO: 15143 - protein, 843 aa, Artificial Sequence
  Description of Artificial Sequence: Synthetic coding sequence
MDKENSDVSAAPADLKISNISVQVVSAQKKLPVRRPPLPGRRLPLPGRRPPQRPIGKAKPKKQSKKKVPFWNVQNKIILFTVFLFILAVIAWTLLWLYISKTESKDAFYFAGMFRITNIEFLPEYRQKESREFLSVSRTVQQVINLVYTTSAFSKFYEQSVVADVSSNNKGGLLVHFWIVFVMPRAKGHIFCEDCVAAILKDSIQTSIINRTSVGSLQGLAVDMDSVVLNAGLRSDYSSTIGSDKGCSQYFYAEHLSLHYPLEISAASGRLMCHFKLVAIVGYLIRLSIKSIQIEADNCVTDSLTIYDSLLPIRSSILYRICEPTRTLMSFVSTNNLMLVTFKSPHIRRLSGIRAYFEVIPEQKCENTVLVKDITGFEGKISSPYYPSYYPPKCKCTWKFQTSLSTLGIALKFYNYSITKKSMKGCEHGWWEINEHMYCGSYMDHQTIFRVPSPLVHIQLQCSSRLSDKPLLAEYGSYNISQPCPVGSFRCSSGLCVPQAQRCDGVNDCFDESDELFCVSPQPACNTSSFRQHGPLICDGFRDCENGRDEQNCTQSIPCNNRTFKCGNDICFRKQNAKCDGTVDCPDGSDEEGCTCSRSSSALHRIIGGTDTLEGGWPWQVSLHFVGSAYCGASVISREWLLSAAHCFHGNRLSDPTPWTAHLGMYVQGNAKFVSPVRRIVVHEYYNSQTFDYDIALLQLSIAWPETLKQLIQPICIPPTGQRVRSGEKCWVTGWGRRHEADNKGSLVLQQAEVELIDQTLCVSTYGIITSRMLCAGIMSGKRDACKGDSGGPLSCRRKSDGKWILTGIVSWGHGSGRPNFPGVYTRVSNFVPWIHKYVPSLL

SEQ ID NO: 15144 - protein, 1059 aa, Artificial Sequence
  Description of Artificial Sequence: Synthetic coding sequence
MEPTVADVHLVPRTTKEVPALDAACCRAASIGVVATSLVVLTLGVLLAFLSTQGFHVDHTAELRGIRWTSSLRRETSDYHRTLTPTLEALLHFLLRPLQTLSLGLEEELLQRGIRARLREHGISLAAYGTIVSAELTGRHKGPLAERDFKSGRCPGNSFSCGNSQCVTKVNPECDDQEDCSDGSDEAHCECGLQPAWRMAGRIVGGMEASPGEFPWQASLRENKEHFCGAAIINARWLVSAAHCFNEFQDPTKWVAYVGATYLSGSEASTVRAQVVQIVKHPLYNADTADFDVAVLELTSPLPFGRHIQPVCLPAATHIFPPSKKCLISGWGYLKEDFLVKPEVLQKATVELLDQALCASLYGHSLTDRMVCAGYLDGKVDSCQGDSGGPLVCEEPSGRFFLAGIVSWGIGCAEARRPGVYARVTRLRDWILEATTKASMPLAPTMAPAPAAPSTAWPTSPESPVVSTPTKSMQALSTVPLDWVTVPKLQECGARPAMEKPTRVVGGFGAASGEVPWQVSLKEGSRHFCGATVVGDRWLLSAAHCFNHTKVEQVRAHLGTASLLGLGGSPVKIGLRRVVLHPLYNPGILDFDLAVLELASPLAFNKYIQPVCLPLAIQKFPVGRKCMISGWGNTQEGNATKPELLQKASVGIIDQKTCSVLYNFSLTDRMICAGFLEGKVDSCQGDSGGPLACEEAPGVFYLAGIVSWGIGCAQVKKPGVYTRITRLKGWILEIMSSQPLPMSPPSTTRMLATTSPRTTAGLTVPGATPSRPTPGAASRVTGQPANSTLSAVSTTARGQTPFPDAPEATTHTQLPDCGLAPAALTRIVGGSAAGRGEWPWQVSLWLRRREHRCGAVLVAERWLLSAAHCFDVYGDPKQWAAFLGTPFLSGAEGQLERVARIYKHPFYNLYTLDYDVALLELAGPVRRSRLVRPICLPEPAPRPPDGTRCVITGWGSVREGGSMARQLQKAAVRLLSEQTCRRFYPVQISSRMLCAGFPQGGVDSCSGDAGGPLACREPSGRWVLTGVTSWGYGCGRPHFPGVYTRVAAVRGWIGQHIQE

SEQ ID NO: 15145 - protein, 531 aa, Artificial Sequence
  Description of Artificial Sequence: Synthetic coding sequence
MEPTVADVHLVPRTTKEVPALDAACCRAASIGVVATSLVVLTLGVLLAFLSTQGFHVDHTAELRGIRWTSSLRRETSDYHRTLTPTLEALFVSSFQKTELEASCVGCSVLNYRDGNSSVLVHFQLHFLLRPLQTLSLGLEEELLQRGIRARLREHGISLAAYGTIVSAELTGRHKGPLAERDFKSGRCPGNSFSCGNSQCVTKVNPECDDQEDCSDGSDEAHCECGLQPAWRMAGRIVGGMEASPGEFPWQASLRENKEHFCGAAIINARWLVSAAHCFNEFQDPTKWVAYVGATYLSGSEASTVRAQVVQIVKHPLYNADTADFDVAVLELTSPLPFGRHIQPVCLPAATHIFPPSKKCLISGWGYLKEDFLVKPEVLQKATVELLDQALCASLYGHSLTDRMVCAGYLDGKVDSCQGDSGGPLVCEEPSGRFFLAGIVSWGIGCAEARRPGVYARVTRLRDWILEATTKASMPLAPTMAPAPAAPSTAWPTSPESPVVSTPTKSMQALSTVPLDWVTVPKLQGIFGAER

SEQ ID NO: 15146 - protein, 134 aa, Artificial Sequence
  Description of Artificial Sequence: Synthetic coding sequence
MTEEPIKEILGAPKAHMAATMEKSPKSEVVITTVPLVSEIQLMAATGGTELSCYRCIIPFAVVVFIAGIVVTAVAYSFNSHGSIISIFGLVVLSSGLFLLASSALCWKVRQRSKKAKRRESQTALVANQRSLFA

SEQ ID NO: 15147 - protein, 134 aa, Artificial Sequence; identical to SEQ ID NO: 15146
  Description of Artificial Sequence: Synthetic coding sequence

SEQ ID NO: 15148 - protein, 134 aa, Artificial Sequence; identical to SEQ ID NO: 15146
  Description of Artificial Sequence: Synthetic coding sequence

SEQ ID NO: 15149 - protein, 257 aa, Artificial Sequence
  Description of Artificial Sequence: Synthetic coding sequence
MASKIGSRRWMLQLIMQLGSVLLTRCPFWGCFSQLMLYAERAEARRKPDIPVPYLYFDMGAAVLCASFMSFGVKRRWFALGAALQLAISTYAAYIGGYVHYGDWLKVRMYSRTVAIIGGFLVLASGAGELYRRKPRSRSLQSTGQVFLGIYLICVAYSLQHSKEDRLAYLNHLPGGELMIQLFFVLYGILALAFLSGYYVTLAAQILAVLLPPVMLLIDGNVAYWHNTRRVEFWNQMKLLGESVGIFGTAVILATDG

SEQ ID NO: 15150 - protein, 199 aa, Artificial Sequence
  Description of Artificial Sequence: Synthetic coding sequence
MGAAVLCASFMSFGVKRRWFALGAALQLAISTYAAYIGGYVHYGDWLKVRMYSRTVAIIGGFLVLASGAGELYRRKPRSRSLQSTGQVFLGIYLICVAYSLQHSKEDRLAYLNHLPGGELMIQLFFVLYGILALAFLSGYYVTLAAQILAVLLPPVMLLIDGNVAYWHNTRRVEFWNQMKLLGESVGIFGTAVILATDG

SEQ ID NO: 15151 - protein, 257 aa, Artificial Sequence; identical to SEQ ID NO: 15149
  Description of Artificial Sequence: Synthetic coding sequence

SEQ ID NO: 15152 - protein, 496 aa, Artificial Sequence
  Description of Artificial Sequence: Synthetic coding sequence
MAGEITETGELYSSYVGLVYMFNLIVGTGALTMPKAFATAGWLVSLVLLVFLGFMSFVTTTFVIEAMAAANAQLHWKRMENLKEEEDDDSSTASDSDVLIRDNYERAEKRPILSVQRRGSPNPFEITDRVEMGQMASMFFNKVGVNLFYFCIIVYLYGDLAIYAAAVPFSLMQVTCSATGNDSCGVEADTKYNDTDRCWGPLRRVDAYRIYLAIFTLLLGPFTFFDVQKTKYLQILTSLMRWIAFAVMIVLALIRIGHGQGEGHPPLADFSGVRNLFGVCVYSFMCQHSLPSLITPVSSKRHLTRLVFLDYVLILAFYGLLSFTAIFCFRGDSLMDMYTLNFARCDVVGLAAVRFFLGLFPVFTISTNFPIIAVTLRNNWKTLFHREGGTYPWVVDRVVFPTITLVPPVLVAFCTHDLESLVGITGAYAGTGIQYVIPAFLVYHCRRDTQLAFGCGVSNKHRSPFRHTFWVGFVLLWAFSCFIFVTANIILSETKL

SEQ ID NO: 15153 - protein, 327 aa, Artificial Sequence
  Description of Artificial Sequence: Synthetic coding sequence
MAGEITETGELYSSYVFVRVVKPNKIAMLFIMLIPGWARWLTPVIPALWEAEAGRSPEVRSSRPAWPTCFVTTTFVIEAMAAANAQLHWKRMENLKEEEDDDSSTASDSDVLIRDNYERAEKRPILSVQRRGSPNPFEITDRVEMGQMASMFFNKVGVNLFYFCIIVYLYGDLAIYAAAVPFSLMQVTCSATGNDSCGVEADTKYNDTDRCWGPLRRVDAYRIYLAIFTLLLGPFTFFDVQKTKYLQILTSLMRWIDGPPGSVMGRAEEDASPAWPRSRCRCGGKLKLNSLYPTSATCMAPDAPGAGQVKVGVNFLCLPPHRSTRPT

SEQ ID NO: 15154 - protein, 129 aa, Artificial Sequence
  Description of Artificial Sequence: Synthetic coding sequence
MLLKVRRASLKPPATPHQGAFRAGNVIGQLIYLLTWSLFTAWLRPPTLLQGPRTSPQGSPPRSPWGDCAEPSCLCEMKIRRRRHEGPAWGQSGFLAGGLHLVPSSLSLAACGVVRMKGLWGRGAGIRGR

SEQ ID NO: 15155 - protein, 262 aa, Artificial Sequence
  Description of Artificial Sequence: Synthetic coding sequence
MGKTFSQLGSWREDENKSILSSKPAIGSKAVNYSSTGSSKSFCSCVPCEGTADASFVTCPTCQGSGKIPQELEKQLVALIPYGDQRLKPKHTKLFVFLAVLICLVTSSFIVFFLFPRSVIVQPAGLNSSTVAFDEADIYLNITNILNISNGNYYPIMVTQLTLEVLHLSLVVGQVSNNLLLHIGPLASEQMFYAVATKIRDENTYKICTWLEIKVHHVLLHIQGTLTCSYLSHSEQLVFQSYEYVDCRGNASVPHQLTPHPP

SEQ ID NO: 15156 - protein, 215 aa, Artificial Sequence
  Description of Artificial Sequence: Synthetic coding sequence
MGKTFSQLGSWREDENKSILSSKPAIGSKAVNYSSTGSSKSFCSCVPCEGTADASFVTCPTCQGSGKIPQELEKQLVALIPYGDQRLKPKHTKLFVFLAVLICLVTSSFIVFFLFPRSVIVQPAGLNSSTVAFDEADIYLNITMFYAVATKIRDENTYKICTWLEIKVHHVLLHIQGTLTCSYLSHSEQLVFQSYEYVDCRGNASVPHQLTPHPP

SEQ ID NO: 15157 - protein, 214 aa, Artificial Sequence
  Description of Artificial Sequence: Synthetic coding sequence
MGTADASFVTCPTCQGSGKIPQELEKQLVALIPYGDQRLKPKHTKLFVFLAVLICLVTSSFIVFFLFPRSVIVQPAGLNSSTVAFDEADIYLNITNILNISNGNYYPIMVTQLTLEVLHLSLVVGQVSNNLLLHIGPLASEQMFYAVATKIRDENTYKICTWLEIKVHHVLLHIQGTLTCSYLSHSEQLVFQSYEYVDCRGNASVPHQLTPHPP

SEQ ID NO: 15158 - protein, 231 aa, Artificial Sequence
  Description of Artificial Sequence: Synthetic coding sequence
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVNFTGKAEMGGPFSYVYFFCTVPEILVHNIVIFMRTSVKISYIGLMTQSSLETHHYVDCGGNSTAI

SEQ ID NO: 15159 - protein, 250 aa, Artificial Sequence
  Description of Artificial Sequence: Synthetic coding sequence
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVSTYVTTNVSLIPPRSEQLVNFTGKAEMGGPFSYVYFFCTVPEILVHNIVIFMRTSVKISYIGLMTQSSLETHHYVDCGGNSTAI

SEQ ID NO: 15160 - protein, 231 aa, Artificial Sequence; identical to SEQ ID NO: 15158
  Description of Artificial Sequence: Synthetic coding sequence

SEQ ID NO: 15161 - protein, 250 aa, Artificial Sequence; identical to SEQ ID NO: 15159
  Description of Artificial Sequence: Synthetic coding sequence

SEQ ID NO: 15162 - protein, 146 aa, Artificial Sequence
  Description of Artificial Sequence: Synthetic coding sequence
MGRVSGLVPSRFLTLLAHLVVVITLFWSRDSNIQACLPLTFTPEEYDKQDIHPLPLCRLVAALSVTLGLFAVELAGFLSGVSMFNSTQSLISIGAHCSASVALSFFIFERWECTTYWYIFVFCSALPAVTEMALFVTVFGLKKKPF

SEQ ID NO: 15163 - protein, 163 aa, Artificial Sequence
  Description of Artificial Sequence: Synthetic coding sequence
MGRVSGLVPSRFLTLLAHLVVVITLFWSRVRPTAALNPSPFPSLSGPSPTLPPPSVLPSWVFLFPAAPRPALQPAPFSLLSAGWWPRSLSPWASLQWSWPVSSQESPCSTAPRASSVSFLPAHLSHTTHFYQDSLQPPDTIVSAVANPSSSKIFNDVLNPAVY

SEQ ID NO: 15164 - protein, 140 aa, Artificial Sequence
  Description of Artificial Sequence: Synthetic coding sequence
MGRVSGLVPSRFLTLLAHLVVVITLFWSRDSNIQACLPLTFTPEEYDKQDIQLVAALSVTLGLFAVELAGFLSGVSMFNSTQSLISIGAHCSASVALSFFIFERWECTTYWYIFVFCSALPAVTEMALFVTVFGLKKKPF

SEQ ID NO: 15165 - protein, 139 aa, Artificial Sequence
  Description of Artificial Sequence: Synthetic coding sequence
MGRVSGLVPSRFLTLLAHLVVVITLFWSRDSNIQACLPLTFTPEEYDKQDIHPLPLCRLVAALSVTLGLFAVELAGFLSGVSMFNSTQSLISIGAHCSASVALSFFIFERWECTTYCALPAVTEMALFVTVFGLKKKPF

SEQ ID NO: 15166 - protein, 575 aa, Artificial Sequence
  Description of Artificial Sequence: Synthetic coding sequence
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSVLLTVCCMKRKKKTANPENNLSYWNNTITMDYFNRHAVELPREIQSLETSEDQLSEPRSPANGDYRDTGMVLVNPFCQETLFVGNDQVSEI

SEQ ID NO: 15167 - protein, 575 aa, Artificial Sequence; identical to SEQ ID NO: 15166
  Description of Artificial Sequence: Synthetic coding sequence

SEQ ID NO: 15168 - protein, 105 aa, Artificial Sequence
  Description of Artificial Sequence: Synthetic coding sequence
MKRSLQALYCQLLTVLLTVCCMKRKKKTANPENNLSYWNNTITMDYFNRHAVELPREIQSLETSEDQLSEPRSPANGDYRDTGMVLVNPFCQETLFVGNDQVSEI

SEQ ID NO: 15169 - protein, 153 aa, Artificial Sequence
  Description of Artificial Sequence: Synthetic coding sequence
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRP

SEQ ID NO: 15170 - protein, 72 aa, Artificial Sequence
  Description of Artificial Sequence: Synthetic coding sequence
MKRSLQALYCQLLSFLLILALTEALAFAIQEPSPRESLQVLPSGTPPGTMVTAPHSSTRHTSVVMLTPNPDG

SEQ ID NO: 15171 - protein, 149 aa, Artificial Sequence
  Description of Artificial Sequence: Synthetic coding sequence
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGA

SEQ ID NO: 15172 - protein, 488 aa, Artificial Sequence
  Description of Artificial Sequence: Synthetic coding sequence
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSDPIT

SEQ ID NO: 15173 - protein, 243 aa, Artificial Sequence
  Description of Artificial Sequence: Synthetic coding sequence
MAASSISSPWGKHVFKAILMVLVALILLHSALAQSRRDFAPPGQQKREAPVDVLTQIGRSVRGTLDAWIGPETMHLVSESSSQVLWAISSAISVAFFALSGIAAQLLNALGLAGDYLAQGLKLSPGQVQTFLLWGAGALVVYWLLSLLLGLVLALLGRILWGLKLVIFLAGFVALMRSVPDPSTRALLLLALLILYALLSRLTGSRASGAQLEAKVRGLERQVEELRWRQRRAAKGARSVEEE

SEQ ID NO: 15174 - protein, 234 aa, Artificial Sequence
  Description of Artificial Sequence: Synthetic coding sequence
MAASSISSPWGKHVFKAILMVLVALILLHSALAQSRRDFAPPGQQKREAPVDVLTQIGRSVRGTLDAWIGPETMHLVSESSSQVLWAISSAISVAFFALSGIAAQLLNALGLAGDYLAQGLKLSPGQVQTFLLWGAGALVVYWLLSLLLGLVLALLGRILWGLKLVIFLAGFVALMRSVPDPSTRALLLLALLTPCPFLALSLNLQNIDPCRSPTSQEKQRKTIPPACPCGPVF

SEQ ID NO: 15175 - protein, 243 aa, Artificial Sequence; identical to SEQ ID NO: 15173
  Description of Artificial Sequence: Synthetic coding sequence

SEQ ID NO: 15176 - protein, 192 aa, Artificial Sequence
  Description of Artificial Sequence: Synthetic coding sequence
MAAWGRRRLGPGSSGGSARERVSLSATDCYIVHEIYNGENAQDQFEYELEQALEAQYKYIVIEPTRIGDETARWITVGNCLHKTAVLAGTACLFTPLALPLDYSHYISLPAGVLSLACCTLYGISWQFDPCCKYQVEYDAYKLSRLPLHTLTSSTPVVLVRKDDLHRKRLHNTIALAALVYCVKKIYELYAV

SEQ ID NO: 15177 - protein, 294 aa, Artificial Sequence
  Description of Artificial Sequence: Synthetic coding sequence
MQGPAGNASRGLPGGPPSTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVSVLVEWQQWESLRFGEYGDPLQCGAWVGQCALYIVIMIFEKSVVFIVLLILQWKKVALLNPIENPDLKLAIVMLIVPFFVNALMFWVVDNFLMRKGKTKAKLEERGANQDSRNGSKVRYRRAASHEESESEILISADDEMEESDVEEDLRRLTPLKPVKKKKHRFGLPV

SEQ ID NO: 15178 - protein, 261 aa, Artificial Sequence
  Description of Artificial Sequence: Synthetic coding sequence
MAGPELLLDSNIRLWVVLPIVIITFFVGMIRHYVSILLQSDKKLTQEQVSDSQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASWVSSASWYFLNVFGLRSIYSLILGQDNAADQSRMMQEQMTGAAMAMPADTNKAFKTEWEALELTDHQWALDDVEEELMAKDLHFEGMFKKELQTSIF

SEQ ID NO: 15179 - protein, 203 aa, Artificial Sequence
  Description of Artificial Sequence: Synthetic coding sequence
MAGPELLLDSNIRLWVVLPIVIITFFVGMIRHYVSILLQSDKKLTQEQVSDRKYLSGLVQWLTPIIPALWGAEMGGSLEPRNLRPTLAACQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASW

SEQ ID NO: 15180 - protein, 351 aa, Artificial Sequence
  Description of Artificial Sequence: Synthetic coding sequence
MQRALPGARQHLGAILASASVVVKALCAAVLFLYLLSFAVDTGCLAVTPGYLFPPNFWIWTLATHGLMEQHVWDVAISLTTVVVAGRLLEPLWGALELLIFFSVVNVSVGLLGAFAYLLTYMASFNLVYLFTVRIHGALGFLGGVLVALKQTMGDCVVLRVPQVRVSVMPMLLLALLLLLRLATLLQSPALASYGFGLLSSWVYLRFYQRHSRGRGDMADHFAFATFFPEILQPVVGLLANLVHSLLVKVKICQKTVKRYDVGAPSSITISLPGTDPQDAERRRQLALKALNERLKRVEDQSIWPSMDDDEEESGAKVDSPLPSDKAPTPPGKGAAPESSLITFEAAPPTL

SEQ ID NO: 15181 - protein, 245 aa, Artificial Sequence
  Description of Artificial Sequence: Synthetic coding sequence
MKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 15182 - protein, 245 aa, Artificial Sequence; identical to SEQ ID NO: 15181
  Description of Artificial Sequence: Synthetic coding sequence

SEQ ID NO: 15183 - protein, 74 aa, Artificial Sequence
  Description of Artificial Sequence: Synthetic coding sequence
MATLSVIGSSSLIAYAVFHNIQKSPEIRPLFYLSFCDLLLGLCWLTETLLYGASVANKDIICYNLQAVGQVSAT

SEQ ID NO: 15184 - protein, 106 aa, Artificial Sequence
  Description of Artificial Sequence: Synthetic coding sequence
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLV

SEQ ID NO: 15185 - protein, 175 aa, Artificial Sequence
  Description of Artificial Sequence: Synthetic coding sequence
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLVIDYTCRVCQMAFVFSSLIPLLLMTPVFCLGNTSECFQNFSQSHKCILMHSPPSAMAELPPSANTSVCST

SEQ ID NO: 15186 - protein, 51 aa, Artificial Sequence
  Description of Artificial Sequence: Synthetic coding sequence
MATLSVIGSSSLIAYAVFHNIQKSPEIRPLFYLSFCDLLLGLCWLTETLLY

SEQ ID NO: 15187 - protein, 245 aa, Artificial Sequence; identical to SEQ ID NO: 15181
  Description of Artificial Sequence: Synthetic coding sequence

SEQ ID NO: 15188 - protein, 337 aa, Artificial Sequence
  Description of Artificial Sequence: Synthetic coding sequence
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 15189 - protein, 302 aa, Artificial Sequence
  Description of Artificial Sequence: Synthetic coding sequence
MATLSVIGSSSLIAYAVFHNIQKSPEIRPLFYLSFCDLLLGLCWLTETLLYGASVANKDIICYNLQAVGQVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 15190 - protein, 514 aa, Artificial Sequence
  Description of Artificial Sequence: Synthetic coding sequence
MGKDFRYYFQHPWSRMIVAYLVIFFNFLIFAEDPVSHSQTEANVIVVGNCFSFVTNKYPRGVGWRILKVLLWLLAILTGLIAGKFLFHQRLFGQLLRLKMFREDHGSWMTMFFSTILFLFIFSHIYNTILLMDGNMGAYIITDYMGIRNESFMKLAAVGTWMGDFVTAWMVTDMMLQDKPYPDWGKSARAFWKKGNVRITLFWTVLFTLTSVVVLVITTDWISWDKLNRGFLPSDEVSRAFLASFILVFDLLIVMQDWEFPHFMGDVDVNLPGLHTPHMQFKIPFFQKIFKEEYRIHITGKWFNYGIIFLVLILDLNMWKNQIFYKPHEYGQYIGPGQKIYTVKDSESLKDLNRTKLSWEWRSNHTNPRTNKTYVEGDMFLHSRFIGASLDVKCLAFVPSLIAFVWFGFFIWFFGRFLKNEPRMENQDKTYTRMKRKSPSEHSKDMGITRENTQASVEDPLNDPSLVCIRSDFNEIVYKSSHLTSENLSSQLNESTSATEADQDPTTSKSTPTN

SEQ ID NO: 15191 - protein, 262 aa, Artificial Sequence
  Description of Artificial Sequence: Synthetic coding sequence
MYIKDWEFPHFMGDVDVNLPGLHTPHMQFKIPFFQKIFKEEYRIHITGKWFNYGIIFLVLILDLNMWKNQIFYKPHEYGQYIGPGQKIYTVKDSESLKDLNRTKLSWEWRSNHTNPRTNKTYVEGDMFLHSRFIGASLDVKCLAFVPSLIAFVWFGFFIWFFGRFLKNEPRMENQDKTYTRMKRKSPSEHSKDMGITRENTQASVEDPLNDPSLVCIRSDFNEIVYKSSHLTSENLSSQLNESTSATEADQDPTTSKSTPTN

SEQ ID NO: 15192 - protein, 410 aa, Artificial Sequence
  Description of Artificial Sequence: Synthetic coding sequence
MATCHSHRTNSWQISVPSAFVWSVAPIKNVSRRSWVVDDNVLQHNSLSLHIFSHIQHDSSNGWEHGVTDMMLQDKPYPDWGKSARAFWKKGNVRITLFWTVLFTLTSVVVLVITTDWISWDKLNRGFLPSDEVSRAFLASFILVFDLLIVMQDWEFPHFMGDVDVNLPGLHTPHMQFKIPFFQKIFKEEYRIHITGKWFNYGIIFLVLILDLNMWKNQIFYKPHEYGQYIGPGQKIYTVKDSESLKDLNRTKLSWEWRSNHTNPRTNKTYVEGDMFLHSRFIGASLDVKCLAFVPSLIAFVWFGFFIWFFGRFLKNEPRMENQDKTYTRMKRKSPSEHSKDMGITRENTQASVEDPLNDPSLVCIRSDFNEIVYKSSHLTSENLSSQLNESTSATEADQDPTTSKSTPTN

SEQ ID NO: 15193 - protein, 283 aa, Artificial Sequence
  Description of Artificial Sequence: Synthetic coding sequence
MVSAAAPSLLILLLLLLGSVPATDARSVPLKATFLEDVAGSGEAEGSSASSPSLPPPWTPALSPTSMGPQPITLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATQNLKSPTRAALGGGDGARMVEGRGAEEEEKGSQEGDQEVQGHGVPVETPEAQEEPCSGVLEGAVVAGEGQGELEGSLLLAQEAQGPVGPPESPCACSSVHPSV

SEQ ID NO: 15194 - protein, 217 aa, Artificial Sequence
  Description of Artificial Sequence: Synthetic coding sequence
MGPQPITLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATQNLKSPTRAALGGGDGARMVEGRGAEEEEKGSQEGDQEVQGHGVPVETPEAQEEPCSGVLEGAVVAGEGQGELEGSLLLAQEAQGPVGPPESPCACSSVHPSV

SEQ ID NO: 15195 - protein, 28 aa, Artificial Sequence
  Description of Artificial Sequence: Synthetic coding sequence
MVSAAAPSLLILLLLLLGSVPATDARSV

SEQ ID NO: 15196 - protein, 140 aa, Artificial Sequence
  Description of Artificial Sequence: Synthetic coding sequence
MVSAAAPSLLILLLLLLGSVPATDARSVPLKATFLEDVAGSGEAEGSSASSPSLPPPWTPALSPTSMGPQPITLGGPSPPTNFLDGIVDFFRQYVMLIAVVGSLAFLLMFIVCAAVITRQKQKASAYYPSSFPKKKYVDQ

SEQ ID NO: 15197 - protein, 44 aa, Artificial Sequence
  Description of Artificial Sequence: Synthetic coding sequence
MVSAAAPSLLILLLLLLGSVPATDARSVPLKATFLEDVAGSGEA

SEQ ID NO: 15198 - protein, 339 aa, Artificial Sequence
  Description of Artificial Sequence: Synthetic coding sequence
MSGQLERCEREWHELEGEFQELQETHRIYKQKLEELAALQTLCSSSISKQKKHLKDLKLTLQRCKRHASREEAELVQQMAANIKERQDVFFDMEAYLPKKNGLYLNLVLGNVNVTLLSNQAKFAYKDEYEKFKLYLTIILLLGAVACRFVLHYRVTDEVFNFLLVWYYCTLTIRESILISNGSRIKGWWVSHHYVSTFLSGVMLTWPNGPIYQKFRNQFLAFSIFQSCVQFLQYYYQRGCLYRLRALGERNHLDLTVEGFQSWMWRGLTFLLPFLFCGHFWQLYNAVTLFELSSHEECREWQVFVLAFTFLILFLGNFLTTLKVVHAKLQKNRGKTKQP

SEQ ID NO: 15199 - protein, 339 aa, Artificial Sequence; identical to SEQ ID NO: 15198
  Description of Artificial Sequence: Synthetic coding sequence

SEQ ID NO: 15200 - protein, 319 aa, Artificial Sequence
  Description of Artificial Sequence: Synthetic coding sequence
MVLPPPDRRHVCLTTLVIMGSMAVMDAYLVEQNQGPRKIGVCIIVLVGDVCFLLVLRYVAVWVGAEVRTAKRGYAMILWFLYIFVLEIKLYFIFQNYKAARRGAADPVARKALTLLLSVCVPGLFLLLVALDRMEYVRTFRKREDLRGRLFWVALDLLDLLDMQASLWEPPRSGLPLWAEGLTFFYCYMLLLVLPCVALSEVSMQGEHIAPQKMMLYPVLSLATVNVVAVLARAANMALFRDSRVSAIFVGKNVVALATKACTFLEYRRQVRDFPPPALSLELQPPPPQRNSVPPPPPPLHGPPGRPHMSSPTRDPLDT

SEQ ID NO: 15201 - protein, 319 aa, Artificial Sequence; identical to SEQ ID NO: 15200
  Description of Artificial Sequence: Synthetic coding sequence

SEQ ID NO: 15202 - protein, 219 aa, Artificial Sequence
  Description of Artificial Sequence: Synthetic coding sequence
MSEQEAQAPGGRGLPPDMLAEQVELWWSQQPRRSALCFVVAVGLVAGCGAGGVALLSTTSSRSGEWRLATGTVLCLLALLVLVKQLMSSAVQDMNCIRQAHHVALLRSGGGADALVVLLSGLVLLVTGLTLAGLAAAPAPARPLAAMLSVGIALAALGSLLLLGLLLYQVGVSGHCPSICMATPSTHSGHGGHGSIFSISGQLSAGRRHETTSSIASLI

SEQ ID NO: 15203 - protein, 219 aa, Artificial Sequence; identical to SEQ ID NO: 15202
  Description of Artificial Sequence: Synthetic coding sequence

SEQ ID NO: 15204 - protein, 16 aa, Artificial Sequence
  Description of Artificial Sequence: Synthetic coding sequence
MSEQEAQAPGGRGLPP

SEQ ID NO: 15205 - protein, 230 aa, Artificial Sequence
  Description of Artificial Sequence: Synthetic coding sequence
MVVFGYEAGTKPRDSGVVPVGTEEAPKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 15206 - protein, 200 aa, Artificial Sequence
  Description of Artificial Sequence: Synthetic coding sequence
MAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 15207 - protein, 170 aa, Artificial Sequence
  Description of Artificial Sequence: Synthetic coding sequence
MVVFGYEAGTKPRDSGVVPVGTEEAPKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATK

SEQ ID NO: 15208 - protein, 58 aa, Artificial Sequence
  Description of Artificial Sequence: Synthetic coding sequence
MVVFGYEAGTKPRDSGVVPVGTEEAPKDTKYISNGDIWNNSWFLWNILKLPVQTLLQG

SEQ ID NO: 15209 - protein, 141 aa, Artificial Sequence
  Description of Artificial Sequence: Synthetic coding sequence
MPPFGYKTETSTAVEKKEKPLPRLNIHSGFWILASIVVTYYVDFFKTLKENFHTSSWFLCGSALLLVSLSIAFYCIVYLEWYCGIGEYDVKYPALIPITTASFIAAGICFNIALWHVWSFFTPLLLFTQFMGVVMFITLLG

SEQ ID NO: 15210 - protein, 165 aa, Artificial Sequence
  Description of Artificial Sequence: Synthetic coding sequence
MDSSRARQQLRRRFLLLPDAEAQLDREGDAGPETSTAVEKKEKPLPRLNIHSGFWILASIVVTYYVDFFKTLKENFHTSSWFLCGSALLLVSLSIAFYCIVYLEWYCGIGEYDVKYPALIPITTASFIAAGICFNIALWHVWSFFTPLLLFTQFMGVVMFITLLG

SEQ ID NO: 15211 - protein, 132 aa, Artificial Sequence
  Description of Artificial Sequence: Synthetic coding sequence
MDSSRARQQLRRRFLLLPDAEAQLDREGDAGPETSTAVEKKEKPLPRLNIHSGFWILASIVVTYYVDFFKTLKENFHTSSWFLCGSALLLVSLSIAFYCIVYLEWYCGIGEYDVKYPALIPITTASFIAAGI

SEQ ID NO: 15212 - protein, 165 aa, Artificial Sequence; identical to SEQ ID NO: 15210
  Description of Artificial Sequence: Synthetic coding sequence

SEQ ID NO: 15213 - protein, 362 aa, Artificial Sequence
  Description of Artificial Sequence: Synthetic coding sequence
MDSPEVTFTLAYLVFAVCFVFTPNEFHAAGLTVQNLLSGWLGSEDAAFVPFHLRRTAATLLCHSLLPLGYYVGMCLAASEKRLHALSQAPEAWRLFLLLAVTLPSIACILIYYWSRDRWACHPLARTLALYALPQSGWQAVASSVNTEFRRIDKFATGAPGARVIVTDTWVMKVTTYRVHVAQQQDVHLTVTESRQHELSPDSNLPVQLLTIRVASTNPAVQAFDIWLNSTEYGELCEKLRAPIRRAAHVVIHQSLGDLFLETFASLVEVNPAYSVPSSQELEACIGCMQTRASVKLVKTCQEAATGECQQCYCRPMWCLTCMGKWFASRQDPLRPDTWLASRVPCPTCRARFCILDVCTVR

SEQ ID NO: 15214 - protein, 362 aa, Artificial Sequence; identical to SEQ ID NO: 15213
  Description of Artificial Sequence: Synthetic coding sequence

SEQ ID NO: 15215 - protein, 232 aa, Artificial Sequence
  Description of Artificial Sequence: Synthetic coding sequence
MDSPEVTFTLAYLVFAVCFVFTPNEFHAAGLTVQNLLSGWLGSEDAAFVPFHLRRTAATLLCHSLLPLGYYVGMCLAASEKRLHALSQAPEAWRLFLLLAVTLPSIACILIYYWSRDRWACHPLARTLALYALPQSGWQAVASSVNTEFRRIDKFATGAPGARVIVTDTWVMKVTTYRVHVAQQQDVHLTVTESRQHELSPDSNLPVQLLTIRVASTNPAVQAFDIWSWRPA

SEQ ID NO: 15216 - protein, 423 aa, Artificial Sequence
  Description of Artificial Sequence: Synthetic coding sequence
MAQAVWSRLGRILWLACLLPWAPAGVAAGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 15217 - protein, 321 aa, Artificial Sequence
  Description of Artificial Sequence: Synthetic coding sequence
MAQAVWSRLGRILWLACLLPWAPAGVAAEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 15218 - protein, 435 aa, Artificial Sequence
  Description of Artificial Sequence: Synthetic coding sequence
MAQAVWSRLGRILWLACLLPWAPAGVAAGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVEVADFDFSPMSDKNPEPPSGVRCCCQMCCGPFLLETPSEYLEIVRENHGLLPPLYKSVKTYTV

SEQ ID NO: 15219 - protein, 404 aa, Artificial Sequence
  Description of Artificial Sequence: Synthetic coding sequence
MDPELTGSWGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 15220 - protein, 1883 aa, Artificial Sequence
  Description of Artificial Sequence: Synthetic coding sequence
MGKRAGGGATGATTAAVSTSAGAGLEPAAARSGGPRSAAAGLLGALHLVMTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQDLPKVLNLHLLNSGTKDVPITSVRPTPQNDAITVHFKPITLKASESKYTKVASISFDASKAKKPSQFSGKITVKAKEKSYSKLEIPYQAEVLDGYLGFDHAATLFHIRDSPADPVERPIYLTNTFSFAILIHDVLLPEEAKTMFKVHNFSKPVLILPNESGYIFTLLFMPSTSSMHIDNNILLITNASKFHLPVRVYTGFLDYFVLPPKIEERFIDFGVLSATEASNILFAIINSNPIELAIKSWHIIGDGLSIELVAVERGNRTTIISSLPEFEKSSLSDQSSVTLASGYFAVFRVKLTAKKLEGIHDGAIQITTDYEILTIPVKAVIAVGSLTCFPKHVVLPPSFPGKIVHQSLNIMNSFSQKVKIQQIRSLSEDVRFYYKRLRGNKEDLEPGKKSKIANIYFDPGLQCGDHCYVGLPFLSKSEPKVQPGVAMQEDMWDADWDLHQSLFKGWTGIKENSGHRLSAIFEVNTDLQKNIISKITAELSWPSILSSPRHLKFPLTNTNCSSEEEITLENPADVPVYVQFIPLALYSNPSVFVDKLVSRFNLSKVAKIDLRTLEFQVFRNSAHPLQSSTGFMEGLSRHLILNLILKPGEKKSVKVKFTPVHNRTVSSLIIVRNNLTVMDAVMVQGQGTTENLRVAGKLPGPGSSLRFKITEALLKDCTDSLKLREPNFTLKRTFKVENTGQLQIHIETIEISGYSCEGYGFKVVNCQEFTLSANASRDIIILFTPDFTASRVIRELKFITTSGSEFVFILNASLPYHMLATCAEALPRPNWELALYIIISGIMSALFLLVIGTAYLEAQGIWEPFRRRLSFEASNPPFDVGRPFDLRRIVGISSEGNLNTLSCDPGHSRGFCGAGGSSSRPSAGSHKQCGPSVHPHSSHSNRNSADVENVRAKNSSSTSSRTSAQAASSQSANKTSPLVLDSNTVTQGHTAGRKSKGAKQSQHGSQHHAHSPLEQHPQPPLPPPVPQPQEPQPERLSPAPLAHPSHPERASSARHSSEDSDITSLIEAMDKDFDHHDSPALEVFTEQPPSPLPKSKGKGKPLQRKVKPPKKQEEKEKKGKGKPQEDELKDSLADDDSSSTTTETSNPDTEPLLKEDTEKQKGKQAMPEKHESEMSQVKQKSKKLLNIKKEIPTDVKPSSLELPYTPPLESKQRRNLPSKIPLPTAMTSGSKSRNAQKTKGTSKLVDNRPPALAKFLPNSQELGNTSSSEGEKDSPPPEWDSVPVHKPGSSTDSLYKLSLQTLNADIFLKQRQTSPTPASPSPPAAPCPFVARGSYSSIVNSSSSSDPKIKQPNGSKHKLTKAASLPGKNGNPTFAAVTAGYDKSPGGNGFAKVSSNKTGFSSSLGISHAPVDSDGSDSSGLWSPVSNPSSPDFTPLNSFSAFGNSFNLTGEVFSKLGLSRSCNQASQRSWNEFNSGPSYLWESPATDPSPSWPASSGSPTHTATSVLGNTSGLWSTTPFSSSIWSSNLSSALPFTTPANTLASIGLMGTENSPAPHAPSTSSPADDLGQTYNPWRIWSPTIGRRSSDPWSNSHFPHEN

SEQ ID NO: 15221 - protein, 332 aa, Artificial Sequence
  Description of Artificial Sequence: Synthetic coding sequence
  MOD_RES (1)..(1): Any amino acid
XGLLGALHLVMTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQDLPKVLNLHLLNSGTKDVPITHRRQKSHLSFLGK

SEQ ID NO: 15222 - protein, 322 aa, Artificial Sequence
  Description of Artificial Sequence: Synthetic coding sequence
MTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQDLPKVLNLHLLNSGTKDVPITHRRQKSHLSFLGK

SEQ ID NO: 15223 - protein, 1078 aa, Artificial Sequence
  Description of Artificial Sequence: Synthetic coding sequence
MFGAASRMDTTAVCTGGVTESRGIVDSLQKFSSLPAYLPTNLHISNAEESFFLKEANQDLTRNSSLQARVEPFFIYRARTPPIINASYGPFSVEKIIPQELLLTSTAFGNMDKFPFNWKLKSHILDSSIYSNRPKVQTLFYVTGMGWDDSDLTEDLPCVKMFAFPEAREVAASCRLQGAPGLCVAELELLPEWFSSGLDLEPEEEIPALLGGTTMELFFTLYPADKAGQCPLEEEGKWENNIHSGLESPQQAFPARERIGSVVVYPTQDDLKWSLVSLDENVVISVPLNLVREGDTATFLVSLTSSSVADQFTLRIKAAAGVKITAVRVSSEDQWAVQEEIDNGSTQTSATLTCMGHRPDTQSRVNGSFYEILQVDFGIDNSSDLAGAQQITWQVEYPIEDSMSELVVSEIFVSQTTFVGIVPLAMDTEVLNTAILTGKPVSVPVKVVGVQEDGSVVDVSESVECKSADEDVIKVSNNCDSIFVNGKEMKSKVDTIVNFTHQHFTSQFEVTVWAPRLPLQIEISDTELSQIKGWRIPVAANRRPTRESDDEDDEEKKGRGCSLQYQHATVRVLTQFVAESPDLGQLTYMLGPDWQFDITDLVTEFMKVEEPKIAQLQDGRTLAGREPGITTVQVLSPLSDSILAEKTVIVLDDRVTIAELGVQLVAGMSLSLQPHRADKRAIVSTAAALDVLQSPQQEAIVSSWILFSDGSVTPLDIYDPKDYSVTVSSLDEMVVSVQANLESKWPIVVAEGEGQGPLIKLEMMISEPCQKTKRKSVLAVGKGNVKVKFEPSSDEHQGGSNDIEGINREYKDHLSNSIEREGNQERAVQEWFHRGTPVGQEESTNKSTTPQSPMEGKNKLLKSGGPDAFTSFPTQGKSPDPNNPSDLTVTSRGLTDLEIGMYALLCVFCLAILVFLINCVAFAWKYRHKRFAVSEQGNIPHSHDWVWLGNEVELLENPVDITLPSEECTTMIDRGLQFEERNFLLNGSSQKTFHSQLLRPSDYVYEKEIKNEPMNSSGPKRKRVKFTSYTTILPEDGGPYTNSILFDSDDNIKWVCQDMGLGDSQDFRDYMESLQDQM

SEQ ID NO: 15224 - protein, 1108 aa, Artificial Sequence
  Description of Artificial Sequence: Synthetic coding sequence
MRSEGAAPGPAAPLCGALSLLLGALLGKVIEGHGVTDNIQRFSSLPPYLPVSYHILRAETSFFLKEANQDLLRNSSLQARVESFFTYKTRQPPVLNASYGPFSVEKVVPLDLMLTSNFLGPTNKFSFDWKLKAHILRDKVYLSRPKVQVLFHIMGRDWDDHGAGEKLPCLRVFAFRETREVRGSCRLKGDLGLCVAELELLSSWFSAPTVGAGRKKSMDQPEGTPVELYYTVHPGNERGDCAGGDFRKGNAIRPGKDGLEETTSHLQRIGTVGLYRAQDSAQLSELRLDGNVVIWLPSRPVKQGEVVTAYVTISSNSSVDLFILRAKVKKGVNILSAQTREPRQWGVKQEVGSGGKHVTATVACQRLGPSPRNRSSSLFNEVVQMNFEIASFSSLSGTQPITWQVEYPRKGTTDIAVSEIFVSQKDLVGIVPLAMDTEILNTAVLTGKTVAMPIKVVSVEENSAVMDISESVECKSTDEDVIKVSERCDYIFVNGKEIKGKMDAVVNFTYQYLSAPLCVTVWVPRLPLQIEVSDTELSQIKGWRVPIVTNKRPTRESEDEDEEERRGRGCALQYQHATVRVLTQFVSEGAGPWGQPNYLLSPNWQFDITHLVADFMKLEEPHVATLQDSRVLVGREVGMTTIQVLSPLSDSILAEKTITVLDDKVSVTDLAIQLVAGLSVALYPNAENSKAVTAVVTAEEVLRTPKQEAVFSTWLQFSDGSVTPLDIYDTKDFSLAATSQDEAVVSVPQPRSPRWPVVVAEGEGQGPLIRVDMTIAEACQKSKRKSILAVGVGNVRVKFGQNDADSSPGGDYEEDEIKNHASDRRQKGQHHERTGQDGHLYGSSPVEREEGALRRATTTARSLLDNKVVKNSRADGGRLAGEGQLQNIPIDFTNFPAHVDLPKAGSGLEENDLVQTPRGLSDLEIGMYALLGVFCLAILVFLINCATFALKYRHKQVPLEGQASMTHSHDWVWLGNEAELLESMGDAPPPQDEHTTIIDRGPGACEESNHLLLNGGSHKHVQSQIHRSADSGGRQGREQKQDPLHSPTSKRKKVKFTTFTTIPPDDSCPTVNSIVSSNDEDIKWVCQDVAVGAPKELRNYLEKLKDKA

SEQ ID NO: 15225 - protein, 637 aa, Artificial Sequence
  Description of Artificial Sequence: Synthetic coding sequence
MQRDESSPFPPLFSLTSSQVSDRCDYVFVNGKEMKGKVNVVVNFTYQHLSSPLEMTVWVPRLPLQIEVSDTELNQIKGWRVPIVSSRRPAGDSEEEEDDERRGRGCTLQYQHAMVRVLTQFVAEAAGPGGHLAHLLGSDWQVDITELINDFMQVEEPRIAKLQGGQILMGQELGMTTIQILSPLSDTILAEKTITVLDEKVTITDLGVQLVTGLSLSLQLSPGSNRAIFATAVAQELLQRPKQEAAISCWVQFSDGSVTPLDIYDGKDFSLMATSLDEKVVSIHQDPKFKWPIIAAETEGQGTLVKVEMVISESCQKSKRKSVLAVGTANIKVKFGQNDANPNTSDSRHTGAGVHMENNVSDRRPKKPSQEWGSQEGQYYGSSSMGLMEGRGTTTDRSILQKKKGQESLLDDNSHLQTIPSDLTSFPAQVDLPRSNGEMDGNDLMQASKGLSDLEIGMYALLGVFCLAILVFLINCVTFALKYRHKQVPFEEQEGMSHSHDWVGLSNRTELLENHINFASSQDEQITAIDRGMDFEESKYLLSTNSQKSINGQLFKPLGPIIIDGKDQKSEPPTSPTSKRKRVKFTTFTAVSSDDEYPTRNSIVMSSEDDIKWVCQDLDPGDCKELHNYMERLHENV

SEQ ID NO: 15226 - protein, 1099 aa, Artificial Sequence
  Description of Artificial Sequence: Synthetic coding sequence
MCPSEMGTLWHHWSPVLISLAALFSKVTEGRGILESIQRFSLLPTYLPVTYHINNADVSFFLKEANQDIMRNSSLQSRVESFLIYKSRRLPVLNASYGPFSIEQVVPQDLMLPSNPFGFTNKFSLNWKLKAHILRDKVYLSRPKVQVLFHIMGRDWDDRSAGEKLPCLRVFAFRETREVRGSCRLQGDLGLCVAELELLSSWFSPPTVVAGRRKSVDQPEGTPVELYYTVHPGGERGDCVREDARRSNGIRTGHSDIDESGPPLQRIGSIFLYQTHRKPSLRELRLDNSVAIHYIPKTVRKGDVLTFPVSISRNSTEDRFTLRAKVKKGVNIIGVRASSPSIWDVKERTDYTGKYAPAVIVCQKKAAGSENSADGASYEVMQIDVEVEEPGDLPATQLVTWQVEYPGEITSDLGVSKIYVSPKDLIGVVPLAMEAEILNTAILTGKTVAVPVKVVSVEDDGTVTELLESVECRSSDEDVIKVSDRCDYVFVNGKEMKGKVNVVVNFTYQHLSSPLEMTVWVPRLPLQIEVSDTELNQIKGWRVPIVSSRRPAGDSEEEEDDERRGRGCTLQYQHAMVRVLTQFVAEAAGPGGHLAHLLGSDWQVDITELINDFMQVEEPRIAKLQGGQILMGQELGMTTIQILSPLSDTILAEKTITVLDEKVTITDLGVQLVTGLSLSLQLSPGSNRAIFATAVAQELLQRPKQEAAISCWVQFSDGSVTPLDIYDGKDFSLMATSLDEKVVSIHQDPKFKWPIIAAETEGQGTLVKVEMVISESCQKSKRKSVLAVGTANIKVKFGQNDANPNTSDSRHTGAGVHMENNVSDRRPKKPSQEWGSQEGQYYGSSSMGLMEGRGTTTDRSILQKKKGQESLLDDNSHLQTIPSDLTSFPAQVDLPRSNGEMDGNDLMQASKGLSDLEIGMYALLGVFCLAILVFLINCVTFALKYRHKQVPFEEQEGMSHSHDWVGLSNRTELLENHINFASSQDEQITAIDRGMDFEESKYLLSTNSQKSINGQLFKPLGPIIIDGKDQKSEPPTSPTSKRKRVKFTTFTAVSSDDEYPTRNSIVMSSEDDIKWVCQDLDPGDCKELHNYMERLHENV

SEQ ID NO: 15227 - protein, 984 aa, Artificial Sequence
  Description of Artificial Sequence: Synthetic coding sequence
MAPGMSGRGGAALLCLSALLAHASGRSHPASPSPPGPQASPVLPVSYRLSHTRLAFFLREARPPSPAVANSSLQRSEPFVVFQTKELPVLNVSLGPFSTSQVVARELLQPSSTLDIPERLTVNWKVRAFIVRSHVPASQPVVQVLFYVAGRDWDDFGVTERLPCVRLHAFRDAREHPLLRIGSISLFRPPPRRTLQEHRLDSNLMIRLPDRPLKPGEVLSILLYLAPNSSSPSSPSVEHFTLRVKAKKGVTLLGTKSRSGQWHVTSELLTGAKHSTATVDVAWAQSTPLPPREGQGPLEILQLDFEMENFTSQSVKRRIMWHIDYRGHGALPDLERAVTELTVIQRDVQAILPLAMDTEIINTAILTGRTVAIPVKVIAIEVNGLVLDISALVECESDNEDIIKVSSSCDYVFVSGKESRGSMNARVTFRYDVLNAPLEMTVWVPKLPLHIELSDARLSQVKGWRVPILPDRRSVRESEDEDEEEEERRQSASRGCTLQYQHATLQVFTQFHTTSSEGTDQVVTMLGPDWLVEVTDLVSDFMRVGDPRVAHMVDSSTLAGLEPGTTPFKVVSPLTEAVLGETLLTVTEEKVSITQLQAQVVASLALSLRPSPGSSHTILATTAAQQTLSFLKQEALLSLWLSYSDGTTAPLSLYSPRDYGLLVSSLDEHVATVTQDRAFPLVVAEAEGSGELLRAELTIAESCQKTKRKSVLATTPVGLRVHFGRDEEDPTYDYPGPSQPGPGGGEDEARGAGPPGSALPAPEAPGPGTASPVVPPTEDFLPLPTGFLQVPRGLTDLEIGMYALLGVFCLAILVFLINCIVFVLRYRHKRIPPEGQTSMDHSHHWVFLGNGQPLRVQGELSPPAGNPLETVPAFCHGDHHSSGSSQTSVQSQVHGRGDGSSGGSARDQAEDPASSPTSKRKRVKFTTFTTLPSEELAYDSVPAGEEDEEEEEDLGWGCPDVAGPTRPTAPPDLHNYMRRIKEIA

SEQ ID NO: 15228 - protein, 129 aa, Artificial Sequence
  Description of Artificial Sequence: Synthetic coding sequence
MTSHHCVGPGNHISWSGHEKEHRLDYCPEVTFPLTKGFPLGYTLLFNFASYPFLLPSKIKTLLRNKDSFLNILCPACLLLIRRCNIEYSSTGLNFLNTFTVSLIVTVIPLLQNVPVPLGNNVGKMQVYE

SEQ ID NO: 15229 - protein, 195 aa, Artificial Sequence
  Description of Artificial Sequence: Synthetic coding sequence
MSAARPQFSIDDAFELSLEDGGPGPESSGVARFGPLHFERRARFEVADEDKQSRLRYQNLENDEDGAQASPEPDGGVGTRDSSRTSIRSSQWSFSTISSSTQRSYNTCCSWTQHPLIQKNRRVVLASFLLLLLGLVLILVGVGLEATPSPGVSSAIFFVPGFLLLVPGVYHVIFIYCAVKGHRGFQFFYLPYFEK

SEQ ID NO: 15230 - protein, 180 aa, Artificial Sequence
  Description of Artificial Sequence: Synthetic coding sequence
MSAARPQFSIDDAFELSLEDGGPGPESSGVARFGPLHFERRARFEVADEDKQSRLRYQNLENDEDGAQASPEPDGGVGTRDSSRTSIRSSQWSFSTISSSTQRSYNTCCSWTQHPLIQKNRRVVLASFLLLLLGLGVSSAIFFVPGFLLLVPGVYHVIFIYCAVKGHRGFQFFYLPYFEK

SEQ ID NO: 15231 - protein, 458 aa, Artificial Sequence
  Description of Artificial Sequence: Synthetic coding sequence
MAALSKSIPHNCYEIGHTWHPSCRVSFLQITGGALEESLKIYAPLYLIAAILRKRKLDYYLHKLLPEILQSASFLTANGALYMAFFCILRKILGKFYSWTPGFGAALPASYVAILIERKSRRGLLTIYMANLATETLFRMGVARGTITTLRNGEVLLFCITAAMYMFFFRCKDGLKGFTFSALRFIVGKEEIPTHSFSPEAAYAKVEQKREQHEEKPGRMNMIGLVRKFVDSICKHGPRHRCCKHYEDNCISYCIKGFIRMFSVGYLIQCCLRIPSAFRHLFTQPSRLLSLFYNKENFQLGAFLGSFVSIYKGTSCFLRWIRNLDDELHAIIAGFLAGISMMFYKSTTISMYLASKLVETMYFKGIEAGKVPYFPHADTIIYSISTAICFQAAVMEVQTLRPSYWKFLLRLTKGKFAVMNRKVLDVFGTGASKHFQDFIPRLDPRYTTVTPELPTEFS

SEQ ID NO: 15232 - protein, 436 aa, Artificial Sequence
  Description of Artificial Sequence: Synthetic coding sequence
MAALSKSIPHNCYEIGHTWHPSCRVSFLQITGGALEESLKIYAPLYLIAAILRKRKLDYYLHKLLPEILQSASFLTANGALYMAFFCILRKILGKFYSWTPGFGAALPASYVAILIERKSRRGLLTIYMANLVLLFCITAAMYMFFFRCKDGLKGFTFSALRFIVGKEEIPTHSFSPEAAYAKVEQKREQHEEKPGRMNMIGLVRKFVDSICKHGPRHRCCKHYEDNCISYCIKGFIRMFSVGYLIQCCLRIPSAFRHLFTQPSRLLSLFYNKENFQLGAFLGSFVSIYKGTSCFLRWIRNLDDELHAIIAGFLAGISMMFYKSTTISMYLASKLVETMYFKGIEAGKVPYFPHADTIIYSISTAICFQAAVMEVQTLRPSYWKFLLRLTKGKFAVMNRKVLDVFGTGASKHFQDFIPRLDPRYTTVTPELPTEFS

SEQ ID NO: 15233 - protein, 160 aa, Artificial Sequence
  Description of Artificial Sequence: Synthetic coding sequence
MAALSKSIPHNCYEIGHTWHPSCRVSFLQITGGALEESLKIYAPLYLIAAILRKRKLDYYLHKLLPEILQSASFLTANGALYMAFFCILRKILGKFYSWTPGFGAALPASYVAILIERKSRRGLLTIYMANLMESHCLPQAGVISAPCSLCLPGSRDSPA

SEQ ID NO: 15234 - protein, 319 aa, Artificial Sequence
  Description of Artificial Sequence: Synthetic coding sequence
MGVARGTITTLRNGEVLLFCITAAMYMFFFRCKDGLKGFTFSALRFIVGKEEIPTHSFSPEAAYAKVEQKREQHEEKPGRMNMIGLVRKFVDSICKHGPRHRCCKHYEDNCISYCIKGFIRMFSVGYLIQCCLRIPSAFRHLFTQPSRLLSLFYNKENFQLGAFLGSFVSIYKGTSCFLRWIRNLDDELHAIIAGFLAGISMMFYKSTTISMYLASKLVETMYFKGIEAGKVPYFPHADTIIYSISTAICFQAAVMEVQTLRPSYWKFLLRLTKGKFAVMNRKVLDVFGTGASKHFQDFIPRLDPRYTTVTPELPTEFS

SEQ ID NO: 15235 - protein, 295 aa, Artificial Sequence
  Description of Artificial Sequence: Synthetic coding sequence
MYMFFFRCKDGLKGFTFSALRFIVGKEEIPTHSFSPEAAYAKVEQKREQHEEKPGRMNMIGLVRKFVDSICKHGPRHRCCKHYEDNCISYCIKGFIRMFSVGYLIQCCLRIPSAFRHLFTQPSRLLSLFYNKENFQLGAFLGSFVSIYKGTSCFLRWIRNLDDELHAIIAGFLAGISMMFYKSTTISMYLASKLVETMYFKGIEAGKVPYFPHADTIIYSISTAICFQAAVMEVQTLRPSYWKFLLRLTKGKFAVMNRKVLDVFGTGASKHFQDFIPRLDPRYTTVTPELPTEFS

SEQ ID NO: 15236 - protein, 267 aa, Artificial Sequence
  Description of Artificial Sequence: Synthetic coding sequence
MTQCCFLRVHPLFFWFWSFHHRMALALCLQVLCSLCGWLSLYISFCHLNKHRSYEWSCRLVTFTHGVLSIGLSAYIGFIDGPWPFTHPGSPNTPLQVHVLCLTLGYFIFDLGWCVYFQSEGALMLAHHTLSILGIIMALVLGESGTEVNAVLFGSELTNPLLQMRWFLRETGHYHSFTGDVVDFLFVALFTGVRIGVGACLLFCEMVSPTPKWFVKAGGVAMYAVSWCFMFSIWRFAWRKSIKKYHAWRSRRSEERQLKHNGHLKIH

SEQ ID NO: 15237 - protein, 245 aa, Artificial Sequence
  Description of Artificial Sequence: Synthetic coding sequence
MALALCLQVLCSLCGWLSLYISFCHLNKHRSYEWSCRLVTFTHGVLSIGLSAYIGFIDGPWPFTHPGSPNTPLQVHVLCLTLGYFIFDLGWCVYFQSEGALMLAHHTLSILGIIMALVLGESGTEVNAVLFGSELTNPLLQMRWFLRETGHYHSFTGDVVDFLFVALFTGVRIGVGACLLFCEMVSPTPKWFVKAGGVAMYAVSWCFMFSIWRFAWRKSIKKYHAWRSRRSEERQLKHNGHLKIH

SEQ ID NO: 15238 - protein, 148 aa, Artificial Sequence
  Description of Artificial Sequence: Synthetic coding sequence
MTQCCFLRVHPLFFWFWSFHHRMALALCLQVLCSLCGWLSLYISFCHLNKHRSYEWSCRLVTFTHGVLSIGLSAYIGFIDGPWPFTHPGSPNTPLQVHVLCLTLGYFIFDLGCIWRFAWRKSIKKYHAWRSRRSEERQLKHNGHLKIH

SEQ ID NO: 15239 - protein, 216 aa, Artificial Sequence
  Description of Artificial Sequence: Synthetic coding sequence
MVPMHLLGRLEKPLLLLCCASFLLGLALLGIKTDITPVAYFFLTLGGFFLFAYLLVRFLEWGLRSQLQSMQTESPGPSGNARDNEAFEVPVYEEAVVGLESQCRPQELDQPPPYSTVVIPPAPEEEQPSHPEGSRRAKLEQRRMASEGSMAQEGSPGRAPINLRLRGPRAVSTAPDLQSLAAVPTLEPLTPPPAYDVCFGHPDDDSVFYEDNWAPP

SEQ ID NO: 15240 - protein, 216 aa, Artificial Sequence; identical to SEQ ID NO: 15239
  Description of Artificial Sequence: Synthetic coding sequence

SEQ ID NO: 15241 - protein, 216 aa, Artificial Sequence; identical to SEQ ID NO: 15239
  Description of Artificial Sequence: Synthetic coding sequence

SEQ ID NO: 15242 - protein, 216 aa, Artificial Sequence; identical to SEQ ID NO: 15239
  Description of Artificial Sequence: Synthetic coding sequence

SEQ ID NO: 15243 - protein, 216 aa, Artificial Sequence; identical to SEQ ID NO: 15239
  Description of Artificial Sequence: Synthetic coding sequence

SEQ ID NO: 15244 - protein, 185 aa, Artificial Sequence
  Description of Artificial Sequence: Synthetic coding sequence
MAGPRPRWRDQLLFMSIIVLVIVVICLMFYALLWEAGNLTDLPNLRIGFYNFCLWNEDTSTLQCHQFPELEALGVPRVGLGLARLGVYGSLVLTLFAPQPLLLAQCNSDERAWRLAVGFLAVSSVLLAGGLGLFLSYVWKWVRLSLPGPGFLALGSAQALLILLLIAMAVFPLRAERAESKLESC

SEQ ID NO: 15245 - protein, 148 aa, Artificial Sequence
  Description of Artificial Sequence: Synthetic coding sequence
MAGPRPRWRDQLLFMSIIVLVIVVICLMFYALLWEAGNLTDLPNLRIGFYNFCLWNEDTSTLQCHQFPELEALGVPRVGLGLARLGVYGSLVLTLFFLSYVWKWVRLSLPGPGFLALGSAQALLILLLIAMAVFPLRAERAESKLESC

SEQ ID NO: 15246 - protein, 108 aa, Artificial Sequence
  Description of Artificial Sequence: Synthetic coding sequence
MVNLGLSRVDDAVAAKHPGLGEYAACQSHAFMKGVFTFVTGTGMAFGLQMFIQRKFPYPLQWSLLVAVVAGSVVSYGVTRVESEKCNNLWLFLETGQLPKDRSTDQRS

SEQ ID NO: 15247 - protein, 459 aa, Artificial Sequence
  Description of Artificial Sequence: Synthetic coding sequence
MTVELWLRLRGKGLAMLHVTRGVWGSRVRVWPLLPALLGPPRALSSLAAKMGEYRKMWNPREPRDWAQQYRERFIPFSKEQLLRLLIQEFHSSPAEKAALEAFSAHVDFCTLFHYHQILARLQALYDPINPDRETLDQPSLTDPQRLSNEQEVLRALEPLLAQANFSPLSEDTLAYALVVHHPQDEVQVTVNLDQYVYIHFWALGQRVGQMPLKSSVGSRRGFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 15248 - protein, 359 aa, Artificial Sequence
  Description of Artificial Sequence: Synthetic coding sequence
MTVELWLRLRGKGLAMLHVTRGVWGSRVRVWPLLPALLGPPRALSSLAAKMGEYRKMWNPREPRDWAQQYRERFIPFSKEQLLRLLIQVTVNLDQYVYIHFWALGQRVGQMPLKSSVGSRRGFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 15249 - protein, 424 aa, Artificial Sequence
  Description of Artificial Sequence: Synthetic coding sequence
MTVELWLRLRGKGLAMLHVTRGVWGSRVRVWPLLPALLGPPRALSSLAAKMGEYRKMWNPREPRDWAQQYRERFIPFSKEQLLRLLIQALYDPINPDRETLDQPSLTDPQRLSNEQEVLRALEPLLAQANFSPLSEDTLAYALVVHHPQDEVQVTVNLDQYVYIHFWALGQRVGQMPLKSSVGSRRGFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 15250 - protein, 394 aa, Artificial Sequence
  Description of Artificial Sequence: Synthetic coding sequence
MTVELWLRLRGKGLAMLHVTRGVWGSRVRVWPLLPALLGPPRALSSLAAKMGEYRKMWNPREPRDWAQQYRERFIPFSKEQLLRLLIQEFHSSPAEKAALEAFSAHVDFCTLFHYHQILARLQVTVNLDQYVYIHFWALGQRVGQMPLKSSVGSRRGFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 15251 - protein, 349 aa, Artificial Sequence
  Description of Artificial Sequence: Synthetic coding sequence
MRRRLNDSRALAKALYDPINPDRETLDQPSLTDPQRLSNEQEVLRALEPLLAQANFSPLSEDTLAYALVVHHPQDEVQVTVNLDQYVYIHFWALGQRVGQMPLKSSVGSRRGFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 15252 - protein, 345 aa, Artificial Sequence
  Description of Artificial Sequence: Synthetic coding sequence
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHVINTTQDPCSWVDKLSTVHHRIVGCSLAVISGVLYGSTFVPIIYIKDHSKRNDSIYAGASQYDLDYVFAHFSGIFLTSTVYFLAYCIAMKNSPKLYPEAVLPGFLSGVLWAIATCCWFIANHSLSAVVSFPIITAGPGFIAAMWGIFMFKEIKGLQNYLLMILAFCIILTGALCTAFSKI

SEQ ID NO: 15253 - protein, 77 aa, Artificial Sequence
  Description of Artificial Sequence: Synthetic coding sequence
MSNNGADLTFGYISCFVAILLFGSNFVPLKKFDTGDGMFLQWVLCAAIWLVALVVNLILHCPKFWPFAMLGGCIWAT

SEQ ID NO: 15254 - protein, 110 aa, Artificial Sequence
  Description of Artificial Sequence: Synthetic coding sequence
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASS

SEQ ID NO: 15255 - protein, 137 aa, Artificial Sequence
  Description of Artificial Sequence: Synthetic coding sequence
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVV

SEQ ID NO: 15256 - protein, 77 aa, Artificial Sequence; identical to SEQ ID NO: 15253
  Description of Artificial Sequence: Synthetic coding sequence

SEQ ID NO: 15257 - protein, 87 aa, Artificial Sequence
  Description of Artificial Sequence: Synthetic coding sequence
MSNNGADLTFGYISCFVAILLFGSNFVPLKKFDTGDGMFLQWVLCAAIWLVALVVNLILHCPKFWPFAMLGGCIWATGNIAVVPIIK

SEQ ID NO: 15258 - protein, 167 aa, Artificial Sequence
  Description of Artificial Sequence: Synthetic coding sequence
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHVI

SEQ ID NO: 15259 - protein, 10 aa, Artificial Sequence
  Description of Artificial Sequence: Synthetic coding sequence
MSNNGADLTF

SEQ ID NO: 15260 - protein, 87 aa, Artificial Sequence; identical to SEQ ID NO: 15257
  Description of Artificial Sequence: Synthetic coding sequence

SEQ ID NO: 15261 - protein, 169 aa, Artificial Sequence
  Description of Artificial Sequence: Synthetic coding sequence
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHVSIV

SEQ ID NO: 15262 - protein, 91 aa, Artificial Sequence
  Description of Artificial Sequence: Synthetic coding sequence
MSNNGADLTFGYISCFVAILLFGSNFVPLKKFDTGDGMFLQWVLCAAIWLVALVVNLILHCPKFWPFAMLGGCIWATGNIAVVPIIKTIGL

SEQ ID NO: 15263 - protein, 493 aa, Artificial Sequence
  Description of Artificial Sequence: Synthetic coding sequence
MEPLRAPALRRLLPPLLLLLLSLPPRARAKYVRGNLSSKEDWVFLTRFCFLSDYGRLDFRFRYPEAKCCQNILLYFDDPSQWPAVYKAGDKDCLAKESVIRPENNQVINLTTQYAWSGCQVVSEEGTRYLSCSSGRSFRSGDGLQLEYEMVLTNGKSFWTRHFSADEFGILETDVTFLLIFILIFFLSCYFGYLLKGRQLLHTTYKMFMAAAGVEVLSLLFFCIYWGQYATDGIGNESVKILAKLLFSSSFLIFLLMLILLGKGFTVTRGRISHAGSVKLSVYMTLYTLTHVVLLIYEAEFFDPGQVLYTYESPAGYGLIGLQVAAYVWFCYAVLVSLRHFPEKQPFYVPFFAAYTLWFFAVPVMALIANFGIPKWAREKIVNGIQLGIHLYAHGVFLIMTRPSAANKNFPYHVRTSQIASAGVPGPGGSQSADKAFPQHVYGNVTFISDSVPNFTELFSIPPPATSPLPRAAPDSGLPLFRDLRPPGPLRDL

SEQ ID NO: 15264 - protein, 467 aa, Artificial Sequence
  Description of Artificial Sequence: Synthetic coding sequence
RLRHCTPTWATEPDSVKKKRNRKRSGAVAHNCNLKHFGRPRWEDHLCPGIWDQRGNIIEFLTGEFIYRMYTIDMHSQLELTASLIPQPGTSLIPLVMVSNPHSLGFQATFYENGYTSDGNTKYKLDIFLKQQQHWGRTDSNFTSSLKKATMSTLTVDIANKEISCVDIKPLSTLISVGCDLDKKIVIQNKVSACSMGILDPLTLQDNYSFIIEKEFYDPGFQGQQSSEDLHVFYSYQQLGCPLLVYYDTLWKPVVELWRKDSFQEVIDAEYVLLEVNGQFSYSYSLTAQSAMCTSQPQNWTTMIKEFGGPFFWNRENYVSCHDPNNNAPLRWPDVQYQILGGRTANQIIFGHNGFYVFYISIVDPYYSYCQLETIFSIYVYGAFPVQLVSAGVVILLIISSILGSVWLAYKTPKLLRTARGRRIKKCATQLCRRCKTVCQFRASATARAGTEPPGRHRTPHGGRSDH

SEQ ID NO: 15265 - protein, 359 aa, Artificial Sequence
  Description of Artificial Sequence: Synthetic coding sequence
MFRSPGTLEILTPLRDTAFPAFDFQKCLVNIQALLMDPELHVGKCKIEFLTGEFIYRMYTIDMHSQLELTASLIPQPGTSLIPLVMVSNPHSLGFQATFYENGYTSDGNTKYKLDIFLKQQQHWGRTDSNFTSSLKKATMSTLTVDIANKEISCVDIKPLSTLISVGCDLDKKIVIQNKVSACSMGILDPLTLQDNYSFIIEKEFYDPGFQGQQSSEDLHVFYSYQQLGCPLLVYYDTLWKPVVELLESSGMNTVHCSLNLPGSSGPPASASQVAGTAVAYHNARLIFFFFFFFFFLRQSLALSPRLECSGVILAHRKLCLPGSRHSPASASRVAGITGARHCARLIFFIFSRDRVSPC

SEQ ID NO: 15266 - protein, 798 aa, Artificial Sequence
  Description of Artificial Sequence: Synthetic coding sequence
MLMLMLVAAVTMWLRPLVTAQLCRSRTVRTGKVFNLIQDVQGDRLYFHPTTTRLIKHPCEKNIALYLGKQVFFTMDNFETSLLPFTIPTSMQVGVPEVTSAHFAGSLLLLVVDQKVYIYDYENNSWSMSLGIKHPVTHVSGDNCCYTGSLFCVHVSNLVFAYFRGDQISQTYIYYSNTGGFSFWKYHYDRQAEIIGSLGGIFHFFSLSQVAMLVVNQGKGMFKYSDHPLNRSFGLSFDYNGTLDILIAPGQRGILLLWFENSLLFSHNAGQLVDTVRVKKGDQTLFSSIFEAKITIHNIAVTENELAVITREDNLYYGNLGIVPSSIIKFADQYIWSEDVALMFRSPGTLEILTPLRDTAFPAFDFQKCLVNIQALLMDPELHVGKCKIEFLTGEFIYRMYTIDMHSQLELTASLIPQPGTSLIPLVMVSNPHSLGFQATFYENGYTSDGNTKYKLDIFLKQQQHWGRTDSNFTSSLKKATMSTLTVDIANKEISCVDIKPLSTLISVGCDLDKKIVIQNKVSACSMGILDPLTLQDNYSFIIEKEFYDPGFQGQQSSEDLHVFYSYQQLGCPLLVYYDTLWKPVVELWRKDSFQEVIDAEYVLLEVNGQFSYSYSLTAQSAMCTSQPQNWTTMIKEFGGPFFWNRENYVSCHDPNNNAPLRWPDVQYQILGGRTANQIIFGHNGFYVFYISIVDPYYSYCQLETIFSIYVYGAFPVQLVSAGVVILLIISSILGSVWLAYKTPKLLRTARGRRIKKCATQLCRRCKTVCQFRASATARAGTEPPGRHRTPHGGRSDH

SEQ ID NO: 15267 - protein, 224 aa, Artificial Sequence
  Description of Artificial Sequence: Synthetic coding sequence
MTLFHFGNCFALAYFPYFITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 15268 - protein, 175 aa, Artificial Sequence
  Description of Artificial Sequence: Synthetic coding sequence
MLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 15269 - protein, 184 aa, Artificial Sequence
  Description of Artificial Sequence: Synthetic coding sequence
MTLFHFGNCFALAYFPYFITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVME

SEQ ID NO: 15270 - protein, 31 aa, Artificial Sequence
  Description of Artificial Sequence: Synthetic coding sequence
MRPGWSHLPLCPTLQDAVLGHFLSHLGRRHL

SEQ ID NO: 15271 - protein, 99 aa, Artificial Sequence
  Description of Artificial Sequence: Synthetic coding sequence
MDLIGFGYAALVTFGSIFGYKRRGGVPSLIAGLFVGCLAGYGAYRVSNDKRDVKVSLFTAFFLATIMGVRFKRSKKIMPAGLVAGLSLMMILRLVLLLL

SEQ ID NO: 15272 - protein, 80 aa, Artificial Sequence
  Description of Artificial Sequence: Synthetic coding sequence
MEKPLFPLVPLHWFGFGYTALVVSGGIVGYVKTAATSVTFVGVMGMRSYYYGKFMPVGLIAGASLLMAAKVGVRMLMTSD

SEQ ID NO: 15273 - protein, 114 aa, Artificial Sequence
  Description of Artificial Sequence: Synthetic coding sequence
MEKPLFPLVPLHWFGFGYTALVVSGGIVGYVKTGSVPSLAAGLLFGSLAGLGAYQLYQDPRNVWGFLAATSVTFVGVMGMRSYYYGKFMPVGLIAGASLLMAAKVGVRMLMTSD

SEQ ID NO: 15274 - protein, 114 aa, Artificial Sequence; identical to SEQ ID NO: 15273
  Description of Artificial Sequence: Synthetic coding sequence

SEQ ID NO: 15275 - protein, 135 aa, Artificial Sequence
  Description of Artificial Sequence: Synthetic coding sequence
MEKPLFPLVPLHWFGFGYTALVVSGGIVGYVKTGSVPSLAAGLLFGSLAGLGAYQLYQDPRNVWGFLAATSVTFVGVMGMRSYYYGKFMPVGLIAGARYFHSITLLYHVEFSLLPRILYAFKTLLVSEYLMLCIN

SEQ ID NO: 15276 - protein, 112 aa, Artificial Sequence
  Description of Artificial Sequence: Synthetic coding sequence
MQDTGSVVPLHWFGFGYAALVASGGIIGYVKAGSVPSLAAGLLFGSLAGLGAYQLSQDPRNVWVFLATSGTLAGIMGMRFYHSGKFMPAGLIAGASLLMVAKVGVSMFNRPH

SEQ ID NO: 15277 - protein, 104 aa, Artificial Sequence
  Description of Artificial Sequence: Synthetic coding sequence
MQDTGSVVPLHWFGFGYAALVASGGIIGYVKAGSVPSLAAGLLFGSLAGLGAYQVSGSKERLGFPSYIWYLGWHYGNEVLPLWKIHACRFNCRCQFADGRQSWS

SEQ ID NO: 15278 - protein, 112 aa, Artificial Sequence; identical to SEQ ID NO: 15276
  Description of Artificial Sequence: Synthetic coding sequence

SEQ ID NO: 15279 - protein, 125 aa, Artificial Sequence
  Description of Artificial Sequence: Synthetic coding sequence
MQMDPGPQVPLYWLGFVYAALAALGGISGYAKVGSVQSPSAGFFFSELAGLDASQPSRNPKEHLSSPVYIWDLARYYANKILTLWNIYACGFSCRCLLIVSKLGSMYGEQILSVVAMSQLGLMKN

SEQ ID NO: 15280 - protein, 218 aa, Artificial Sequence
  Description of Artificial Sequence: Synthetic coding sequence
MYALWRTGPTTSPALLTLLSKGVPRPAAPWTMSPSSVALICLLRYGQLLEQSRHSWVNTTALITGCTNAAGLLVVGNFQVDHARSLHYVGAGVAFPAGLLFVCLHCALSYQGATAPLDLAVAYLRSVLAVIAFITLVLSGVFFVHESSQLQHGAALCEWVCVIDILIFYGTFSYEFGAVSSDTLVAALQPTPGRACKSSGSSSTSTHLNCAPESIAMI

SEQ ID NO: 15281 - protein, 271 aa, Artificial Sequence
  Description of Artificial Sequence: Synthetic coding sequence
MTAWILLPVSLSAFSITGIWTVYAMAVMNHHVCPVENWSYNESCPPDPAEQGGPKTCCTLDDVPLISKCGSYPPESCLFSLIGNMGAFMVALICLLRYGQLLEQSRHSWVNTTALITGCTNAAGLLVVGNFQVDHARSLHYVGAGVAFPAGLLFVCLHCALSYQGATAPLDLAVAYLRSVLAVIAFITLVLSGVFFVHESSQLQHGAALCEWVCVIDILIFYGTFSYEFGAVSSDTLVAALQPTPGRACKSSGSSSTSTHLNCAPESIAMI

SEQ ID NO: 15282 - protein, 271 aa, Artificial Sequence; identical to SEQ ID NO: 15281
  Description of Artificial Sequence: Synthetic coding sequence

SEQ ID NO: 15283 - protein, 67 aa, Artificial Sequence
  Description of Artificial Sequence: Synthetic coding sequence
MYALWRTGPTTSPALLTLLSKGVPRPAAPWTMSPSSVALICLLRYGQLLEQSRHSWVNTTALITGCT

SEQ ID NO: 15284 - protein, 233 aa, Artificial Sequence
  Description of Artificial Sequence: Synthetic coding sequence
MWGYLSLMPVFLAVWAISGVWIVFAIAVTNRTVDLSKGFPYISICGSFPPQSCIFSQVLNMGAALAAWICIVRYHQLRDWGVRRWPNQLILWTGLLCALGTSVVGNFQEKNQRPTHLAGAFLAFILGNVYFWLQLLLWRLKRLPQPGAAWIGPLRLGLCSVCTILIVAMIVLHACSLRSVSAACEWVVAMLLFALFGLLAVDFSALESCTLCVQPWPSLSPPPASPISLPVQL

SEQ ID NO: 15285 - protein, 233 aa, Artificial Sequence; identical to SEQ ID NO: 15284
  Description of Artificial Sequence: Synthetic coding sequence

SEQ ID NO: 15286 - protein, 249 aa, Artificial Sequence
  Description of Artificial Sequence: Synthetic coding sequence
MDGKKCSVWMFLPLVFTLFTSAGLWIVYFIAVEDDKILPLNSAERKPGVKHAPYISIAGDDPPASCVFSQVMNMAAFLALVVAVLRFIQLKPKVLNPWLNISGLVALCLASFGMTLLGNFQLTNDEEIHNVGTSLTFGFGTLTCWIQAALTLKVNIKNEGRRVGIPRVILSASITLCVVLYFILMAQSIHMYAARVQWGLVMCFLSYFGTFAVEFRHYRYEIVCSEYQENFLSFSESLSEASEYQTDQV

SEQ ID NO: 15287 - protein, 67 aa, Artificial Sequence
  Description of Artificial Sequence: Synthetic coding sequence
MDGKKCSVWMFLPLVFTLFTSAGLWIVYFIAVEDDKILPLNSAERKPGVKHAPYISIAGDDPPASCV

SEQ ID NO: 15288 - protein, 249 aa, Artificial Sequence; identical to SEQ ID NO: 15286
  Description of Artificial Sequence: Synthetic coding sequence

SEQ ID NO: 15289 - protein, 468 aa, Artificial Sequence
  Description of Artificial Sequence: Synthetic coding sequence
MPEDGAGDGGEVPALIPDGEPLREEQRPLKQSLGSSLCRESHWKCLLLTLLIHACGAVVAWCRLATVPRLVLGPEAALARGAGGPPPTYPASPCSDGYLYIPLAFVSLLYLLYLAECWHCHVRSCQAPRTDAHTVLALIRRLQQAPPCVWWKATSYHYVRRTRQITRYRNGDAYTTTQVYHERADSRTARGEFDYSAHGVRDVSKELVGLAEHAATRLRFTKCFSFGSAEAEASYLTQRARFFSANEGLDDYLEAREGMHLKDVDFRESLMVFADPRSPPWYARAWVFWLVSAATLSWPLRVVAAYGTAHVHYQVEKLFGASSPPPGAVPSGPPLSRVATVDFTELEWHICSNRQLVPSYSEAVVMGAGSGAYLRGCQRCRRSVSSNSLPPARPSGPRLPFSRSRLSLGAGGRATPGVFRSLSGGPLGRRGEDTEPLESPPCYEDALYFPVLIVHGDSGCQGDGQGAL

SEQ ID NO: 15290 - protein, 222 aa, Artificial Sequence
  Description of Artificial Sequence: Synthetic coding sequence
MSPPGSAAGESAAGGGGGGGGPGVSEELTAAAAAAAADEGPAREEQRPIQPSFTKSLCRESHWKCLLLSLLMYGCLGAVAWCHVTTVTRLTFSSAYQGNSLMYHDSPCSNGYVYIPLAFLLMLYAVYLVECWHCQARHELQHRVDVSSVRERVGRMQQATPCIWWKAISYHYVRRTRQVTRYRNGDAYTTTQVPGCLGSQVVPLRSPWRNAQLDAGSDEEPA

SEQ ID NO: 15291 - protein, 566 aa, Artificial Sequence
  Description of Artificial Sequence: Synthetic coding sequence
MSPPGSAAGESAAGGGGGGGGPGVSEELTAAAAAAAADEGPAREEQRPIQPSFTKSLCRESHWKCLLLSLLMYGCLGAVAWCHVTTVTRLTFSSAYQGNSLMYHDSPCSNGYVYIPLAFLLMLYAVYLVECWHCQARHELQHRVDVSSVRERVGRMQQATPCIWWKAISYHYVRRTRQVTRYRNGDAYTTTQVYHERVNTHVAEAEFDYARCGVRDVSKTLVGLEGAPATRLRFTKCFSFASVEAENAYLCQRARFFAENEGLDDYMEAREGMHLKNVDFREFMVAFPDPARPPWYACSSAFWAAALLTLSWPLRVLAEYRTAYAHYHVEKLFGLEGPGSASSAGGGLSPSDELLPPLTHRLPRVNTVDSTELEWHIRSNQQLVPSYSEAVLMDLAGLGTRCGGAGGGYAPSCRYGGVGGPGAAGVAPYRRSCEHCQRAVSSSSIFSRSALSICASPRAGPGPGGGAGCGGSRFSLGRLYGSRRSCLWRSRSGSVNEASCPTEQTRLSSQASMGDDEDDDEEEAGPPPPYHDALYFPVLIVHRQEGCLGHSHRPLHRHGSCVETSL

SEQ ID NO: 15292 - protein, 183 aa, Artificial Sequence
  Description of Artificial Sequence: Synthetic coding sequence
MQAPRAALVFALVIALVPVGRGNYEELENSGDTTVESERPNKVTIPSTFAAVTIKETLNANINSTNFAPDENQLEFILMVLIPLILLVLLLLSVVFLATYYKRKRTKQEPSSQGSQSALQTYELGSENVKVPIFEEDTPSVMEIEMEELDKWMNSMNRNADFECLPTLKEEKESNHNPSDSES

SEQ ID NO: 15293 - protein, 125 aa, Artificial Sequence
  Description of Artificial Sequence: Synthetic coding sequence
MQAPRAALVFALVIALVPVGRGNYEELENSGDTTVESERPNKVTIPSTFAAVTIKETLNANINSTNFAPDENQLEFILMVLIPLILLVLLLLSVVFLATYYKRKRTKQEPSSQGSQSALQTYLLV

SEQ ID NO: 15294 - protein, 296 aa, Artificial Sequence
  Description of Artificial Sequence: Synthetic coding sequence
MTKTALLKLFVAIVITFILILPEYFKTPKERTLELSCLEVCLQSNFTYSLSSLNFSFVTFLQPVRETQIIMRIFLNPSNFRNFTRTCQDITGEFKMCSSCLVCESKGNMDFISQEQTSKVLIRRGSMEVKANDFHSPCQHFNFSVAPLVDHLEEYNTTCHLKNHTGRSTIMEDEPSKEKSINYTCRIMEYPNDCIHISLHLEMDIKNITCSMKITWYILVLLVFIFLIILTIRKILEGQRRVQKWQSHRDKPTSVLLRGSDSEKLRALNVQVLSAETTQRLPLDQVQEVLPPIPEL

SEQ ID NO: 15295 - protein, 188 aa, Artificial Sequence
  Description of Artificial Sequence: Synthetic coding sequence
MGGGWWWARAARLARLRFRRSLLPPQRPRSGGARGSFAPGHGPRAGASPPPVSELDRADAWLLRKAHETAFLSWFRNGLLASGIGVISFMQSDMGREAAYGFFLLGGLCVVWGSASYAVGLAALRGPMQLTLGGAAVGAGAVLAASLLWACAVGLYMGQLELDVELVPEDDGTASAEGPDEAGRPPPE

SEQ ID NO: 15296 - protein, 479 aa, Artificial Sequence
  Description of Artificial Sequence: Synthetic coding sequence
MAVLGVQLVVTLLTATLMHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 15297 - protein, 376 aa, Artificial Sequence
  Description of Artificial Sequence: Synthetic coding sequence
MAVLGVQLVVTLLTATLMHRLAPHCSFARWLLCNGSLFRYKHPSEEELRALAGKPRPRGRKERWANGLSEEKPLSVPRDAPFQLETCPLTTVDALGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 15298 - protein, 487 aa, Artificial Sequence
  Description of Artificial Sequence: Synthetic coding sequence
MGVIGIQLVVTMVMASVMQKIIPHYSLARWLLCNGSLRWYQHPTEEELRILAGKQQKGKTKKDRKYNGHIESKPLTIPKDIDLHLETKSVTEVDTLALHYFPEYQWLVDFTVAATVVYLVTEVYYNFMKPTQEMNISLVWCLLVLSFAIKVLFSLTTHYFKVEDGGERSVCVTFGFFFFVKAMAVLIVTENYLEFGLETGFTNFSDSAMQFLEKQGLESQSPVSKLTFKFFLAIFCSFIGAFLTFPGLRLAQMHLDALNLATEKITQTLLHINFLAPLFMVLLWVKPITKDYIMNPPLGKESIPLMTEATFDTLRLWLIILLCALRLAMMRSHLQAYLNLAQKCVDQMKKEAGRISTVELQKMVARVFYYLCVIALQYVAPLVMLLHTTLLLKTLGNHSWGIYPESISTLPVDNSLLSNSVYSELPSAEGKMKVTVTQITVALSSLKNIFTPLLFRGLLSFLTWWIAACLFSTSLFGLFYHQYLTVA

SEQ ID NO: 15299 - protein, 307 aa, Artificial Sequence
  Description of Artificial Sequence: Synthetic coding sequence
MGVIGIQLVVTMVMASVMQKIIPHYSLARWLLCNGSLRWYQHPTEEELRILAGKQQKGKTKKDRKYNGHIESKPLTIPKDIDLHLETKSVTEVDTLALHYFPEYQWLVDFTVAATVVYLVTEVYYNFMKPTQEMNISLVWCLLVLSFAIKVLFSLTTHYFKVEDGGERSVCVTFGFFFFVKAMAVLIVTENYLEFGLETGFTNFSDSAMQFLEKQGLESQSPVSKLTFKFFLAIFCSFIGAFLTFPGLRLAQMHLDALNLATEKITQTLLHINFLAPLFMVLLWVKPITKDYIMNPPLGKEISPSGR

SEQ ID NO: 15300 - protein, 289 aa, Artificial Sequence
  Description of Artificial Sequence: Synthetic coding sequence
MEPAAGIQRRSSQGPTVPPPPRGHAPPAAAPGPAPLSSPVREPPQLEEERQVRISESGQFSDGLEDRGLLESSTRLKPHEAQNYRKKALWVSWFSIIVTLALAVAAFTVSVMRYSASAFGFAFDAILDVLSSAIVLWRYSNAAAVHSAHREYIACVILGVIFLLSSICIVVKAIHDLSTRLLPEVDDFLFSVSILSGILCSILAVLKFMLGKVLTSRALITDGFNSLVGGVMGFSILLSAEVFKHDSAVWYLDGSIGVLIGLTIFAYGVKLLIDMVPRVRQTRHYEMFE

SEQ ID NO: 15301 - protein, 92 aa, Artificial Sequence
  Description of Artificial Sequence: Synthetic coding sequence
CGMSRSGLLESSTRLKPHEAQNYRKKALWVSWFSIIVTLALAVAAFTVSVMRYSASAFGFAFDAILDVLSSAIVLWRYSNAAAVHSAHREYM

SEQ ID NO: 15302 - protein, 258 aa, Artificial Sequence
  Description of Artificial Sequence: Synthetic coding sequence
MSRYSYQSLLDWLYGGVDPSFAGNGGPDCAAFLSWQQRLLESVVVLTLALLEILVALRHILRQTKEDGRGSPGSQPEQVTQRPEEGKESLSKNLLLVALCLTFGVEVGFKFATKTVIYLLNPCHLVTMMHLPFELEIYYIQHVMLYVVPIYLLWKGGAYTPEPLSSFRWALLSTGLMFFYHFSVLQILGLVTEVNLNNMLCPAISDPFYGPWYRIWASGHQTLMTMTHGKLVILFSYMAGPLCKYLLDLLRLPAKKID

SEQ ID NO: 15303 - protein, 297 aa, Artificial Sequence [sequence omitted]

SEQ ID NO: 15304 - protein, 148 aa, Artificial Sequence
  Description of Artificial Sequence: Synthetic coding sequence
MHMLNGALLALLFPVVNTRLLPFELEIYYIQHVMLYVVPIYLLWKGGAYTPEPLSSFRWALLSTGLMFFYHFSVLQILGLVTEVNLNNMLCPAISDPFYGPWYRIWASGHQTLMTMTHGKLVILFSYMAGPLCKYLLDLLRLPAKKID

SEQ ID NO: 15305 - protein, 297 aa, Artificial Sequence [sequence omitted]

SEQ ID NO: 15306 - protein, 258 aa, Artificial Sequence; identical to SEQ ID NO: 15302
  Description of Artificial Sequence: Synthetic coding sequence

SEQ ID NO: 15307 - protein, 324 aa, Artificial Sequence
  Description of Artificial Sequence: Synthetic coding sequence
MAAAAPGNGRASAPRLLLLFLVPLLWAPAAVRAGPDEDLSHRNKEPPAPAQQLQPQPVAVQGPEPARVEKIFTPAAPVHTNKEDPATQTNLGFIHAFVAAISVIIVSELGDKTFFIAAIMAMRYNRLTVLAGAMLALGLMTCLSVLFGYATTVIPRVYTYYVSTVLFAIFGIRMLREGLKMSPDEGQEELEEVQAELKKKDEEFQRTKLLNGPGDVETGTSITVPQKKWLHFISPIFVQALTLTFLAEWGDRSQLTTIVLAAREDPYGVAVGGTVGHCLCTGLAVIGGRMIAQKISVRTVTIIGGIVFLAFAFSALFISPDSGF

SEQ ID NO: 15308 - protein, 261 aa, Artificial Sequence
  Description of Artificial Sequence: Synthetic coding sequence
MEIPMQKIFTPAAPVHTNKEDPATQTNLGFIHAFVAAISVIIVSELGDKTFFIAAIMAMRYNRLTVLAGAMLALGLMTCLSVLFGYATTVIPRVYTYYVSTVLFAIFGIRMLREGLKMSPDEGQEELEEVQAELKKKDEEFQRTKLLNGPGDVETGTSITVPQKKWLHFISPIFVQALTLTFLAEWGDRSQLTTIVLAAREDPYGVAVGGTVGHCLCTGLAVIGGRMIAQKISVRTVTIIGGIVFLAFAFSALFISPDSGF

SEQ ID NO: 15309 - protein, 72 aa, Artificial Sequence
  Description of Artificial Sequence: Synthetic coding sequence
MSAIFNFQSLLTVILLLICTCAYIRSLAPSLLDRNKTGLLGIFWKCARIGERKSPYVAVCCIVMAFSILFIQ

SEQ ID NO: 15310 - protein, 74 aa, Artificial Sequence
  Description of Artificial Sequence: Synthetic coding sequence
MTNVYSLDGILVFGLLFVCTCAYFKKVPRLKTWLLSEKKGVWGVFYKAAVIGTRLHAAVAIACVVMAFYVLFIK

SEQ ID NO: 15311 - protein, 697 aa, Artificial Sequence
  Description of Artificial Sequence: Synthetic coding sequence
MCKSLRYCFSHCLYLAMTRLEEVNREVNMHSSVRYLGYLARINLLVAICLGLYVRWEKTANSLILVIFILGLFVLGIASILYYYFSMEAASLSLSNLWFGFLLGLLCFLDNSSFKNDVKEESTKYLLLTSIVLRILCSLVERISGYVRHRPTLLTTVEFLELVGFAIASTTMLVEKSLSVILLVVALAMLIIDLRMKSFLAIPNLVIFAVLLFFSSLETPKNPIAFACFFICLITDPFLDIYFSGLSVTERWKPFLYRGRICRRLSVVFAGMIELTFFILSAFKLRDTHLWYFVIPGFSIFGIFWMICHIIFLLTLWGFHTKLNDCHKVYFTHRTDYNSLDRIMASKGMRHFCLISEQLVFFSLLATAILGAVSWQPTNGIFLSMFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 15312 - protein, 313 aa, Artificial Sequence
  Description of Artificial Sequence: Synthetic coding sequence
MFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 15313 - protein, 697 aa, Artificial Sequence; identical to SEQ ID NO: 15311
  Description of Artificial Sequence: Synthetic coding sequence

SEQ ID NO: 15314 - protein, 297 aa, Artificial Sequence
  Description of Artificial Sequence: Synthetic coding sequence
MEEPTAVEGQVQLPSPHQGSLRKAVAAALALDGESTMGHRKKKRKESRPESIIIYRSDNEKTDEEPGESEGGDQPKEEEGDDFLDYPVDDDMWNLPLDSRYVTLTGTITRGKKKGQMVDIHVTLTEKELQELTKPKESSRETTPEGRMACQMGADRGPHVVLWTLICLPVVFILSFVVSFYYGTITWYNIFLVYNEERTFWHKISYCPCLVLFYPVLIMAMASSLGLYAAVVQLSWSWEAWWQAARDMEKGFCGWLCSKLGLEDCSPYSIVELLESDNISSTLSNKDPIQEVETSTV

SEQ ID NO: 15315 - protein, 297 aa, Artificial Sequence; identical to SEQ ID NO: 15314
  Description of Artificial Sequence: Synthetic coding sequence

SEQ ID NO: 15316 - protein, 116 aa, Artificial Sequence
  Description of Artificial Sequence: Synthetic coding sequence
MEEPTAVEGQVQLPSPHQGSLRKAVAAALALDGESTMGHRKKKRKESRPESIIIYRSDNEKTDEEPGESEGGDQPKEEEGDDFLDYPVDDDMWNLPLDSRYVTLTGTITRGKKKGQ

SEQ ID NO: 15317 - protein, 297 aa, Artificial Sequence; identical to SEQ ID NO: 15314
  Description of Artificial Sequence: Synthetic coding sequence

SEQ ID NO: 15318 - protein, 297 aa, Artificial Sequence; identical to SEQ ID NO: 15314
  Description of Artificial Sequence: Synthetic coding sequence

SEQ ID NO: 15319 - protein, 102 aa, Artificial Sequence
  Description of Artificial Sequence: Synthetic coding sequence
MEEPTAVEGQVQLPSPHQGSLRKAVAAALALDGESTMGHRKKKRKESRPESIIIYRSDNEKTDEEPGESEGGDQPKEEEGDDFLDYPVDDDMWNLPLDSRYV

SEQ ID NO: 15320 - protein, 198 aa, Artificial Sequence
  Description of Artificial Sequence: Synthetic coding sequence
MELPDPVRQRLGNFSRAVFSDSNRTGPESNEGPENEMVSSLALQMSLYFNTYYFPLWWVSSIMMLHMKYSILPDYYKFIVITVIILITLIEAIRLYLGYVGNLQEKVPELAGFWLLSLLLQLPLILFLLFNEGLTNLPLEKAIHIIFTLFLAFQVVAAFLTLRKMVNQLAVRFHLQDFDRLSANRGDMRRMRSCIEEI

SEQ ID NO: 15321 - protein, 144 aa, Artificial Sequence
  Description of Artificial Sequence: Synthetic coding sequence
MEREGSGGSGGSAGLLQQILSLKVVPRVGNGTLCPNSTSLCSFPEMWYGVFLWALVSSLFFHVPAGLLALFTLRHHKYGRFMSVSILLMGIVGPITAGILTSAAIAGVYRAAGKEMIPFEALTLGTGQTFCVLVVSFLRILATL

SEQ ID NO: 15322 - protein, 144 aa, Artificial Sequence; identical to SEQ ID NO: 15321
  Description of Artificial Sequence: Synthetic coding sequence

SEQ ID NO: 15323 - protein, 132 aa, Artificial Sequence
  Description of Artificial Sequence: Synthetic coding sequence
MKAEGGDHSMINLSVQQVLSLWAHGTVLRNLTEMWYWIFLWALFSSLFVHGAAGVLMFVMLQRHRQGRVISVIAVSIGFLASVTGAMITSAAVAGIYRVAGKNMAPLEALVWGVGQTVLTLIISFSRILATL

SEQ ID NO: 15324 - protein, 132 aa, Artificial Sequence; identical to SEQ ID NO: 15323
  Description of Artificial Sequence: Synthetic coding sequence

SEQ ID NO: 15325 - protein, 323 aa, Artificial Sequence
  Description of Artificial Sequence: Synthetic coding sequence
MSPAAAAEPDGDQQDRHVSKLIFCFFVFGAVLLCVGVLLSIFGFQACQYKPLPDCPMVLKVAGPACAVVGLGAVILARSRAQLQLRAGLQRGQQMDPDRAFICGESRQFAQCLIFGFLFLTSGMLISVLGIWVPGCGSNWAQEPLNETDTGDSEPRMCGFLSLQIMGPLIVLVGLCFFVVAHVKKRNTLNAGQDASEREEGQIQIMEPVQVTVGDSVIIFPPPPPPYFPESSASAVAESPGTNSLLPNENPPSYYSIFNYGTPTSEGAASERDCESIYTISGTNSSSEASHTPHLPSELPPRYEEKENAAATFLPLSSEPSPP

SEQ ID NO: 15326 - protein, 324 aa, Artificial Sequence
  Description of Artificial Sequence: Synthetic coding sequence
MSPAAAAEPDGDQQDRHVSKLIFCFFVFGAVLLCVGVLLSIFGFQACQYKPLPDCPMVLKVAGPACAVVGLGAVILARSRAQLQLRAGLQRGQQMDPDRAFICGESRQFAQCLIFGFLFLTSGMLISVLGIWVPGCGSNWAQEPLNETDTGDSEPRMCGFLSLQIMGPLIVLVGLCFFVVAHVKKRNTLNAGQDASEREEGQIQIMEPVQVTVGDSVIIFPPPPPPYFPESSASAVAESPGTNSLLPNENPPSYYSIFNYGRTPTSEGAASERDCESIYTISGTNSSSEASHTPHLPSELPPRYEEKENAAATFLPLSSEPSPP

SEQ ID NO: 15327 - protein, 243 aa, Artificial Sequence
  Description of Artificial Sequence: Synthetic coding sequence
MEQGSGRLEDFPVNVFSVTPYTPSTADIQVSDDDKAGATLLFSGIFLGLVGITFTVMGWIKYQGVSHFEWTQLLGPVLLSVGVTFILIAVCKFKMLSCQLCKESEERVPDSEQTPGGPSFVFTGINQPITFHGATVVQYIPPPYGSPEPMGINTSYLQSVVSPCGLITSGGAAAAMSSPPQYYTIYPQDNSAFVVDEGCLSFTDGGNHRPNPDVDQLEETQLEEEACACFSPPPYEEIYSLPR

SEQ ID NO: 15328 - protein, 504 aa, Artificial Sequence
  Description of Artificial Sequence: Synthetic coding sequence
MSQPRTPEQALDTPGDCPPGRRDEDAGEGIQCSQRMLSFSDALLSIIATVMILPVTHTEISPEQQFDRSVQRLLATRIAVYLMTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 15329 - protein, 265 aa, Artificial Sequence
  Description of Artificial Sequence: Synthetic coding sequence
MTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICAPHRFAAPPAPFGWLLLPSSVCSSAASSASSSVRARVSSQSSRFWFLWGFFFFFLRQSCCVAQAGV

SEQ ID NO: 15330 - protein, 134 aa, Artificial Sequence
  Description of Artificial Sequence: Synthetic coding sequence
MSQPRTPEQALDTPGDCPPGRRDEDAGEGIQCSQRMLSFSDALLSIIATVMILPVTHTEISPEQQFDRSVQRLLATRIAVYLMTFLIVTVAWAAHTRLFQVVGKTDDTLALLNLACMMTITFLPYTFSLMVTFP

SEQ ID NO: 15331 - protein, 388 aa, Artificial Sequence
  Description of Artificial Sequence: Synthetic coding sequence
MMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 15332 - protein, 235 aa, Artificial Sequence
  Description of Artificial Sequence: Synthetic coding sequence
MGTADSDEMAPEAPQHTHIDVHIHQESALAKLLLTCCSALRPRATQARGSSRLLVASWVMQIVLGILSAVLGGFFYIRDYTLLVTSGAAIWTGAVAVLAGAAAFIYEKRGGTYWALLRTLLTLAAFSTAIAALKLWNEDFRYGYSYYNSACRISSSSDWNTPAPTQSPEEVRRLHLCTSFMDMLKALFRTLQAMLLGVWILLLLASLTPLWLYCWRMFPTKGKRDQKEMLEVSGI

SEQ ID NO: 15333 - protein, 235 aa, Artificial Sequence; identical to SEQ ID NO: 15332
  Description of Artificial Sequence: Synthetic coding sequence

SEQ ID NO: 15334 - protein, 270 aa, Artificial Sequence
  Description of Artificial Sequence: Synthetic coding sequence
MTQNTVIVNGVAMASRPSQPTHVNVHIHQESALTQLLKAGGSLKKFLFHPGDTVPSTARIGYEQLALGVTQILLGVVSCVLGVCLSLGPWTVLSASGCAFWAGSVVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 15335 - protein, 270 aa, Artificial Sequence; identical to SEQ ID NO: 15334
  Description of Artificial Sequence: Synthetic coding sequence

SEQ ID NO: 15336 - protein, 270 aa, Artificial Sequence; identical to SEQ ID NO: 15334
  Description of Artificial Sequence: Synthetic coding sequence

SEQ ID NO: 15337 - protein, 270 aa, Artificial Sequence; identical to SEQ ID NO: 15334
  Description of Artificial Sequence: Synthetic coding sequence

SEQ ID NO: 15338 - protein, 233 aa, Artificial Sequence
  Description of Artificial Sequence: Synthetic coding sequence
MTQNTVIVNGVAMASRPSQPTHVNVHIHQESALTQLLKAGGSLKKFLFHPGDTVPSTARIGYEQLALGVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 15339 - protein, 270 aa, Artificial Sequence; identical to SEQ ID NO: 15334
  Description of Artificial Sequence: Synthetic coding sequence

SEQ ID NO: 15340 - protein, 270 aa, Artificial Sequence; identical to SEQ ID NO: 15334
  Description of Artificial Sequence: Synthetic coding sequence

SEQ ID NO: 15341 - protein, 311 aa, Artificial Sequence
  Description of Artificial Sequence: Synthetic coding sequence
MAGPLWRTAAFVQRHRTGLLVGSCAGLFGVPISYHLFPDPVVQWLYQYWPQGQPAPLPPQLQSLFQEVLQDIGVPSGHCYKPFTTFTFQPVSAGFPRLPAGAVVGIPASFLGDLVINTNHPVVIHGHTVDWRSPAGARLRASLTLSREAQKFALAREVVYLESSTTAVHALLAPACLAGTWALGVGAKYTLGLHAGPMNLRAAFSLVAAVAGFVAYAFSQDSLTHAVESWLDRRTASLSAAYACGGVEFYEKLLSGNLALRSLLGKDGEKLYTPSGNIVPRHLFRIKHLPYTTRRDSVLQMWRGMLNPGRS

SEQ ID NO: 15342 - protein, 311 aa, Artificial Sequence; identical to SEQ ID NO: 15341
  Description of Artificial Sequence: Synthetic coding sequence

SEQ ID NO: 15343 - protein, 250 aa, Artificial Sequence
  Description of Artificial Sequence: Synthetic coding sequence
MAGPLWRTAAFVQRHRTGLLVGSCAGLFGVPISYHLFPDPVVQWLYQYWPQGQPAPLPPQLQSLFQEVLQDIGVPSGHCYKPFTTFTFQPVSAGFPRLPAGAVVGIPASFLGDLVINTNHPVVIHGHTVDWRSPAGARLRASLTLSREAQKFALAREVVYLESSTTAVHALLAPACLAGTWALGVGAKYTLGLHAGPMNLRAASLSAAYACGGVEFYEKLLSGNLALRSLLGKDGEKLQMWRGMLNPGRS

SEQ ID NO: 15344 - protein, 311 aa, Artificial Sequence; identical to SEQ ID NO: 15341
  Description of Artificial Sequence: Synthetic coding sequence

SEQ ID NO: 15345 - protein, 114 aa, Artificial Sequence
  Description of Artificial Sequence: Synthetic coding sequence
MAGPLWRTAAFVQRHRTGLLVGSCAGLFGVPISYHLFPDPVVQWLYQYWPQGQPAPLPPQLQSLFQEVLQDIGVPSGHCYKPFTTFTFQPVSAGFPRLPAGAVVGIPASFLGDL

SEQ ID NO: 15346 - protein, 297 aa, Artificial Sequence
  Description of Artificial Sequence: Synthetic coding sequence
MEPRALVTALSLGLSLCSLGLLVTAIFTDHWYETDPRRHKESCERSRAGADPPDQKNRLMPLSHLPLRDSPPLGRRLLPGGPGRADPESWRSLLGLGGLDAECGRPLFATYSGLWRKCYFLGIDRDIDTLILKGIAQRCTAIKYHFSQPIRLRNIPFNLTKTIQQDEWHLLHLRRITAGFLGMAVAVLLCGCIVATVSFFWEESLTQHVAGLLFLMTGIFCTISLCTYAASISYDLNRLPKLIYSLPADVEHGYSWSIFCAWCSLGFIVAAGGLCIAYPFISRTKIAQLKSGRDSTV

SEQ ID NO: 15347 - protein, 111 aa, Artificial Sequence
  Description of Artificial Sequence: Synthetic coding sequence
MEPRALVTALSLGLSLCSLGLLVTAIFTDHWYETDPRRHKESCERSRAGADPPDQKNRLMPLSHLLGPLEEVLLPGHRPGHRHPHPERYCAAMHGHQVPLFSAHPLAKHSF

SEQ ID NO: 15348 - protein, 197 aa, Artificial Sequence
  Description of Artificial Sequence: Synthetic coding sequence
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQVGGSGQEGRLAMLGGGHLLLDIC

SEQ ID NO: 15349 - protein, 233 aa, Artificial Sequence
  Description of Artificial Sequence: Synthetic coding sequence
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQFGLWASWLAWLAITTLAFLKVYHNYRQEDLLDSLIHEKELLLARPSPRTSFQEEKSAVI

SEQ ID NO: 15350 - protein, 219 aa, Artificial Sequence
  Description of Artificial Sequence: Synthetic coding sequence
MALSWLQRVELALFAAAFLCGAVAAAAMTRTQGSFSGRCPLYGVATLNGSSLALSRPSAPSLCYFVAGASGLLALYCLLLLLFWIYSSCIEDSHRGAIGLRIALAISAIAVFLVLVSACILRFGTRSLCNSIISLNTTISCSEAQKIPWTPPGTALQFYSNLHNAETSSWVNLVLWCVVLVLQVVQWKSEATPYRPLERGDPEWSSETDALVGSRLSHS

SEQ ID NO: 15351 - protein, 517 aa, Artificial Sequence
  Description of Artificial Sequence: Synthetic coding sequence
MGLGQPQAWLLGLPTAVVYGSLALFTTILHNVFLLYYVDTFVSVYKINKMAFWVGETVFLLWNSLNDPLFGWLSDRQFLSSQPRSGAGLSSRAVVLARVQALGWHGPLLALSFLAFWVPWAPAGLQFLLCLCLYDGFLTLVDLHHHALLADLALSAHDRTHLNFYCSLFSAAGSLSVFASYAFWNKEDFSSFRAFCVTLAVSSGLGFLGATQLLRRRVEAARKDPGCSGLVVDSGLCGEELLVGSEEADSITLGRYLRQLARHRNFLWFVSMDLVQVFHCHFNSNFFPLFLEHLLSDHISLSTGSILLGLSYVAPHLNNLYFLSLCRRWGVYAVVRGLFLLKLGLSLLMLLAGPDHLSLLCLFIASNRVFTEGTCKLLTLVVTDLVDEDLVLNHRKQAASALLFGMVALVTKPGQTFAPLLGTWLLCFYTGHDLFQQSLITPVGSAHPWPEPPAPAPAQAPTLRQGCFYLLVLVPITCALLQLFTWSQFTLHGRRLHMVKAQRQNLSQAQTLDVKMV

SEQ ID NO: 15352 - protein, 246 aa, Artificial Sequence
  Description of Artificial Sequence: Synthetic coding sequence
MDLVQVFHCHFNSNFFPLFLEHLLSDHISLSTGSILLGLSYVAPHLNNLYFLSLCRRWGVYAVVRGLFLLKLGLSLLMLLAGPDHLSLLCLFIASNRVFTEGTCKLLTLVVTDLVDEDLVLNHRKQAASALLFGMVALVTKPGQTFAPLLGTWLLCFYTGHDLFQQSLITPVGSAHPWPEPPAPAPAQAPTLRQGCFYLLVLVPITCALLQLFTWSQFTLHGRRLHMVKAQRQNLSQAQTLDVKMV

SEQ ID NO: 15353 - protein, 246 aa, Artificial Sequence; identical to SEQ ID NO: 15352
  Description of Artificial Sequence: Synthetic coding sequence

SEQ ID NO: 15354 - protein, 153 aa, Artificial Sequence
  Description of Artificial Sequence: Synthetic coding sequence
MGLGQPQAWLLGLPTAVVYGSLALFTTILHNVFLLYYVDTFVSVYKINKMAFWVGETVFLLWNSLNDPLFGWLSDRQFLSSQPRLCGEELLVGSEEADSITLGRYLRQLARHRNFLWFVSMDLVQVQWLTPVIPALRDAKVERPLEPRSSRLQ

SEQ ID NO: 15355 - protein, 315 aa, Artificial Sequence [sequence omitted]

SEQ ID NO: 15356 - protein, 133 aa, Artificial Sequence
  Description of Artificial Sequence: Synthetic coding sequence
MRGEHNSTSYDSAVIYRGFWAVLMLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGWHIQIHH

SEQ ID NO: 15357 - protein, 229 aa, Artificial Sequence
  Description of Artificial Sequence: Synthetic coding sequence
MRLNIAIFFGALFGALGVLLFLVAFGSDYWLLATEVGRCSGEKNIENVTFHHEGFFWRCWFNGIVEENDSNIWKFWYTNQPPSKNCTHAYLSPYPFMRGEHNSTSYDSAVIYRGFWAVLMLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGWHIQIHH

SEQ ID NO: 15358 - protein, 376 aa, Artificial Sequence
  Description of Artificial Sequence: Synthetic coding sequence
MARGPGPLGRPRPDTVAMPKRGKRLKFRAHDACSGRVTVADYANSDPAVVRSGRVKKAVANAVQQEVKSLCGLEASQVPAEEALSGAGEPCDIIDSSDEMDAQEESIHERTVSRKKKSKRHKEELDGAGGEEYPMDIWLLLASYIRPEDIVNFSLICKNAWTVTCTAAFWTRLYRRHYTLDASLPLRLRPESMEKLRCLRACVIRSLYHMYEPFAARISKNPAIPESTPSTLKNSKCLLFWCRKIVGNRQEPMWEFNFKFKKQSPRLKSKCTGGLQPPVQYEDVHTNPDQDCCLLQVTTLNFIFIPIVMGMIFTLFTINVSTDMRHHRVRLVFQDSPVHGGRKLRSEQGVQVILDPVHSVRLFDWWHPQYPFSLRA

SEQ ID NO: 15359 - protein, 413 aa, Artificial Sequence
  Description of Artificial Sequence: Synthetic coding sequence
MSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPIKSSCLYGTCCLRGMTYSIGFLRFCKQATLQFCLVKPVMAVTTIILQAFGKYHDGDFNVRSGYLYVTLIYNASVSLALYALFLFYFTTRELLRPFQPVLKFLTIKAVIFLSFWQGLLLAILERCGVIPEVETSGGNKLGAGTLAAGYQNFIICVEMLFASVALRYAFPCQVYAEKKENSPAPPAPMQSISSGIRETVSPQDIVQDAIHNFSPAYQHYTQQATHEAPRPGTHPSGGSGGSRKSRSLEKRMLIPSEDL

SEQ ID NO: 15360 - protein, 175 aa, Artificial Sequence
  Description of Artificial Sequence: Synthetic coding sequence
MSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPIKSSCLYGTCCLRGMTYS

SEQ ID NO: 15361 - protein, 139 aa, Artificial Sequence
  Description of Artificial Sequence: Synthetic coding sequence
MSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLC

SEQ ID NO: 15362 - protein, 158 aa, Artificial Sequence
  Description of Artificial Sequence: Synthetic coding sequence
MSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPI

SEQ ID NO: 15363 - protein, 407 aa, Artificial Sequence
  Description of Artificial Sequence: Synthetic coding sequence
MTVRGDVLAPDPASPTTAAASPSVSVIPEGSPTAMEQPVFLMTTAAQAISGFFVWTALLITCHQIYMHLRCYSCPNEQRYIVRILFIVPIYAFDSWLSLLFFTNDQYYVYFGTVRDCYEALVIYNFLSLCYEYLGGESSIMSEIRGKPIESSCMYGTCCLWGKTYSIGFLRFCKQATLQFCVVKPLMAVSTVVLQAFGKYRDGDFDVTSGYLYVTIIYNISVSLALYALFLFYFATRELLSPYSPVLKFFMVKSVIFLSFWQGMLLAILEKCGAIPKIHSARVSVGEGTVAAGYQDFIICVEMFFAALALRHAFTYKVYADKRLDAQGRCAPMKSISSSLKETMNPHDIVQDAIHNFSPAYQQYTQQSTLEPGPTWRGGAHGLSRSHSLSGARDNEKTLLLSSDDEF

SEQ ID NO: 15364 - protein, 407 aa, Artificial Sequence; identical to SEQ ID NO: 15363
  Description of Artificial Sequence: Synthetic coding sequence

SEQ ID NO: 15365 - protein, 139 aa, Artificial Sequence
  Description of Artificial Sequence: Synthetic coding sequence
MHLRCYSCPNEQRYIVRILFIVPIYAFDSWLSLLFFTNDQYYVYFGTVRDCYEALVIYNFLSLCYEYLGGESSIMSEIRGKPIESSCMYGTCCLWGKTYSIGFLRFCKQATLQFCVVKPLMAVSTVVLQAFGKYRDGDF

SEQ ID NO: 15366 - protein, 72 aa, Artificial Sequence
  Description of Artificial Sequence: Synthetic coding sequence
MTVRGDVLAPDPASPTTAAASPSVSVIPEGSPTAMEQPVFLMTTAAQAISGFFVWTALLITCHQPRARLGQV

SEQ ID NO: 15367 - protein, 350 aa, Artificial Sequence
  Description of Artificial Sequence: Synthetic coding sequence
MNPRGLFQDFNPSKFLIYTCLLLFSVLLPLRLDGIIQWSYWAVFAPIWLWKLLVVAGASVGAGVWARNPRYRTEGEACVEFKAMLIAVGIHLLLLMFEVLVCDRVERGTHFWLLVFMPLFFVSPVSVAACVWGFRHDRSLELEILCSVNILQFIFIALKLDRIIHWPWLVVFVPLWILMSFLCLVVLYYIVWSLLFLRSLDVVAEQRRTHVTMAISWITIVVPLLTFEVLLVHRLDGHNTFSYVSIFVPLWLSLLTLMATTFRRKGGNHWWFGIRRDFCQFLLEIFPFLREYGNISYDLHHEDSEDAEETSVPEAPKIAPIFGKKARVVITQSPGKYVPPPPKLNIDMPD

SEQ ID NO: 15368 - protein, 213 aa, Artificial Sequence
  Description of Artificial Sequence: Synthetic coding sequence
MAALLRAVRRFRGKAVWERPLHGLWCCSGQEDPKRWVGSSSPISKEKLPNAETEKFWMFYRFDAIRTFGFLSRLKLAQTALTVVALPPGYYLYSQGLLTLNTVCLMSGISGFALTMLCWMSYFLRRLVGILYLNESGTMLRVAHLNFWGWRQDTYCPMADVIPLTETKDRPQEMFVRIQRYSGKQTFYVTLRYGRILDRERFTQVFGVHQMLK

SEQ ID NO: 15369 - protein, 261 aa, Artificial Sequence
  Description of Artificial Sequence: Synthetic coding sequence
MNPEWGQAFVHVAVAGGLCAVAVFTGIFDSVSVQVGYEHYAEAPVAGLPAFLAMPFNSLVNMAYTLLGLSWLHRGGAMGLGPRYLKDVFAAMALLYGPVQWLRLWTQWRRAAVLDQWLTLPIFAWPVAWCLYLDRGWRPWLFLSLECVSLASYGLALLHPQGFEVALGAHVVAAVGQALRTHRHYGSTTSATYLALGVLSCLGFVVLKLCDHQLARWRLFQCLTGHFWSKVCDVLQFHFAFLFLTHFNTHPRFHPSGGKTR

SEQ ID NO: 15370 - protein, 66 aa, Artificial Sequence
  Description of Artificial Sequence: Synthetic coding sequence
MNPEWGQAFVHVAVAGGLCAVAVFTGIFDSVSVQVGYEHYAEAPVAGLPAFLAMPFNSLVNMAYTL

SEQ ID NO: 15371 - protein, 33 aa, Artificial Sequence
  Description of Artificial Sequence: Synthetic coding sequence
MNPEWGQAFVHVAVAGGLCAVAVFTGIFDSVSV

SEQ ID NO: 15372 - protein, 47 aa, Artificial Sequence
  Description of Artificial Sequence: Synthetic coding sequence
MNSLEQAEDLKAFERRLTEYIHCLQPATGRWRSVLLHIIMESPIFHH

SEQ ID NO: 15373 - protein, 125 aa, Artificial Sequence
  Description of Artificial Sequence: Synthetic coding sequence
MNSLEQAEDLKAFERRLTEYIHCLQPATGRWRMLLIVVSVCTATGAWNWLIDPETQKVSFFTSLWNHPFFTISCITLIGLFFAGIHKRVVAPSIIAARCRTVLAEYNMSCDDTGKLILKPRPHVQ

SEQ ID NO: 15374 - protein, 142 aa, Artificial Sequence
  Description of Artificial Sequence: Synthetic coding sequence
MNSLEQAEAPRVVSLIPAVVSGNCQDLKAFERRLTEYIHCLQPATGRWRMLLIVVSVCTATGAWNWLIDPETQKVSFFTSLWNHPFFTISCITLIGLFFAGIHKRVVAPSIIAARCRTVLAEYNMSCDDTGKLILKPRPHVQ

SEQ ID NO: 15375 - protein, 267 aa, Artificial Sequence
  Description of Artificial Sequence: Synthetic coding sequence
MAGAENWPGQQLELDEDEASCCRWGAQHAGARELAALYSPGKRLQEWCSVILCFSLIAHNLVHLLLLARWEDTPLVILGVVAGALIADFLSGLVHWGADTWGSVELPIAFIRPFREHHIDPTAITRHDFIETNGDNCLVTLLPLLNMAYKFRTHSPEALEQLYPWECFVFCLIIFGTFTNQIHKWSHTYFGLPRWVTLLQDWHVILPRKHHRIHHVSPHETYFCITTGWLNYPLEKIGFWRRLEDLIQGLTGEKPRADDMKWAQKIK

SEQ ID NO: 15376 - protein, 270 aa, Artificial Sequence
  Description of Artificial Sequence: Synthetic coding sequence
MAGAENWPGQQLELDEDEASCCRWGAQHAGARELAALYSPGKRLQEWCSVILCFSLIAHNLVHLLLLARWEDTPLVILGVVAGALIADFLSGLVHWGADTWGSVELPIVGKAFIRPFREHHIDPTAITRHDFIETNGDNCLVTLLPLLNMAYKFRTHSPEALEQLYPWECFVFCLIIFGTFTNQIHKWSHTYFGLPRWVTLLQDWHVILPRKHHRIHHVSPHETYFCITTGWLNYPLEKIGFWRRLEDLIQGLTGEKPRADDMKWAQKIK

SEQ ID NO: 15377 - protein, 195 aa, Artificial Sequence
  Description of Artificial Sequence: Synthetic coding sequence
MNERAIAGALIADFLSGLVHWGADTWGSVELPIVGKAFIRPFREHHIDPTAITRHDFIETNGDNCLVTLLPLLNMAYKFRTHSPEALEQLYPWECFVFCLIIFGTFTNQIHKWSHTYFGLPRWVTLLQDWHVILPRKHHRIHHVSPHETYFCITTGWLNYPLEKIGFWRRLEDLIQGLTGEKPRADDMKWAQKIK

SEQ ID NO: 15378 - protein, 370 aa, Artificial Sequence
  Description of Artificial Sequence: Synthetic coding sequence
MAGAENWPGQQLELDEDEASCCRWGAQHAGARELAALYSPGKRLQEWCSVILCFSLIAHNLVHLLLLARWEDTPLVILGVVAGALIADFLSGLVHWGADTWGSVELPIVGKAFIRPFREHHIDPTAITRHDFIETNGDNCLVTLLPLLNMAYKFRTHSPEALEQLYPWECFVFCLIIFGTFTNQIHKWSHTYFGLPRWVTLLQDWHVILPRKHHRIHHVSPHETYFCITTGVKVPRNFRLLEELEEGQKGVGDGTVSWGLEDDEDMTLTRWTGMIIGPPRTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 15379 - protein, 336 aa, Artificial Sequence
  Description of Artificial Sequence: Synthetic coding sequence
MTDLNDNICKRYIKMITNIVILSLIICISLAFWIISMTASTYYGNLRPISPWRWLFSVVVPVLIVSNGLKKKSLDHSGALGGLVVGFILTIANFSFFTSLLMFFLSSSKLTKWKGEVKKRLDSEYKEGGQRNWVQVFCNGAVPTELALLYMIENGPGEIPVDFSKQYSASWMCLSLLAALACSAGDTWASEVGPVLSKSSPRLITTWEKVPVGTNGGVTVVGLVSSLLGGTFVGIAYFLTQLIFVNDLDISAPQWPIIAFGGLAGLLGSIVDSYLGATMQYTGLDESTGMVVNSPTNKARHIAGKPILDNNAVNLFSSVLIALLLPTAAWGFWPRG

SEQ ID NO: 15380 - protein, 336 aa, Artificial Sequence; identical to SEQ ID NO: 15379
  Description of Artificial Sequence: Synthetic coding sequence

SEQ ID NO: 15381 - protein, 298 aa, Artificial Sequence
  Description of Artificial Sequence: Synthetic coding sequence
MTDLNDNICKRYIKMITNIVILSLIICISLAFWIISMTASTYYGNLRPISPWRWLFSVVVPVLIVSNGLKKKSLDHSGALGGLVVGFILTIANFSFFTSLLMFFLSSSKLTKWKGEVKKRLDSEYKEGGQRNWVQVFCNGAVPTELALLYMIENGPGEIPVDFSKQYSASWMCLSLLAALACSAGDTWASEVGPVLSKSSPRLITTWEKVPVGTNGGVTVVGLVSSLLGGTFVGIAYFLTQLIFVNDLDISAPQWPIIAFGGLAGLLGSIVDSYLGATMQYTGKNIPSFLQLIGMLKK

SEQ ID NO: 15382 - protein, 170 aa, Artificial Sequence
  Description of Artificial Sequence: Synthetic coding sequence
MTDLNDNICKRYIKMITNIVILSLIICISLAFWIISMTASTYYGNLRPISPWRWLFSVVVPVLIVSNGLKKKSLDHSGALGGLVVGFILTIANFSFFTSLLMFFLSSSKLTKWKGEVKKRLDSEYKEGGQRNWVQVFCNGAVPTELALLYMIENGPGEIPVDFSKQYSAS

SEQ ID NO: 15383 - protein, 152 aa, Artificial Sequence
  Description of Artificial Sequence: Synthetic coding sequence
  MOD_RES (1)..(1): Any amino acid
XDTWASEVGPVLSKSSPRLITTWEKVPVGTNGGVTVVGLVSSLLGGTFVGIAYFLTQLIFVNDLDISAPQWPIIAFGGLAGLLGSIVDSYLGATMQYTGLDESTGMVVNSPTNKARHIAGKPILDNNAVNLFSSVLIALLLPTAAWGFWPRG

SEQ ID NO: 15384 - protein, 177 aa, Artificial Sequence
  Description of Artificial Sequence: Synthetic coding sequence
MLGCGIPALGLLLLLQGSADGNGIQGFFYPWSCEGDIWDRESCGGQAAIDSPNLCLRLRCCYRNGVCYHQRPDENVRRKHMWALVWTCSGLLLLSCSICLFWWAKRRDVLHMPGFLAGPCDMSKSVSLLSKHRGTKKTPSTGSVPVALSKESRDVEGGTEGEGTEEGEETEGEEEED

SEQ ID NO: 15385 - protein, 271 aa, Artificial Sequence
  Description of Artificial Sequence: Synthetic coding sequence
MAAGGRMEDGSLDITQSIEDDPLLDAQLLPHHSLQAHFRPRFHPLPTVIIVNLLWFIHLVFVVLAFLTGVLCSYPNPNEDKCPGNYTNPLKVQTVIILGKVILWILHLLLECYIQYHHSKIRNRGYNLIYRSTRHLKRLALMIQSSGNTVLLLILCMQHSFPEPGRLYLDLILAILALELICSLICLLIYTVKIRRFNKAKPEPDILEEEKIYAYPSNITSETGFRTISSLEEIVEKQGDTIEYLKRHNALLSKRLLALTSSDLGCQPSRT

SEQ ID NO: 15386 - protein, 267 aa, Artificial Sequence
  Description of Artificial Sequence: Synthetic coding sequence
MNKATGSLDITQSIEDDPLLDAQLLPHHSLQAHFRPRFHPLPTVIIVNLLWFIHLVFVVLAFLTGVLCSYPNPNEDKCPGNYTNPLKVQTVIILGKVILWILHLLLECYIQYHHSKIRNRGYNLIYRSTRHLKRLALMIQSSGNTVLLLILCMQHSFPEPGRLYLDLILAILALELICSLICLLIYTVKIRRFNKAKPEPDILEEEKIYAYPSNITSETGFRTISSLEEIVEKQGDTIEYLKRHNALLSKRLLALTSSDLGCQPSRT

SEQ ID NO: 15387 - protein, 444 aa, Artificial Sequence
  Description of Artificial Sequence: Synthetic coding sequence
MAGGMKVAVSPAVGPGPWGSGVGGGGTVRLLLILSGCLVYGTAETDVNVVMLQESQVCEKRASQQFCYTNVLIPKWHDIWTRIQIRVNSSRLVRVTQVENEEKLKELEQFSIWNFFSSFLKEKLNDTYVNVGLYSTKTCLKVEIIEKDTKYSVIVIRRFDPKLFLVFLLGLMLFFCGDLLSRSQIFYYSTGMTVGIVASLLIIIFILSKFMPKKSPIYVILVGGWSFSLYLIQLVFKNLQEIWRCYWQYLLSYVLTVGFMSFAVCYKYGPLENERSINLLTWTLQLMGLCFMYSGIQIPHIALAIIIIALCTKNLEHPIQWLYITCRKVCKGAEKPVPPRLLTEEEYRIQGEVETRKALEELREFCNSPDCSAWKTVSRIQSPKRFADFVEGSSHLTPNEVSVHEQEYGLGSIIAQDEIYEEASSEEEDSYSRCPAITQNNFLT

SEQ ID NO: 15388 - protein, 371 aa, Artificial Sequence
  Description of Artificial Sequence: Synthetic coding sequence
MAGGMKVAVSPAVGPGPWGSGVGGGGTVRLLLILSGCLVYGTAETDVNVVMLQESQVCEKRASQQFCYTNVLIPKWHDIWTRIQIRVNSSRLVRVTQVENEEKLKELEQSQIFYYSTGMTVGIVASLLIIIFILSKFMPKKSPIYVILVGGWSFSLYLIQLVFKNLQEIWRCYWQYLLSYVLTVGFMSFAVCYKYGPLENERSINLLTWTLQLMGLCFMYSGIQIPHIALAIIIIALCTKNLEHPIQWLYITCRKVCKGAEKPVPPRLLTEEEYRIQGEVETRKALEELREFCNSPDCSAWKTVSRIQSPKRFADFVEGSSHLTPNEVSVHEQEYGLGSIIAQDEIYEEASSEEEDSYSRCPAITQNNFLT

SEQ ID NO: 15389 - protein, 172 aa, Artificial Sequence
  Description of Artificial Sequence: Synthetic coding sequence
MCTSGQIIGSLLVLSVLEIGLGVSSVAVGAVSFSLALREHKPQLGDSSPFLLCGICGILCAKKKSGLVMILFSACCICGLIGGILNFQFLRAVTKKTSSLYPLHLASMSLACIGIGGCTLSSWLTCRLASYEQRRMFSEREHSLHHSHEMAEKEITDNMSNGGPQLIFNGRV

SEQ ID NO: 15390 - protein, 89 aa, Artificial Sequence
  Description of Artificial Sequence: Synthetic coding sequence
MILFSACCICGLIGGILNFQFLRAVTKKTSSLYPLHLASMSLACIGIGGCTLSSWLTCRLASYEQRRMFSEREHSLHHSHEMAEKIEGY

SEQ ID NO: 15391 - protein, 360 aa, Artificial Sequence
  Description of Artificial Sequence: Synthetic coding sequence
MPGTVATLRFQLLPPEPDDAFWGAPCEQPLERRYQALPALVCIMCCLFGVVYCFFGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLLSLMGVLVQWRVTAEGDSHTEVVISRQRRRVQLMRIRQQEDRKEKRRKKRPPRAPLRGPRAPPRPGPPDPAYRRRPVPIKRFNGDVLSPSYIQSFRDRQTGSSLSSFMASPTDADYEYGSRGPLTACSGPPVRV

SEQ ID NO: 15392 - protein, 360 aa, Artificial Sequence; identical to SEQ ID NO: 15391
  Description of Artificial Sequence: Synthetic coding sequence

SEQ ID NO: 15393 - protein, 227 aa, Artificial Sequence
  Description of Artificial Sequence: Synthetic coding sequence
MPGTVATLRFQLLPPEPDDAFWGAPCEQPLERRYQALPALVCIMCCLFGVVYCFFGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLL

SEQ ID NO: 15394 - protein, 208 aa, Artificial Sequence
  Description of Artificial Sequence: Synthetic coding sequence
MASSLLAGERLVRALGPGGELEPERLPRKLRAELEAALGKKHKGGDSSSGPQRLVSFRLIRDLHQHLRERDSKLYLHELLEGSEIYLPEVVKPPRNPELVARLEKIKIQLANEEYKRITRNVTCQDTRHGGTLSDLGKQVRSLKALVITIFNFIVTVVAAFVCTYLGSQYIFTEMASRVLAALIVASVVGLAELYVMVRAMEGELGEL

SEQ ID NO: 15395 - protein, 299 aa, Artificial Sequence [sequence omitted]

SEQ ID NO: 15396 - protein, 491 aa, Artificial Sequence
  Description of Artificial Sequence: Synthetic coding sequence
MIATGGVITGLAALKRQDSARSQQHVNLSPSPATQEKKPIRRRPRADVVVVRGKIRLYSPSGFFLILGVLISIIGIAMAVLGYWPQKEHFIDAETTLSTNETQVIRNEGGVVVRFFEQHLHSDKMKMLGPFTMGIGIFIFICANAILHENRDKETKIIHMRDIYSTVIDIHTLRIKEQRQMNGMYTGLMGETEVKQNGSSCASRLAANTIASFSGFRSSFRMDSSVEEDELMLNEGKSSGHLMPPLLSDSSVSVFGLYPPPSKTTDDKTSGSKKCETKSIVSSSISAFTLPVIKLNNCVIDEPSIDNITEDADNLKSRSRNLSMDSLVVPLPNTSESFQPVSTVLPRNNSIGESLSSQYKSSMALGPGAGQLLSPGAARRQFGSNTSLHLLSSHSKSLDLDRGPSTLTVQAEQRKHPSWPRLDRNNSKGYMKLENKEDPMDRLLVPQVAIKKDFTNKEKLLMISRSHNNLSFEHDEFLSNNLKRGTSETRF

SEQ ID NO: 15397 - protein, 491 aa, Artificial Sequence; identical to SEQ ID NO: 15396
  Description of Artificial Sequence: Synthetic coding sequence

SEQ ID NO: 15398 - protein, 491 aa, Artificial Sequence; identical to SEQ ID NO: 15396
  Description of Artificial Sequence: Synthetic coding sequence

SEQ ID NO: 15399 - protein, 307 aa, Artificial Sequence
  Description of Artificial Sequence: Synthetic coding sequence
MTAGSPEECGEVRRSPEGRVSRLGRRLGRRRRPRSPPEPLRVRARLRLRSPSGAFAALGALVVLVGMGIAVAGYWPHRAGAPGSRAANASSPQMSELRREGRGGGRAHGPHERLRLLGPVIMGVGLFVFICANTLLYENRDLETRRLRQGVLRAQALRPPDGPGWDCALLPSPGPRSPRAVGCAEPEIWDPSPRRGTSPVPSVRSLRSEPANPRLGLPALLNSYPLKGPGLPPPWGPRTQTGHVIITVQPSGSCIEHSKSLDLGLGELLLGAPAARDCAHRSWPRLDRLSLGGYAKLGGGGDLGARV

SEQ ID NO: 15400 - protein, 307 aa, Artificial Sequence; identical to SEQ ID NO: 15399
  Description of Artificial Sequence: Synthetic coding sequence

SEQ ID NO: 15401 - protein, 621 aa, Artificial Sequence
  Description of Artificial Sequence: Synthetic coding sequence
MIATGGLLRISARKQDPLRPPSQIPKRKRKAKKRRKNDVVVVKGKLKLCSISGLIALCGILVLLVGIAMAVVGYWPKATGTNREGGKQLPPAGSSHRVPTTANSSSSGSKNRSRSHPRAPGGVNSSSAGAPRSTPPARAASPSSSSTSVGFFFRIFSGYLHSDKLKVFGPLIMGIGIFLFICANAVLHENRDKKTKIINLRDLYSTVIDVHSLRAKDLAAAAAAAAAAAASSSSSAPAAAPPGAIPLNGFLSYVQSRGLELKPGGCGGSGDAFGAAAMLAKGSWPPHPAAPSGGRPRGAASPPDLASSPRCPREPPSLAEAVYSVYRERSGVAGSRRAAAATAAAAASSCSSPAPCSPPESWGRQSTASSFVDSSLSAFALLPLQGGRDRGGDAEGASCSWQRPPGERGSQEIPRGELDLSMTNLRGAEGSMRGARREPEEPEGAVAARAARGQGGRLPRTGRYAALRRRSTSGLPDYRAPPSPEPPPSPGSADPDSSPLAKAASPSPPLRLEGSPPTRRDSGSSQSDDPSSSNKGYTPLREAGTSTESVLDAVAGQTRDSAVAAPVLGAEQSSPEGASQEPPTAEQPQPVQRQFTNKEKLIMISRSHAIGVEEELESTGI

SEQ ID NO: 15402 - protein, 621 aa, Artificial Sequence; identical to SEQ ID NO: 15401
  Description of Artificial Sequence: Synthetic coding sequence

SEQ ID NO: 15403 - protein, 392 aa, Artificial Sequence
  Description of Artificial Sequence: Synthetic coding sequence
MEGVSALLARCPTAGLAGGLGVTACAAAGVLLYRIARRMKPTHTMVNCWFCNQDTLVPYGNRNCWDCPHCEQYNGFQENGDYNKPIPAQYLEHLNHVVSSAPSLRDPSQPQQWVSSQVLLCKRCNHHQTTKIKQLAAFAPREEGRYDEEVEVYRHHLEQMYKLCRPCQAAVEYYIKHQNRQLRALLLSHQFKRREADQTHAQNFSSAVKSPVQVILLRALAFLACAFLLTTALYGASGHFAPGTTVPLALPPGGNGSATPDNGTTPGAEGWRQLLGLLPEHMAEKLCEAWAFGQSHQTGVVALGLLTCLLAMLLAGRIRLRRIDAFCTCLWALLLGLHLAEQHLQAASPSWLDTLKFSTTSLCCLVGFTAAVATRKATGPRRFRPRRSEKQP

SEQ ID NO: 15404 - protein, 666 aa, Artificial Sequence
  Description of Artificial Sequence: Synthetic coding sequence
MEGVSALLARCPTAGLAGGLGVTACAAAGVLLYRIARRMKPTHTMVNCWFCNQDTLVPYGNRNCWDCPHCEQYNGFQENGDYNKPIPAQYLEHLNHVVSSAPSLRDPSQPQQWVSSQVLLCKRCNHHQTTKIKQLAAFAPREEGRYDEEVEVYRHHLEQMYKLCRPCQAAVEYYIKHQNRQLRALLLSHQFKRREADQTHAQNFSSAVKSPVQVILLRALAFLACAFLLTTALYGASGHFAPGTTVPLALPPGGNGSATPDNGTTPGAEGWRQLLGLLPEHMAEKLCEAWAFGQSHQTGVVALGLLTCLLAMLLAGRIRLRRIDAFCTCLWALLLGLHLAEQHLQAASPSWLDTLKFSTTSLCCLVGFTAAVATRKATGPRRFRPRRFFPGDSAGLFPTSPSLAIPHPSVGGSPASLFIPSPPSFLPLANQQLFRSPRRTSPSSLPGRLSRALSLGTIPSLTRADSGYLFSGSRPPSQVSRSGEFPVSDYFSLLSGSCPSSPLPSPAPSVAGSVASSSGSLRHRRPLISPARLNLKGQKLLLFPSPPGEAPTTPSSSDEHSPHNGSLFTMEPPHVPRKPPLQDVKHALDLRSKLERGSACSNRSIKKEDDSSQSSTCVVDTTTRGCSEEAATWRGRFGPSLVRGLLAVSLAANALFTSVFLYQSLR

SEQ ID NO: 15405 - protein, 642 aa, Artificial Sequence
  Description of Artificial Sequence: Synthetic coding sequence
MEGVSALLARCPTAGLAGGLGVTACAAAGVLLYRIARRMKPTHTMVNCWFCNQDTLVPYGNRNCWDCPHCEQYNGFQENGDYNKPIPAQYLEHLNHVVSSAPSLRDPSQPQQWVSSQVLLCKRCNHHQTTKIKQLAAFAPREEGRYDEEVEVYRHHLEQMYKLCRPCQAAVEYYIKHQNRQLRALLLSHQFKRREADQTHAQNFSSAVKSPVQVILLRALAFLACAFLLTTALYGASGHFAPGTTVPLALPPGGNGSATPDNGTTPGAEGWRQLLGLLPEHMAEKLCEAWAFGQSHQTGVVALGLLTCLLAMLLAGRIRLRRIDAFCTCLWALLLGLHLAEQHLQAASPSWLDTLKFSTTSLCCLVGFTAAVATRKATGPRRFRPRRFFPGDSAGLFPTSPSLAIPHPSVGGSPASLFIPSPPSFLPLANQQLFRSPRRTSPSSLPGRLSRALSLGTIPSLTRADYFSLLSGSCPSSPLPSPAPSVAGSVASSSGSLRHRRPLISPARLNLKGQKLLLFPSPPGEAPTTPSSSDEHSPHNGSLFTMEPPHVPRKPPLQDVKHALDLRSKLERGSACSNRSIKKEDDSSQSSTCVVDTTTRGCSEEAATWRGRFGPSLVRGLLAVSLAANALFTSVFLYQSLR

SEQ ID NO: 15406 - protein, 136 aa, Artificial Sequence
  Description of Artificial Sequence: Synthetic coding sequence
MLFSLRELVQWLGFATFEIFVHLLALLVFSVLLALRVDGLVPGLSWWNVFVPFFAADGLSTYFTTIVSVRLFQDGEKRLAVLRLFWVLTVLSLKFVFEMLLCQKLAEQTRELWFGLITSPLFILLQLLMIRACRVN

SEQ ID NO: 15407 - protein, 136 aa, Artificial Sequence; identical to SEQ ID NO: 15406
  Description of Artificial Sequence: Synthetic coding sequence

SEQ ID NO: 15408 - protein, 226 aa, Artificial Sequence
  Description of Artificial Sequence: Synthetic coding sequence
MTVQRLVAAAVLVALVSLILNNVAAFTSNWVCQTLEDGRRRSVGLWRSCWLVDRTRGGPSPGARAGQVDAHDCEALGWGSEAAGFQESRGTVKLQFDMMRACNLVATAALTAGQLTFLLGLVGLPLLSPDAPCWEEAMAAAFQLASFVLVIGLVTFYRIGPYTNLSWSCYLNIGACLLATLAAAMLIWNILHKREDCMAPRVIVISRSLTARFRRGLDNDYVESPC

SEQ ID NO: 15409 - protein, 226 aa, Artificial Sequence; identical to SEQ ID NO: 15408
  Description of Artificial Sequence: Synthetic coding sequence

SEQ ID NO: 15410 - protein, 350 aa, Artificial Sequence
  Description of Artificial Sequence: Synthetic coding sequence
MIRQERSTSYQELSEELVQVVENSELADEQDKETVRVQGPGILPGLDSESASSSIRFSKACLKNVFSVLLIFIYLLLMAVAVFLVYRTITDFREKLKHPVMSVSYKEVDRYDAPGIALYPGQAQLLSCKHHYEVIPPLTSPGQPGDMNCTTQRINYTDPFSNQTVKSALIVQGPREVKKRELVFLQFRLNKSSEDFSAIDYLLFSSFQEFLQSPNRVGFMQACESAYSSWKFSGGFRTWVKMSLVKTKEEDGREAVEFRQETSVVNYIDQRPAAKKSAQLFFVVFEWKDPFIQKVQDIVTANPWNTIALLCGAFLALFKAAEFAKLSIKWMIKIRKRYLKRRGQATSHIS

SEQ ID NO: 15411 - protein, 411 aa, Artificial Sequence
  Description of Artificial Sequence: Synthetic coding sequence
MIRQERSTSYQEAVRPALPSSKPCLLTSPAVLVKLLSSSASTSRPPNLGHLWQPSSSVPLHRAASLAKVRQFQLSEELVQVVENSELADEQDKETVRVQGPGILPGLDSESASSSIRFSKACLKNVFSVLLIFIYLLLMAVAVFLVYRTITDFREKLKHPVMSVSYKEVDRYDAPGIALYPGQAQLLSCKHHYEVIPPLTSPGQPGDMNCTTQRINYTDPFSNQTVKSALIVQGPREVKKRELVFLQFRLNKSSEDFSAIDYLLFSSFQEFLQSPNRVGFMQACESAYSSWKFSGGFRTWVKMSLVKTKEEDGREAVEFRQETSVVNYIDQRPAAKKSAQLFFVVFEWKDPFIQKVQDIVTANPWNTIALLCGAFLALFKAAEFAKLSIKWMIKIRKRYLKRRGQATSHIS

SEQ ID NO: 15412 - protein, 146 aa, Artificial Sequence
  Description of Artificial Sequence: Synthetic coding sequence
MSRSRLFSVTSAISTIGILCLPLFQLVLSDLPCEEDEMCVNYNDQHPNGWYIWILLLLVLVAALLCGAVVLCLQCWLRRPRIDSHRRTMAVFAVGDLDSIYGTEAAVSPTVGIHLQTQTPDLYPVPAPCFGPLGSPPPYEEIVKTT

SEQ ID NO: 15413 - protein, 173 aa, Artificial Sequence
  Description of Artificial Sequence: Synthetic coding sequence
MAPKGKVGTRGKKQIFEENRETLKFYLRIILGANAIYCLVTLVFFYSSASFWAWLALGFSLAVYGASYHSMSSMARAAFSEDGALMDGGMDLNMEQGMAEHLKDVILLTAIVQVLSCFSLYVWSFWLLAPGRALYLLWVNVLGPWFTADSGTPAPEHNEKRQRRQERRQMKRL

SEQ ID NO: 15414 - protein, 518 aa, Artificial Sequence
  Description of Artificial Sequence: Synthetic coding sequence
MQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKLASFSPSPPSPYPTTVGPVESSGLRSRYRSSPTVYNSPTDKEDYMTDLRTLDTFLRSEEEKQHRVKLGSPDSTSPSSSPTFWNYSRSMGDYAQTLKKFQYQLACRSQAPCANKDEADLSSKQAAEEVWARVAMNRQLLDHMDSWTAKFRNWINETILVPLVQEIESVSTQMRRMGCPELQIGELSQGGCMSSFRWNRGGDFKGRKWDTDLPTDSAIIMHVFCTYLDSRLPPHPKYPDGKTFTSQHFVQTPNKPDVTNENVFCIYQSAINPPHYELIYQRHVYNLPKGRNNMFHTLLMFLYIIKTKESGMLGRVNLGLSGVNILWIFGE

SEQ ID NO: 15415 - protein, 561 aa, Artificial Sequence
  Description of Artificial Sequence: Synthetic coding sequence
MMQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKLASFSPSPPSPYPTTVGPVESSGLRSRYRSSPTVYNSPTDKEDYMTDLRTLDTFLRSEEEKQHRVKLGSPDSTSPSSSPTFWNYSRSMGDYAQTLKKFQYQLACRSQAPCANKDEADLSSKQAAEEVWARVAMNRQLLDHMDSWTAKFRNWINETILVPLVQEIESVSTQMRRMGCPELQIGEASITSLKQAALVKAPLIPTLNTIVQYLDLTPNQEYLFERIKELSQGGCMSSFRWNRGGDFKGRKWDTDLPTDSAIIMHVFCTYLDSRLPPHPKYPDGKTFTSQHFVQTPNKPDVTNENVFCIYQSAINPPHYELIYQRHVYNLPKGRNNMFHTLLMFLYIIKTKESGMLGRVNLGLSGVNILWIFGE

SEQ ID NO: 15416 - protein, 560 aa, Artificial Sequence
  Description of Artificial Sequence: Synthetic coding sequence
MQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKLASFSPSPPSPYPTTVGPVESSGLRSRYRSSPTVYNSPTDKEDYMTDLRTLDTFLRSEEEKQHRVKLGSPDSTSPSSSPTFWNYSRSMGDYAQTLKKFQYQLACRSQAPCANKDEADLSSKQAAEEVWARVAMNRQLLDHMDSWTAKFRNWINETILVPLVQEIESVSTQMRRMGCPELQIGEASITSLKQAALVKAPLIPTLNTIVQYLDLTPNQEYLFERIKELSQGGCMSSFRWNRGGDFKGRKWDTDLPTDSAIIMHVFCTYLDSRLPPHPKYPDGKTFTSQHFVQTPNKPDVTNENVFCIYQSAINPPHYELIYQRHVYNLPKGRNNMFHTLLMFLYIIKTKESGMLGRVNLGLSGVNILWIFGE

SEQ ID NO: 15417 - protein, 56 aa, Artificial Sequence
  Description of Artificial Sequence: Synthetic coding sequence
MQGEAHPSASLIDRTIKMRKETEARKVVLAWGLLNVSMAGMIYTEMTGKLISSYYN

SEQ ID NO: 15418 - protein, 519 aa, Artificial Sequence
  Description of Artificial Sequence: Synthetic coding sequence
MMQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKLASFSPSPPSPYPTTVGPVESSGLRSRYRSSPTVYNSPTDKEDYMTDLRTLDTFLRSEEEKQHRVKLGSPDSTSPSSSPTFWNYSRSMGDYAQTLKKFQYQLACRSQAPCANKDEADLSSKQAAEEVWARVAMNRQLLDHMDSWTAKFRNWINETILVPLVQEIESVSTQMRRMGCPELQIGELSQGGCMSSFRWNRGGDFKGRKWDTDLPTDSAIIMHVFCTYLDSRLPPHPKYPDGKTFTSQHFVQTPNKPDVTNENVFCIYQSAINPPHYELIYQRHVYNLPKGRNNMFHTLLMFLYIIKTKESGMLGRVNLGLSGVNILWIFGE

SEQ ID NO: 15419 - protein, 203 aa, Artificial Sequence
  Description of Artificial Sequence: Synthetic coding sequence
MMQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKVMTLFSCLVTLF

SEQ ID NO: 15420 - protein, 129 aa, Artificial Sequence
  Description of Artificial Sequence: Synthetic coding sequence
MLLGGWLLLAFNAIFLLSWAVAPKGLCPRRSSVPMPGVQAVAATAMIVGLLIFPIGLASPFIKEVCEASSMYYGGKCRLGWGYMTAILNAVLASLLPIISWPHTTKVQGRTIIFSSATERIIFVPEMNK

SEQ ID NO: 15421 - protein, 129 aa, Artificial Sequence; identical to SEQ ID NO: 15420
  Description of Artificial Sequence: Synthetic coding sequence

SEQ ID NO: 15422 - protein, 200 aa, Artificial Sequence
  Description of Artificial Sequence: Synthetic coding sequence
MLSSVWVALGLSLTCTSAFSLISPAWFQTPTFSFGILTYCSWPQGNSWNQSCVTFSSLEDIPDFAWKVSAVMLLGGWLLLAFNAIFLLSWAVAPKGLCPRRSSVPMPGVQAVAATAMIVGLLIFPIGLASPFIKEVCEASSMYYGGKCRLGWGYMTAILNAVLASLLPIISWPHTTKVQGRTIIFSSATERIIFVPEMNK

SEQ ID NO: 15423 - protein, 157 aa, Artificial Sequence
  Description of Artificial Sequence: Synthetic coding sequence
MVFPPNTQHKFTSGRVAFQLLQVGVDSPAAGTRHNSAGPAHLHRALSTASSMQRLPAATRATLILSLAFASLHSACSAASSSNSSSLTAHHPDPGTLEQCLNVDFCPQAARCCRTGVDEYGWIAAAVGWSLWFLTLILLCVDKLMKLTPDEPKDLQA

SEQ ID NO: 15424 - protein, 107 aa, Artificial Sequence
  Description of Artificial Sequence: Synthetic coding sequence
MQRLPAATRATLILSLAFASLHSACSAEASSSNSSSLTAHHPDPGTLEQCLNVDFCPQAARCCRTGVDEYGWIAAAVGWSLWFLTLILLCVDKLMKLTPDEPKDLQA

SEQ ID NO: 15425 - protein, 689 aa, Artificial Sequence
  Description of Artificial Sequence: Synthetic coding sequence
MATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 15426 - protein, 689 aa, Artificial Sequence; identical to SEQ ID NO: 15425
  Description of Artificial Sequence: Synthetic coding sequence

SEQ ID NO: 15427 - protein, 644 aa, Artificial Sequence
  Description of Artificial Sequence: Synthetic coding sequence
MATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 15428 - protein, 160 aa, Artificial Sequence [sequence omitted]

SEQ ID NO: 15429 - protein, 429 aa, Artificial Sequence
  Description of Artificial Sequence: Synthetic coding sequence
MWALGQAGFANLTEGLKVWLGIMLPVLGIKSLSPFAITYLDRLLLMHPNLTGLRHDWPQGLLPTSGLCLYAEQLPDTQPAGACQLYPRLKVLAFGAKPDSTLHTYFPSFLSRATPSCPPEMKKELLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 15430 - protein, 235 aa, Artificial Sequence
  Description of Artificial Sequence: Synthetic coding sequence
MRPDDINPRTGLVVALVSVFLVFGFMFTVSGMKGETLGNIPLLAIGPAICLPGIAAIALARKTEGCTKWPENELLWVRKLPCFRKPKDKEVVELLRTPSDLESGKGSSDELAKKAGLRGKPPPQSQGEVSVASSINSPTPTEEGECQSLVQNGHQEETSRYLDGYCPSGSSLTYSALDVKCSARDRSECPEPEDSIFFVPQDSIIVCSYKQNSPYDRYCCYINQIQGRWDHETIV

SEQ ID NO: 15431 - protein, 229 aa, Artificial Sequence
  Description of Artificial Sequence: Synthetic coding sequence
MKQQQWCGMTAKMGTVLSGVFTIMAVDMYLIFEQKHLGNGSCTEITPKYRGASNIINNFIICWSFKIVLFLSFITILISCFLLYSVYAQIFRGLVIYIVWIFFYETANVVIQILTNNDFDIKEVRIMRWFGLVSRTVMHCFWMFFVINYAHITYKNRSQGNIISYKRRISTAEILHSRNKRLSISSGFSGSHLESQYFERQSFHTSIFTCLSPVPSSAPSTCRYTIDVC

SEQ ID NO: 15432 - protein, 211 aa, Artificial Sequence
  Description of Artificial Sequence: Synthetic coding sequence
MKQQQWCGMTAKMGTVLSGVFTIMAVDMYLIFEQKHLGNGSCTEITPKYRGASNIINNFIICWSFKIVLFLSFITILISCFLLYSVYAQIFRGLVIYIVWIFFYETANVVIQILTNNDFDIKEVRIMRWFGLVSRTVMHCFWMFFVINYAHITYKNRSQGNIISYKRRISTAEILHSRNKRLSISSGFSGSHLESQYFERQRRCSGKTSIK

SEQ ID NO: 15433 - protein, 115 aa, Artificial Sequence
  Description of Artificial Sequence: Synthetic coding sequence
MAGTVLGVGAGVFILALLWVAVLLLCVLLSRASGAARFSVIFLFFGAVIITSVLLLFPRAGEFPAPEVEVKIVDDFFIGRYVLLAFLSAIFLGGLFLVLIHYVLEPIYAKPLHSY

SEQ ID NO: 15434 - protein, 115 aa, Artificial Sequence; identical to SEQ ID NO: 15433
  Description of Artificial Sequence: Synthetic coding sequence

SEQ ID NO: 15435 - protein, 115 aa, Artificial Sequence; identical to SEQ ID NO: 15433
  Description of Artificial Sequence: Synthetic coding sequence

SEQ ID NO: 15436 - protein, 115 aa, Artificial Sequence; identical to SEQ ID NO: 15433
  Description of Artificial Sequence: Synthetic coding sequence

SEQ ID NO: 15437 - protein, 115 aa, Artificial Sequence; identical to SEQ ID NO: 15433
  Description of Artificial Sequence: Synthetic coding sequence

SEQ ID NO: 15438 - protein, 115 aa, Artificial Sequence; identical to SEQ ID NO: 15433
  Description of Artificial Sequence: Synthetic coding sequence

SEQ ID NO: 15439 - protein, 115 aa, Artificial Sequence; identical to SEQ ID NO: 15433
  Description of Artificial Sequence: Synthetic coding sequence

SEQ ID NO: 15440 - protein, 115 aa, Artificial Sequence; identical to SEQ ID NO: 15433
  Description of Artificial Sequence: Synthetic coding sequence

SEQ ID NO: 15441 - protein, 240 aa, Artificial Sequence
  Description of Artificial Sequence: Synthetic coding sequence
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSEELALCGSRLLVLGSFLLLFCGLLCCVTAMCFHPRRESHWSRTRL

SEQ ID NO: 15442 - protein, 240 aa, Artificial Sequence; identical to SEQ ID NO: 15441
  Description of Artificial Sequence: Synthetic coding sequence

SEQ ID NO: 15443 - protein, 412 aa, Artificial Sequence
  Description of Artificial Sequence: Synthetic coding sequence
MDTSPSRKYPVKKRVKIHPNTVMVKYTSHYPQPGDDGYEEINEGYGNFMEENPKKGLLSEMKKKGRAFFGTMDTLPPPTEDPMINEIGQFQSFAEKNIFQSRKMWIVLFGSALAHGCVALITRLVSDRSKVPSLELIFIRSVFQVLSVLVVCYYQEAPFGPSGYRLRLFFYGVCNVISITCAYTSFSIVPPSNGTTMWRATTTVFSAILAFLLVDEKMAYVDMATVVCSILGVCLVMIPNIVDEDNSLLNAWKEAFGYTMTVMAGLTTALSMIVYRSIKEKISMWTALFTFGWTGTIWGISTMFILQEPIIPLDGETWSYLIAICVCSTAAFLGVYYALDKFHPALVSTVQHLEIVVAMVLQLLVLHIFPSIYDVFGGVIIMISVFVLAGYKLYWRNLRKQDYQEILDSPIK

SEQ ID NO: 15444 - protein, 412 aa, Artificial Sequence; identical to SEQ ID NO: 15443
  Description of Artificial Sequence: Synthetic coding sequence

SEQ ID NO: 15445 - protein, 160 aa, Artificial Sequence
  Description of Artificial Sequence: Synthetic coding sequence
MAPALWRACNGLMAAFFALAALVQVNDPDAEVWVVVYTIPAVLTLLVGLNPEVTGNVIWKSISAIHILFCTVWAVGLASYLLHRTQQNILHEEEGRELSGLVIITAWIILCHSSSKNPVGGRIQLAIAIVITLFPFISWVYIYINKEMRSSWPTHCKTVI

SEQ ID NO: 15446 - protein, 150 aa, Artificial Sequence
  Description of Artificial Sequence: Synthetic coding sequence
MAPALWRACNGLMAAFFALAALVQVVYTIPAVLTLLVGLNPEVTGNVIWKSISAIHILFCTVWAVGLASYLLHRTQQNILHEEEGRELSGLVIITAWIILCHSSSKNPVGGRIQLAIAIVITLFPFISWVYIYINKEMRSSWPTHCKTVI

SEQ ID NO: 15447 - protein, 200 aa, Artificial Sequence
  Description of Artificial Sequence: Synthetic coding sequence
MKQYQGSGGVAMDVERSRFPYCVVWTPIPVLTWFFPIIGHMGICTSTGVIRDFAGPYFVSEDNMAFGKPAKCHLQEAFSHPILVRSGCHNKISSIGYWKLDPAQVYASGPNAWDTAVHDASEEYKHRMHNLCCDNCHSHVALALNLMRYNNSTNWNMVTLCFFCLLYGKYVSVGAFVKTWLPFILLLGIILTVSLVFNLR

SEQ ID NO: 15448 - protein, 208 aa, Artificial Sequence
  Description of Artificial Sequence: Synthetic coding sequence
MAEAEGSSLLLLPPPPPPPRMAEVEAPTAAETDMKQYQGSGGVAMDVERSRFPYCVVWTPIPVLTWFFPIIGHMGICTSTGVIRDFAGPYFVSEDNMAFGKPAKYWKLDPAQVYASGPNAWDTAVHDASEEYKHRMHNLCCDNCHSHVALALNLMRYNNSTNWNMVTLCFFCLLYGKYVSVGAFVKTWLPFILLLGIILTVSLVFNLR

SEQ ID NO: 15449 - protein, 202 aa, Artificial Sequence
  Description of Artificial Sequence: Synthetic coding sequence
MAAPWRRWPTGLLAVLRPLLTCRPLQGTTLQRDVLLFEHDRGRFFTILGLFCAGQGVFWASMAVAAVSRPPVPVQPLDAEVPNRGPFDLRSALWRYGLAVGCGAIGALVLGAGLLFSLRSVRSVVLRAGGQQVTLTTHAPFGLGAHFTVPLKQVSCMAHRGEVPAMLPLKVKGRRFYFLLDKTGHFPNTKLFDNTVGAYRSL

SEQ ID NO: 15450 - protein, 225 aa, Artificial Sequence
  Description of Artificial Sequence: Synthetic coding sequence
MVHVSNRSIQGMNILFSSWAVVLMVMGITLDKWVELISEDERAKMNHSPWMMCCPALWPEDDLKVVRIMMTSSLGLSFLLNLILGMKFTYLIPQNKYIQLFTTILSFFSGISLLWALILYHNKLKQGQSMHFSNYRITWIMYTAYLNVFFLSVCGVLSLLECKLSTSSCTCLNIHKSDNECKESENSIEDISLPECTAMPRSIVRAHTVNSLNKKVQTRHVTWAL

SEQ ID NO: 15451 - protein, 380 aa, Artificial Sequence
  Description of Artificial Sequence: Synthetic coding sequence
MAGSDVDSEGPARRGGAARRPGAPGGPGSEAAAGCPEPLSTAEAPAESATLPAWMRLYFYGMHGITLDVLVSSARRFARSPDLRMLGFSSPYRCLLHSLTHFALEKVYLQQRRCPNAFVFNFLLYPSAHVGLQTLAGQALLLSLGGGAGVAVAPGALDLALQYVLALYHCQVFLKRFLRLRYGRQRRRQQQQQQQQQQQQRRGALPVPPGARVPTAAGARRRRPRGPRGAGGAPSQGLPDLPRFLFFGMHGFLDEIFFTFFFNVLGQGDGTTSGHTSLWSFFMYGSCSFVVEKLYFHLHYSRGWGTWKRVPIYVIFIYVWELSWGLGLRTCGACSWDYSHYPLNFMGLITLMYLPGWIFLSVYQDLISNVLWRVQYVPAN

SEQ ID NO: 15452 - protein, 167 aa, Artificial Sequence
  Description of Artificial Sequence: Synthetic coding sequence
MASAEPLTALSRWYLYAIHGYFCEVMFTAAWEFVVNLNWKFPGVTSVWALFIYGTSILIVERMYLRLRGRCPLLLRCLIYTLWTYLWEFTTGFILRQFNACPWDYSQFDFDFMGLITLEYAVPWFCGALIMEQFIIRNTLRLRFDKDAEPGEPSGALALANGHVKTD

SEQ ID NO: 15453 - protein, 134 aa, Artificial Sequence
  Description of Artificial Sequence: Synthetic coding sequence
MASAEPLTALSRWYLYAIHGYFCEVMFTAAWEFVVNLNWKFPGVTSVWALFIYGTSILIVERMYLRLRGRCPLLLRCLIYTLWTYLWEFTTGFILRQFNACPWDYSQFDFDFMGLITLEYAVPWFCGALIMEQF

SEQ ID NO: 15454 - protein, 79 aa, Artificial Sequence
  Description of Artificial Sequence: Synthetic coding sequence
MASAEPLTALSRWYLYAIHGYFCEVMFTAAWEFVVNLNWKFPGVTSVWALFIYGTSILIVERMYLRLRGRCPLLLRCLI

SEQ ID NO: 15455 - protein, 167 aa, Artificial Sequence; identical to SEQ ID NO: 15452
  Description of Artificial Sequence: Synthetic coding sequence

SEQ ID NO: 15456 - protein, 56 aa, Artificial Sequence
  Description of Artificial Sequence: Synthetic coding sequence
MASAEPLTALSRWYLYAIHGYFCEVMFTAAWEFVVNLNWKFPGVTSVWALFIYGTS

SEQ ID NO: 15457 - protein, 167 aa, Artificial Sequence; identical to SEQ ID NO: 15452
  Description of Artificial Sequence: Synthetic coding sequence

SEQ ID NO: 15458 - protein, 55 aa, Artificial Sequence
  Description of Artificial Sequence: Synthetic coding sequence
MASAEPLTALSRWYLYAIHGYFCEVMFTAAWEFVVNLNWKFPGVTSVWALFIYGT

SEQ ID NO: 15459 - protein, 316 aa, Artificial Sequence
  Description of Artificial Sequence: Synthetic coding sequence
MALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSTREEDRNQDGKTDMLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 15460 - protein, 345 aa, Artificial Sequence
  Description of Artificial Sequence: Synthetic coding sequence
MSSSLTRSSAVTARGSAPKPRCSCCWPLRSRTSRRCWWPSGATVSLPRPLCHEAPRARSARAGLPNRLPTALFNSGFWLKRSSYEEQPTVRFQHQVLLVALLGPESDGFLAWSTFPAFNRLQGDRLRVPLVSTREEDRNQDGKTDMLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 15461 - protein, 506 aa, Artificial Sequence
  Description of Artificial Sequence: Synthetic coding sequence
MNMPVNKSPMINTCGGISSPYHEELWKLNFQHLSGERGHKSRPTFSITKEFILRFNQTQNSKEKEELLELARKIILRCKRKLGLKTLGSGRHVHLPAAWTEVIYLAQCKGEIQDESLNMLYASLDHASFDYDHLPALFFVAESVLYRLCCDASLKTYLYSVEIKLAKIGYLVFLRLFIFFLHGHLESFKQHLLRLQPYLYALSFSGASYHKYPNIFSNVQFILKASEIIGKRELRSESIFRPVEDKKRYENTDSDMGGYEINHLLWHCVAAWSCVQNNSPQLNNVLEHLVFHKTQLQKKCWLDSVLALLVLGEAAKLNMACLKALMDVVRDFVSSIMSVQNQEESCKVDDFSWAWNVVYIYTVILAEICLYAATSDLRKTALIGFCHCKSSQKNILYLDKSVPPELKETSILSLLEYFSSKMSENCDQVVWTGYYGLVYNLVKISWELQGDEEQDGLRNMIWQTLQKTKDYEEDVRIQNAINIAQGTSFCIRNSHVSISRFLHQGR

SEQ ID NO: 15462 - protein, 657 aa, Artificial Sequence
  Description of Artificial Sequence: Synthetic coding sequence
MNMPVNKSPMINTCGGISSPYHEELWKLNFQHLSGERGHKSRPTFSITKEFILRFNQTQNSKEKEELLELARKIILRCKRKLGLKTLGSGRHVHLPAAWTEVIYLAQCKGEIQDESLNMLYASLDHASFDYDHLPALFFVAESVLYRLCCDASLKTYLYSVEIKLAKIGYLVFLRLFIFFLHGHLESFKQHLLRLQPYLYALSFSGASYHKYPNIFSNVQFILKASEIIGKRELRSESIFRPVEDKKRYENTDSDMGGYEINHLLWHCVAAWSCVQNNSPQLNNVLEHLVFHKTQLQKKCWLDSVLALLVLGEAAKLNMACLKALMDVVRDFVSSIMSVQNQEESCKVDDFSWAWNVVYIYTVILAEICLYAATSDLRKTALIGFCHCKSSQKNILYLDKSVPPELKETSILSLLEYFSSKMSENCDQVVWTGYYGLVYNLVKISWELQGDEEQDGLRNMIWQTLQKTKDYEEDVRIQNAINIAQAELNDPTDPFTRYSTNISSNVGEEVFSKYIGWRIANTLSKLFFPPIEAHFLPLKKPSIKKDQTKYPNKKLESVKKQVLHFTVREHPSVSEIPMFPYPDFFTKADKELAKIIDHHWQEELKIREKEDAICKAQELKDKKLAEKNHFQEVMKKREEKLHKQTKPYELPYRKEVI

SEQ ID NO: 15463 - protein, 109 aa, Artificial Sequence
  Description of Artificial Sequence: Synthetic coding sequence
MSQYAPSPDFKRALDSSPEANTEDDKTEEDVPMPKNYLWLTIVSCFCPAYPINIVALVFSIMSLNSYNDGDYEGARRLGRNAKWVAIASIIIGLLIIGISCAVHFTRNA

SEQ ID NO: 15464 - protein, 140 aa, Artificial Sequence
  Description of Artificial Sequence: Synthetic coding sequence
MAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRAVAGMVLTVIGISLCITSSVSKTQGQQSTL

SEQ ID NO: 15465 - protein, 164 aa, Artificial Sequence
  Description of Artificial Sequence: Synthetic coding sequence
MAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRAVAGMVLTVIGISLCITSSVPWTAELQLHGKGQLQTLSQKCKREASGTQSERFG

SEQ ID NO: 15466 - protein, 164 aa, Artificial Sequence; identical to SEQ ID NO: 15465
  Description of Artificial Sequence: Synthetic coding sequence

SEQ ID NO: 15467 - protein, 164 aa, Artificial Sequence; identical to SEQ ID NO: 15465
  Description of Artificial Sequence: Synthetic coding sequence

SEQ ID NO: 15468 - protein, 164 aa, Artificial Sequence; identical to SEQ ID NO: 15465
  Description of Artificial Sequence: Synthetic coding sequence

SEQ ID NO: 15469 - protein, 161 aa, Artificial Sequence
  Description of Artificial Sequence: Synthetic coding sequence
MAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKPVLLPCGHQSSLPLDSLEKDRGWGLGLKTRPHLSPSSSPVPAPTGMAELRPS

SEQ ID NO: 15470 - protein, 196 aa, Artificial Sequence
  Description of Artificial Sequence: Synthetic coding sequence
MARLGALLLAAALGALLSFALLAAAVASDYWYILEVADAGNGSAWPGRAELLSSHSGLWRICEVLHRAVIVVLPLSLVLLVCGWICGLLSSLAQSVSLLLFTGCYFLLGSVLTLAGVSIYISYSHLAFAETVQQYGPQHMQGVRVSFGWSMALAWGSCALEAFSGTLLLSAAWTLSLSPPICGHLSPQQVGGRGGD

SEQ ID NO: 15471 - protein, 394 aa, Artificial Sequence
  Description of Artificial Sequence: Synthetic coding sequence
MPSGWSSGLIQTRTPGPARARLLCFQEHGWVVLLPGRPSSWGRSLADPPSSSQALHSPARQVHLVWLLRSRGFREIKERAQGPGASPWGRWDWSPSPRFAARLSTSSPFPQGRAQRPQRGGVDLPATPGGPRGQCAGRSGDVLRRAGRRRARPPPVPRLPAPRAPRRPRGPATPDPSPPAGRPHGPAGRAAPGRRPGCTAQLRAPGRRGRQRLLVHPGGGGRRQWQRLARARRAALLALGALAHLRRCPDTGGGQHLHQLLAPGLCGDGAAVWPAAHAGRPRQLRLVHGPGLGLLCLGGIQRNPPALSCLDPQPEPPNLWSSESPAGGRERGRLRPRAAEGPTQIAWRQRDAVSGQGLPGLCSVHSPRRAGLVEKRLMRGPESPSDLQGWGARS

SEQ ID NO: 15472 - protein, 150 aa, Artificial Sequence
  Description of Artificial Sequence: Synthetic coding sequence
MARLGALLLAAALGALLSFALLAAAVASDYWYILEVADAGNGSAWPGRAELLSSHSGLWRICEGVLTLAGVSIYISYSHLAFAETVQQYGPQHMQGVRVSFGWSMALAWGSCALEAFSGTLLLSAAWTLSLSPPICGHLSPQQVGGRGGD

SEQ ID NO: 15473 - protein, 196 aa, Artificial Sequence; identical to SEQ ID NO: 15470
  Description of Artificial Sequence: Synthetic coding sequence

SEQ ID NO: 15474 - protein, 223 aa, Artificial Sequence
  Description of Artificial Sequence: Synthetic coding sequence
MARLGALLLAAALGALLSFALLAAAVASDYWYILEVADAGNGSAWPGRAELLSSHSGLWRICEGQNGCIPLVDPFASESLDVSTSVQHLILLHRAVIVVLPLSLVLLVCGWICGLLSSLAQSVSLLLFTGCYFLLGSVLTLAGVSIYISYSHLAFAETVQQYGPQHMQGVRVSFGWSMALAWGSCALEAFSGTLLLSAAWTLSLSPPICGHLSPQQVGGRGGD

SEQ ID NO: 15475 - protein, 150 aa, Artificial Sequence; identical to SEQ ID NO: 15472
  Description of Artificial Sequence: Synthetic coding sequence

SEQ ID NO: 15476 - protein, 351 aa, Artificial Sequence
  Description of Artificial Sequence: Synthetic coding sequence
MASGRLIKFVVFELLEFAAFSIPTLVITEQFATAYQGTRARSDNTHYWLIISCSIAYVALVTLLIWVPVKVILHKKRYIYRKIKGWRPVLMMCVVLTTLPCLTFSIAVTEVQKSINGSADVLPDMLPDLPVSLVLLSLIMVDIIEKLRIYPLRGSQKSSENGHIHSTSLQHIKTVTEQVRQSPENAASPQATNSTQVSQPSGAMTRSQESVFMGPQEPSCDSGILRMMSRRDVRAELFLWSFLLWSDTIEMVRVAGHPNVYKSSWLYPVYIFSFISLLRITFTPQNPLLNSLSVLLQDLPFVFVRLGLIIALGTITPVLGLCKNILVTLSYIYFNYLTRIRIFSAFEMSPF

SEQ ID NO: 15477 - protein, 351 aa, Artificial Sequence; identical to SEQ ID NO: 15476
  Description of Artificial Sequence: Synthetic coding sequence

SEQ ID NO: 15478 - protein, 351 aa, Artificial Sequence; identical to SEQ ID NO: 15476
  Description of Artificial Sequence: Synthetic coding sequence

SEQ ID NO: 15479 - protein, 351 aa, Artificial Sequence; identical to SEQ ID NO: 15476
  Description of Artificial Sequence: Synthetic coding sequence

SEQ ID NO: 15480 - protein, 173 aa, Artificial Sequence
  Description of Artificial Sequence: Synthetic coding sequence
MSMSANTMIFMILGASVVMAIACLMDMNALLDRFHNYILPHLRGEDRVCHCNCGRHHIHYVIPYDGDQSVVDASENYFVTDSVTKQEIDLMLGLLLGFCISWFLVWMDGVLHCAVRAWRAGRRYDGSWTWLPKLCSLRELGRRPHRPFEEAAGNMVHVKQKLYHNGHPSPRHL

SEQ ID NO: 15481 - protein, 173 aa, Artificial Sequence; identical to SEQ ID NO: 15480
  Description of Artificial Sequence: Synthetic coding sequence

SEQ ID NO: 15482 - protein, 296 aa, Artificial Sequence
  Description of Artificial Sequence: Synthetic coding sequence
MCVRRSLVGLTFCTCYLASYLTNKYVLSVLKFTYPTLFQGWQTLIGGLLLHVSWKLGWVEINSSSRSHVLVWLPASVLFVGIIYAGSRALSRLAIPVFLTLHNVAEVIICGYQKCFQKEKTSPAKICSALLLLAAAGCLPFNDSQFNPDGYFWAIIHLLCVGAYKILQKSQKPSALSDIDQQYLNYIFSVVLLAFASHPTGDLFSVLDFPFLYFYRFHGSCCASGFLGFFLMFSTVKLKNLLAPGQCAAWIFFAKIITAGLSILLFDAILTSATTGCLLLGALGEALLVFSERKSS

SEQ ID NO: 15483 - protein, 123 aa, Artificial Sequence
  Description of Artificial Sequence: Synthetic coding sequence
MCVRRSLVGLTFCTCYLASYLTNKYVLSVLKFTYPTLFQGSHVLVWLPASVLFVGIIYAGSRALSRLAIPVFLTLHNVAEVIICGYQKCFQKEKTSPAKICRLHLERTRQNQTSRLSSCLKGD

SEQ ID NO: 15484 - protein, 155 aa, Artificial Sequence
  Description of Artificial Sequence: Synthetic coding sequence
MIPDVISALLLLAAAGCLPFNDSQFNPDGYFWAIIHLLCVGAYKILQKSQKPSALSDIDQQYLNYIFSVVLLAFASHPTGDLFSVLDFPFLYFYRFHGSCCASGFLGFFLMFSTVKLKNLLAPGQCAAWIFFAKIITAGLSILLFDAILTSATTG

SEQ ID NO: 15485 - protein, 168 aa, Artificial Sequence [sequence omitted]

SEQ ID NO: 15486 - protein, 128 aa, Artificial Sequence
  Description of Artificial Sequence: Synthetic coding sequence
METAGAATGQPASGLEAPGSTNDRLFLVKGGIFLGTVAAAGMLAGFITTLSLAKKKSPEWFNKGSMATAALPESGSSLALRALGWGSLYAWCGVGVISFAVWKALGVHSVSNYCLVPGIYMFILLTVF

SEQ ID NO: 15487 - protein, 141 aa, Artificial Sequence
  Description of Artificial Sequence: Synthetic coding sequence
METAGAATGQPASGLEAPGSTNDRLFLVKGGIFLGTVAAAGMLAGFITTLSLAKKKSPEWFNKGSMATAALPESGSSLALRALGWGSLYAWCGVGVISFAVWKALGVHSMNDFRSKMQSIFPTIPKNSESAVEWEETLKSK

SEQ ID NO: 15488 - protein, 216 aa, Artificial Sequence
  Description of Artificial Sequence: Synthetic coding sequence
MPKGRAGSLPTTSIGWRFQLWFLGLTCPERHLARRLKNNSFYPFVQQEPNGAEARDLGLPRVRRGRGPVARDLVAAAAPPGAEPHARRVPLLHPGPHRVPGPLASGLRAPGAQLRCPRKVLLPPGPRRPQVGAPGAGAAVGALRANGILGPLHRPETQHQLLRLPGHLLPARGSPLATPWRWHCDGQEPHGSQAQLLSVQPGGVTLRASPTSGLCS

SEQ ID NO: 15489 - protein, 223 aa, Artificial Sequence
  Description of Artificial Sequence: Synthetic coding sequence
MEGLVFLNALATRLLFLLHSLVGVWRVTEVKKEPRYWLLALLNLLLFLETALTLKFKRGRGYKWFSPAIFLYLISIVPSLWLLELHHETQYCSIQAEGTSQNTSRKEDFNQTLTSNEQTSRADDLIETAKVFVNNLSTVCEKVWTLGLHQTFLLMLIIGRWLLPIGGGITRDQLSQLLLMFVGTAADILEFTSETLEEQNVRLCWKNSTNRRHTNPKWQLVLF

SEQ ID NO: 15490 - protein, 368 aa, Artificial Sequence
  Description of Artificial Sequence: Synthetic coding sequence
MEGLVFLNALATRLLFLLHSLVGVWRVTEVKKEPRYWLLALLNLLLFLETALTLKFKRGRGYKWFSPAIFLYLISIVPSLWLLELHHETQYCSIQAEGTSQNTSRKEDFNQTLTSNEQTSRADDLIETAKVFVNNLSTVCEKVWTLGLHQTFLLMLIIGRWLLPIGGGITRDQLSQLLLMFVGTAADILEFTSETLEEQNVRNSPALVYAILVIWTWSMLQFPLDLAVQNVVCPVSVTERGFPSLFFCQYSADLWNIGISVFIQDGPFLVVRLILMTYFKVINQMLVFFAAKNFLVVVLQLYRLVVLALAVRASLRSQSEGLKGEHGCRAQTSESGPSQRDWQNESKEGLAIPLRGSPVTSDDSHHTP

SEQ ID NO: 15491 - protein, 368 aa, Artificial Sequence; identical to SEQ ID NO: 15490
  Description of Artificial Sequence: Synthetic coding sequence

SEQ ID NO: 15492 - protein, 168 aa, Artificial Sequence
  Description of Artificial Sequence: Synthetic coding sequence
MRLTEKSEGEQQLKPNNSNAPNEDQEEEIQQSEQHTPARQRTQRADTQPSRCRLPSRRTPTTSSDRTINLLEVLPWPTEWIFNPYRLPALFELYPEFLLVFKEAFHDISHCLKAQMEKIGLPIILHLFALSTLYFYKFFLPTILSLSFFILLVLLLLLFIIVFILIFF

SEQ ID NO: 15493 - protein, 247 aa, Artificial Sequence
  Description of Artificial Sequence: Synthetic coding sequence
MADTTPNGPQGAGAVQFMMTNKLDTAMWLSRLFTVYCSALFVLPLLGLHEAASFYQRALLANALTSALRLHQRLPHFQLSRAFLAQALLEDSCHYLLYSLIFVNSYPVTMSIFPVLLFSLLHAATYTKKVLDARGSNSLPLLRSVLDKLSANQQNILKFIACNEIFLMPATVFMLFSGQGSLLQPFIYYRFLTLRYSSRRNPYCRTLFNELRIVVEHIIMKPACPLFVRRLCLQSIAFISRLAPTVP

SEQ ID NO: 15494 - protein, 247 aa, Artificial Sequence; identical to SEQ ID NO: 15493
  Description of Artificial Sequence: Synthetic coding sequence

SEQ ID NO: 15495 - protein, 222 aa, Artificial Sequence
  Description of Artificial Sequence: Synthetic coding sequence
MADTTPNGPQGAGAVQFMMTNKLDTAMWLSRLFTVYCSALFVLPLLGLHEAASFYQRALLANALTSALRLHQRLPHFQLSRAFLAQALLEDSCHYLLYSLIFVNSYPVTMSIFPVLLFSLLHAATYTKKVLDARGSNSLPLLRSVLDKLSANQQNILKFIACNEIFLMPATVFMLFSGQGSLLQPFIYYRFLTLRYSSRRNPYCRTLFNELRIVVEHIIMKP

SEQ ID NO: 15496 - protein, 247 aa, Artificial Sequence; identical to SEQ ID NO: 15493
  Description of Artificial Sequence: Synthetic coding sequence

SEQ ID NO: 15497 - protein, 167 aa, Artificial Sequence
  Description of Artificial Sequence: Synthetic coding sequence
MASPRTVTIVALSVALGLFFVFMGTIKLTPRLSKDAYSEMKRAYKSYVRALPLLKKMGINSILLRKSIGALEVACGIVMTLVPGRPKDVANFFLLLLVLAVLFFHQLVGDPLKRYAHALVFGILLTCRLLIARKPEDRSSEKKPLPGNAEEQPSLYEKAPQGKVKVS

SEQ ID NO: 15498 - protein, 126 aa, Artificial Sequence
  Description of Artificial Sequence: Synthetic coding sequence
MASPRTVTIVALSVALGLFFVFMGTIKLTPRLSKDAYSEMKRAYKSYVRALPLLKKMGINSILHQLVGDPLKRYAHALVFGILLTCRLLIARKPEDRSSEKKPLPGNAEEQPSLYEKAPQGKVKVS

SEQ ID NO: 15499 - protein, 190 aa, Artificial Sequence
  Description of Artificial Sequence: Synthetic coding sequence
MTAVGVQAQRPLGQRQPRRSFFESFIRTLIITCVALAVVLSSVSICDGHWLLAEDRLFGLWHFCTTTNQTICFRDLGQAHVPGLAVGMGLVRSVGALAVVAAIFGLEFLMVSQLCEDKHSQCKWVMGSILLLVSFVLSSGGLLGFVILLRNQVTLIGFTLMFWCEFTASFLLFLNAISGLHINSITHPWE

SEQ ID NO: 15500 - protein, 299 aa, Artificial Sequence
  Description of Artificial Sequence: Synthetic coding sequence
MELLSALSLGELALSFSRVPLFPVFDLSYFIVSILYLKYEPGAVELSRRHPIASWLCAMLHCFGSYILADLLLGEPLIDYFSNNSSILLASAVWYLIFFCPLDLFYKCVCFLPVKLIFVAMKEVVRVRKIAVGIHHAHHHYHHGWFVMIATGWVKGSGVALMSNFEQLLRGVWKPETNEILHMSFPTKASLYGAILFTLQQTRWLPVSKASLIFIFTLFMVSCKVFLTATHSHSSPFDALEGYICPVLFGSACGGDHHHDNHGGSHSGGGPGAQHSAMPAKSKEELSEGSRKKKAKKAD

SEQ ID NO: 15501 - protein, 237 aa, Artificial Sequence
  Description of Artificial Sequence: Synthetic coding sequence
MLHCFGGGILSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 15502 - protein, 291 aa, Artificial Sequence
  Description of Artificial Sequence: Synthetic coding sequence
MDSPWDELALAFSRTSMFPFFDIAHYLVSVMAVKRQPGAAALAWKNPISSWFTAMLHCFGGGILSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 15503 - protein, 35 aa, Artificial Sequence
  Description of Artificial Sequence: Synthetic coding sequence
MLHCFGGGILSCLLLAEPPLKFLANHTNILLASSI

SEQ ID NO: 15504 - protein, 162 aa, Artificial Sequence
  Description of Artificial Sequence: Synthetic coding sequence
  MOD_RES (1)..(1): Any amino acid
XSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKSLNWR

SEQ ID NO: 15505 - protein, 81 aa, Artificial Sequence
  Description of Artificial Sequence: Synthetic coding sequence
  MOD_RES (1)..(1): Any amino acid
XWIVMIAIGWARGAGGTIITNFERLVKGDWKPEGDEWLKMSYPAKVTLLGSVIFTFQHTQHLAISKHNLMFLYTIFIVATK

SEQ ID NO: 15506 - protein, 488 aa, Artificial Sequence
  Description of Artificial Sequence: Synthetic coding sequence
MPGGRRGPSRQQLSRSALPSLQTLVGGGCGNGTGLRNRNGSAIGLPVPPITALITPGPVRHCQIPDLPVDGSLLFEFLFFIYLLVALFIQYINIYKTVWWYPYNHPASCTSLNFHLIDYHLAAFITVMLARRLVWALISEATKAGAASMIHYMVLISARLVLLTLCGWVLCWTLVNLFRSHSVLNLLFLGYPFGVYVPLCCFHQDSRAHLLLTDYNYVVQHEAVEESASTVGGLAKSKDFLSLLLESLKEQFNNATPIPTHSCPLSPDLIRNEVECLKADFNHRIKEVLFNSLFSAYYVAFLPLCFVKSTQYYDMRWSCEHLIMVWINAFVMLTTQLLPSKYCDLLHKSAAHLGKWQKLEHGSYSNAPQHIWSENTIWPQGVLVRHSRCLYRAMGPYNVAVPSDVSHARFYFLFHRPLRLLNLLILIEGSVVFYQLYSLLRSEKWNHTLSMALILFCNYYVLFKLLRDRIVLGRAYSYPLNSYELKAN

SEQ ID NO: 15507 - protein, 112 aa, Artificial Sequence
  Description of Artificial Sequence: Synthetic coding sequence
MPGGRRGPSRQQLSRSALPSLQTLVGGGCGNGTGLRNRNGSAIGLPVPPITALITPGPVRHCQIPDLPVDGSLLFEFLFFIYLLVALFIQYINIYKTVWWYPYNHPASCTSL

SEQ ID NO: 15508 - protein, 192 aa, Artificial Sequence
  Description of Artificial Sequence: Synthetic coding sequence
MPGGRRGPSRQQLSRSALPSLQTLVGGGCGNGTGLRNRNGSAIGLPVPPITALITPGPVRHCQIPDLPVDGSLLFEFLFFIYLLVALFIQYINIYKTVWWYPYNHPASCTSLNFHLIDYHLAAFITVMLARRLVWALISEATKAGAASMIHYMVLISARLVLLTLCGWVLCWTLVNLFRSHSVLNLLFLGYP

SEQ ID NO: 15509 - protein, 140 aa, Artificial Sequence
  Description of Artificial Sequence: Synthetic coding sequence
MPGGRRGPSRQQLSRSALPSLQTLVGGGCGNGTGLRNRNGSAIGLPVPPITALITPGPVRHCQIPDLPVDGSLLFEFLFFIYLLVALFIQYINIYKTVWWYPYNHPASCTSLNFHLIDYHLAAFITVMLARRLVWALISE

SEQ ID NO: 15510 - protein, 492 aa, Artificial Sequence
  Description of Artificial Sequence: Synthetic coding sequence
MGGRRGPNRTSYCRNPLCEPGSSGGSSGSHTSSASVTSVRSRTRSSSGTGLSSPPLATQTVVPLQHCKIPELPVQASILFELQLFFCQLIALFVHYINIYKTVWWYPPSHPPSHTSLNFHLIDFNLLMVTTIVLGRRFIGSIVKEASQRGKVSLFRSILLFLTRFTVLTATGWSLCRSLIHLFRTYSFLNLLFLCYPFGMYIPFLQLNCDLRKTSLFNHMASMGPREAVSGLAKSRDYLLTLRETWKQHTRQLYGPDAMPTHACCLSPSLIRSEVEFLKMDFNWRMKEVLVSSMLSAYYVAFVPVWFVKNTHYYDKRWSCELFLLVSISTSVILMQHLLPASYCDLLHKAAAHLGCWQKVDPALCSNVLQHPWTEECMWPQGVLVKHSKNVYKAVGHYNVAIPSDVSHFRFHFFFSKPLRILNILLLLEGAVIVYQLYSLMSSEKWHQTISLALILFSNYYAFFKLLRDRLVLGKAYSYSASPQRDLDHRFS

SEQ ID NO: 15511 - protein, 192 aa, Artificial Sequence
  Description of Artificial Sequence: Synthetic coding sequence
MGGRRGPNRTSYCRNPLCEPGSSGGSSGSHTSSASVTSVRSRTRSSSGTGLSSPPLATQTVVPLQHCKIPELPVQASILFELQLFFCQLIALFVHYINIYKTVWWYPPSHPPSHTSLASQRGKVSLFRSILLFLTRFTVLTATGWSLCRSLIHLFRTYSFLNLLFLCYPFGMYIPFLQLNCDLRKTSLFNHM

SEQ ID NO: 15512 - protein, 293 aa, Artificial Sequence
  Description of Artificial Sequence: Synthetic coding sequence
MYIPFLQLNCDLRKTSLFNHMASMGPREAVSGLAKSRDYLLTLRETWKQHTRQLYGPDAMPTHACCLSPSLIRSEVEFLKMDFNWRMKEVLVSSMLSAYYVAFVPVWFVKNTHYYDKRWSCELFLLVSISTSVILMQHLLPASYCDLLHKAAAHLGCWQKVDPALCSNVLQHPWTEECMWPQGVLVKHSKNVYKAVGHYNVAIPSDVSHFRFHFFFSKPLRILNILLLLEGAVIVYQLYSLMSSEKWHQTISLALILFSNYYAFFKLLRDRLVLGKAYSYSASPQRDLDHRFS

SEQ ID NO: 15513 - protein, 342 aa, Artificial Sequence
  Description of Artificial Sequence: Synthetic coding sequence
MKNFHLIDFNLLMVTTIVLGRRFIGSIVKEASQRGKVSLFRSILLFLTRFTVLTATGWSLCRSLIHLFRTYSFLNLLFLCYPFGMYIPFLQLNCDLRKTSLFNHMASMGPREAVSGLAKSRDYLLTLRETWKQHTRQLYGPDAMPTHACCLSPSLIRSEVEFLKMDFNWRMKEVLVSSMLSAYYVAFVPVWFVKNTHYYDKRWSCELFLLVSISTSVILMQHLLPASYCDLLHKAAAHLGCWQKVDPALCSNVLQHPWTEECMWPQGVLVKHSKNVYKAVGHYNVAIPSDVSHFRFHVSLLPGEGGLGPERVGGSAGQECDVIARESYFQYFPNPKEDSAHM

SEQ ID NO: 15514 - protein, 192 aa, Artificial Sequence; identical to SEQ ID NO: 15511
  Description of Artificial Sequence: Synthetic coding sequence

SEQ ID NO: 15515 - protein, 221 aa, Artificial Sequence
  Description of Artificial Sequence: Synthetic coding sequence
MGGRRGPNRTSYCRNPLCEPGSSGGSSGSHTSSASVTSVRSRTRSSSGTGLSSPPLATQTVVPLQHCKIPELPVQASILFELQLFFCQLIALFVHYINIYKTVWWYPPSHPPSHTSLNFHLIDFNLLMVTTIVLGRRFIGSIVKEVWDVHSVPAAELRPPQDKPLQPHGLHGAPGGGQWPGKEPGLPPDTAGDVEAAHKTAVWPGRHAHPCLLPVTQPHPQ

SEQ ID NO: 15516 - protein, 233 aa, Artificial Sequence
  Description of Artificial Sequence: Synthetic coding sequence
METSASSSQPQDNSQVHRETEDVDYGETDFHKQDGKAGLFSQEQYERNKSSSSSSSSSSSSSSSSSSSSSESNDEDQQPRATGKHRRSLGAGYPHGNGSPGPGHGEPDVLKDELQLYGDAPGEVVPSGESGLRRRGSDPASGEVEASQLRRLNIKKDDEFFHFVLLCFAIGALLVCYHYYADWFMSLGVGLLTFASLETVGIYFGLVYRIHSVLQGFIPLFQKFRLTGFRKTD

SEQ ID NO: 15517 - protein, 233 aa, Artificial Sequence; identical to SEQ ID NO: 15516
  Description of Artificial Sequence: Synthetic coding sequence

SEQ ID NO: 15518 - protein, 249 aa, Artificial Sequence
  Description of Artificial Sequence: Synthetic coding sequence
MAEAGAGSLSLPGGKAMETSASSSQPQDNSQVHRETEDVDYGETDFHKQDGKAGLFSQEQYERNKSSSSSSSSSSSSSSSSSSSSSESNDEDQQPRATGKHRRSLGAGYPHGNGSPGPGHGEPDVLKDELQLYGDAPGEVVPSGESGLRRRGSDPASGEVEASQLRRLNIKKDDEFFHFVLLCFAIGALLVCYHYYADWFMSLGVGLLTFASLETVGIYFGLVYRIHSVLQGFIPLFQKFRLTGFRKTD

SEQ ID NO: 15519 - protein, 203 aa, Artificial Sequence
  Description of Artificial Sequence: Synthetic coding sequence
METSASSSQPQDNSQVHRETEDVDYGETDFHKQDGKAGLFSQEQYERNKSSSSSSSSSSSSSSSSSSSSSGPGHGEPDVLKDELQLYGDAPGEVVPSGESGLRRRGSDPASGEVEASQLRRLNIKKDDEFFHFVLLCFAIGALLVCYHYYADWFMSLGVGLLTFASLETVGIYFGLVYRIHSVLQGFIPLFQKFRLTGFRKTD

SEQ ID NO: 15520 - protein, 157 aa, Artificial Sequence
  Description of Artificial Sequence: Synthetic coding sequence
METSASSSQPQDNSQVHRETEDVDCPGHGEPDVLKDELQLYGDAPGEVVPSGESGLRRRGSDPASGEVEASQLRRLNIKKDDEFFHFVLLCFAIGALLVCYHYYADWFMSLGVGLLTFASLETVGIYFGLVYRIHSVLQGFIPLFQKFRLTGFRKTD

SEQ ID NO: 15521 - protein, 264 aa, Artificial Sequence
  Description of Artificial Sequence: Synthetic coding sequence
MRPLLGLLLVFAGCTFALYLLSTRLPRGRRLGSTEEAGGRSLWFPSDLAELRELSEVLREYRKEHQAYVFLLFCGAYLYKQGFAIPGSSFLNVLAGALFGPWLGLLLCCVLTSVGATCCYLLSSIFGKQLVVSYFPDKVALLQRKVEENRNSLFFFLLFLRLFPMTPNWFLNLSAPILNIPIVQFFFSVLIGLIPYNFICVQTGSILSTLTSLDALFSWDTVFKLLAIAMVALIPGTLIKKFSQKHLQLNETSTANHIHSRKDT

SEQ ID NO: 15522 - protein, 291 aa, Artificial Sequence
  Description of Artificial Sequence: Synthetic coding sequence
MAKGRVAERSQLGAHHTTPVGDGAAGTRGLAAPGSRDHQKEKSWVEAGSARMSLLILVSIFLSAAFVMFLVYKNFPQLSEEERVNMKVPRDMDDAKALGKVLSKYKDTFYVQVLVAYFATYIFLQTFAIPGSIFLSILSGFLYPFPLALFLVCLCSGLGASFCYMLSYLVGRPVVYKYLTEKAVKWSQQVERHREHLINYIIFLRITPFLPNWFINITSPVINVPLKVFFIGTFLGVAPPSFVAIKAGTTLYQLTTAGEAVSWNSIFILMILAVLSILPAIFQKKLKQKFE

SEQ ID NO: 15523 - protein, 291 aa, Artificial Sequence; identical to SEQ ID NO: 15522
  Description of Artificial Sequence: Synthetic coding sequence

SEQ ID NO: 15524 - protein, 127 aa, Artificial Sequence
  Description of Artificial Sequence: Synthetic coding sequence
MAKGRVAERSQLGAHHTTPVGDGAAGTRGLAAPGSRDHQKEKSWVEAGSARMSLLILVSIFLSAAFVMFLVYKNFPQLSEEERVNMKVPRDMDDAKALGKVLSKYKDTFYVQVLVAYFATYILYPFN

SEQ ID NO: 15525 - protein, 159 aa, Artificial Sequence
  Description of Artificial Sequence: Synthetic coding sequence
MAERPGPPGGAVSATAYPDTPAEFPPHLQAGAMRRRFWGVFNCLCAGAFGALAAASAKLAFGSEVSMGLCVLGIIVMASTNSLMWTFFSRGLSFSMSSAIASVTVTFSNILSSAFLGYVLYGECQEVLWWGGVFLILCGLTLIHRKLPPTWKPLPHKQQ

SEQ ID NO: 15526 - protein, 275 aa, Artificial Sequence
  Description of Artificial Sequence: Synthetic coding sequence
MGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLVKSRLKRLCSSEVGLLKNAEREQESEEEM

SEQ ID NO: 15527 - protein, 291 aa, Artificial Sequence
  Description of Artificial Sequence: Synthetic coding sequence
MTNDSEGKMGFKHPKIMGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLVKSRLKRLCSSEVGLLKNAEREQESEEEM

SEQ ID NO: 15528 - protein, 275 aa, Artificial Sequence
  Description of Artificial Sequence: Synthetic coding sequence
MANFKGHALPGSFFLIIGLCWSVKYPLKYFSHTRKNSPLHYYQRLEIVEAAIRTLFSVTGILAEQFVPDGPHLHLYHENHWIKLMNWQHSTMYLFFAVSGIVDMLTYLVSHVPLGVDRLVMAVAVFMEGFLFYYHVHNRPPLDQHIHSLLLYALFGGCVSISLEVIFRDHIVLELFRTSLIILQGTWFWQIGFVLFPPFGTPEWDQKDDANLMFITMCFCWHYLAALSIVAVNYSLVYCLLTRMKRHGRGEIIGIQKLNSDDTYQTALLSGSDEE

SEQ ID NO: 15529 - protein, 275 aa, Artificial Sequence; identical to SEQ ID NO: 15528
  Description of Artificial Sequence: Synthetic coding sequence

SEQ ID NO: 15530 - protein, 157 aa, Artificial Sequence
  Description of Artificial Sequence: Synthetic coding sequence
MSGFLEGLRCSECIDWGEKRNTIASIAAGVLFFTGWWIIIDAAVIYPTMKDFNHSYHACGVIATIAFLMINAVSNGQVRGDSYSEGCLGQTGARIWLFVGFMLAFGSLIASMWILFGGYVAKEKDIVYPGIAVFFQNAFIFFGGLVFKFGRTEDLWQ

SEQ ID NO: 15531 - protein, 158 aa, Artificial Sequence
  Description of Artificial Sequence: Synthetic coding sequence
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVWLFIGFMLMFGSLIASMWILFGAYVTQNTDVYPGLAVFFQNALIFFSTLIYKFGRTEELWT

SEQ ID NO: 15532 - protein, 81 aa, Artificial Sequence
  Description of Artificial Sequence: Synthetic coding sequence
MAGFLDNFRWPECECIDWSERRNAVASVVAGILFFTGWWIMIDAAVVYPKPEQLNHAFHTCGVFSTLAFFMINAVSNAQVR

SEQ ID NO: 15533 - protein, 62 aa, Artificial Sequence
  Description of Artificial Sequence: Synthetic coding sequence
MAGFLDNFRWPECECIDWSERRNAVASVVAGILFFTGWWIMIDAAVVYPKPEQLNHAFHTCG

SEQ ID NO: 15534 - protein, 126 aa, Artificial Sequence
  Description of Artificial Sequence: Synthetic coding sequence
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVWLFIGFMLMFGSLIASMWILFGAYVTQNL

SEQ ID NO: 15535 - protein, 158 aa, Artificial Sequence; identical to SEQ ID NO: 15531
  Description of Artificial Sequence: Synthetic coding sequence

SEQ ID NO: 15536 - protein, 253 aa, Artificial Sequence
  Description of Artificial Sequence: Synthetic coding sequence
MMAQSKANGSHYALTAIGLGMLVLGVIMAMWNLVPGFSAAEKPTAQGSNKTEVGGGILKSKTFSVAYVLVGAGVMLLLLSICLSIRDKRKQRQGEDLAHVQHPTGAGPHAQEEDSQEEEEEDEEAASRYYVPSYEEVMNTNYSEARGEEQNPRLSISLPSYESLTGLDETTPTSTRADVEASPGNPPDRQNSKLAKRLKPLKVRRIKSEKLHLKDFRINLPDKNVPPPSIEPLTPPPQYDEVQEKAPDTRPPD

SEQ ID NO: 15537 - protein, 253 aa, Artificial Sequence; identical to SEQ ID NO: 15536
  Description of Artificial Sequence: Synthetic coding sequence

SEQ ID NO: 15538 - protein, 253 aa, Artificial Sequence; identical to SEQ ID NO: 15536
  Description of Artificial Sequence: Synthetic coding sequence

SEQ ID NO: 15539 - protein, 253 aa, Artificial Sequence; identical to SEQ ID NO: 15536
  Description of Artificial Sequence: Synthetic coding sequence

SEQ ID NO: 15540 - protein, 253 aa, Artificial Sequence; identical to SEQ ID NO: 15536
  Description of Artificial Sequence: Synthetic coding sequence

SEQ ID NO: 15541 - protein, 253 aa, Artificial Sequence; identical to SEQ ID NO: 15536
  Description of Artificial Sequence: Synthetic coding sequence

SEQ ID NO: 15542 - protein, 175 aa, Artificial Sequence
  Description of Artificial Sequence: Synthetic coding sequence
MMAQSKANGSHYALTAIGLGMLVLGVIMAMWNLVPGFSAAEKPTAQGSNKTEVGGGILKSKTFSVAYVLVGAGVMLLLLSICLSIRDKRKQRQGEDLAHVQHPTGAGPHAQEEDSQEEEEEDEEAASRYYVPSYEEVMNTNYSEARGEEQNPRLSISLPSYESLTGLDETTPTST

SEQ ID NO: 15543 - protein, 209 aa, Artificial Sequence
  Description of Artificial Sequence: Synthetic coding sequence
MARGPLAARGLRLLLPLLPLLPLLPLPQVALGFADGSCDPSDQCPPQARWSSLWHVGLILLAVLLLLLCGVTAGCVRFCCLRKQAQAQPHLPPARQPCDVAVIPMDSDSPVHSTVTSYSSVQYPLGMRLPLPFGELDLDSMAPPAYSLYTPEPPPSYDEAVKMAKPREEGPALSQKPSPLLGASGLETTPVPQESGPNTQLPPCSPGAP

SEQ ID NO: 15544 - protein, 124 aa, Artificial Sequence
  Description of Artificial Sequence: Synthetic coding sequence
GGRWPPADCGCCCRSCRSCRSCRCRRWVGRRSLSVRPPRGGSLLGPRPSRAHPCPHRWRWASRTAAATPRTSARPRPAGAACGTWACTPRSLHPPTMKLSRWPSPERKDQHSPRNPALSLGPRA

SEQ ID NO: 15545 - protein, 194 aa, Artificial Sequence
  Description of Artificial Sequence: Synthetic coding sequence
MERHCLLFILLTCLRWLCHDIPQGAGARWPRVSPVVEPCSPRLILLAVLLLLLCGVTAGCVRFCCLRKQAQAQPHLPPARQPCDVAVIPMDSDSPVHSTVTSYSSVQYPLGMRLPLPFGELDLDSMAPPAYSLYTPEPPPSYDEAVKMAKPREEGPALSQKPSPLLGASGLETTPVPQESGPNTQLPPCSPGAP

SEQ ID NO: 15546 - protein, 103 aa, Artificial Sequence
  Description of Artificial Sequence: Synthetic coding sequence
MARGPLAARGLRLLLPLLPLLPLLPLPQVGRAAFSLGSATAGRVPARTTPLPGSPLSPQVALGFADGSCDPSDQCPPQARWSSLWHVGLILLAVLLLLLCGVT

SEQ ID NO: 15547 - protein, 247 aa, Artificial Sequence
  Description of Artificial Sequence: Synthetic coding sequence
MASAELDYTIEIPDQPCWSQKNSPSPGGKEAETRQPVVILLGWGGCKDKNLAKYSAIYHKRKLLELLFDYEIEKEPLLFHVFSNGGVMLYRYVLELLQTRRFCRLRVVGTIFDSAPGDSNLVGALRALAAILERRAAMLRLLLLVAFALVVVLFHVLLAPITALFHTHFYDRLQDAGSRWPELYLYSRADEVVLARDIERMVEARLARRVLARSVDFVSSAHVSHLRDYPTYYTSLCVDFMRNCVRC

SEQ ID NO: 15548 - protein, 277 aa, Artificial Sequence
  Description of Artificial Sequence: Synthetic coding sequence
MASAELDYTIEIPDQPCWSQKNSPSPGGKEAETRQPVVILLGWGGCKDKNLAKYSAIYHKRGCIVIRYTAPWHMVFFSESLGIPSLRVLAQKLLELLFDYEIEKEPLLFHVFSNGGVMLYRYVLELLQTRRFCRLRVVGTIFDSAPGDSNLVGALRALAAILERRAAMLRLLLLVAFALVVVLFHVLLAPITALFHTHFYDRLQDAGSRWPELYLYSRADEVVLARDIERMVEARLARRVLARSVDFVSSAHVSHLRDYPTYYTSLCVDFMRNCVRC

SEQ ID NO: 15549 - protein, 201 aa, Artificial Sequence
  Description of Artificial Sequence: Synthetic coding sequence
MASAELDYTIEIPDQPCWSQKNSPSPGGKEAETRQPVVILLGWGGCKDKNLAKYSAIYHKRGCIVIRYTAPWHMVFFSESLGIPSLRVLAQKLLELLFDYEIEKEPLLFHVFSNGGVMLYRYVLELLQTRRFCRLRVVGTIFDSAPGDSNLVFCMASCLLLSPLLVDGISAGTEGQLTLRPDWAAQVLTRLGCHLQCITRS

SEQ ID NO: 15550 - protein, 111 aa, Artificial Sequence
  Description of Artificial Sequence: Synthetic coding sequence
MASAELDYTIEIPDQPCWSQKNSPSPGGKEAETRQPVVILLGWGGCKDKNLAKYSAIYHKRVFCMASCLLLSPLLVDGISAGTEGQLTLRPDWAAQVLTRLGCHLQCITRS

SEQ ID NO: 15551 - protein, 78 aa, Artificial Sequence
  Description of Artificial Sequence: Synthetic coding sequence
MASAELDYTIEIPDQPCWSQSLLHGLLLAAFTIAGGWHLCWDRGATHTPARLGSTGANAAWLSPSMHHPKLRAPLRHS

SEQ ID NO: 15552 - protein, 135 aa, Artificial Sequence
  Description of Artificial Sequence: Synthetic coding sequence
MASAELDYTIEIPDQPCWSQKNSPSPGGKEAETRQPVVILLGWGGCKDKNLAKYSAIYHKRLLELLFDYEIEKEPLLFHVFSNGGVMLYRYVLELLQTRRFCRLRVVGTIFDSAPGDSNLVGALRALAAILERRA

SEQ ID NO: 15553 - protein, 169 aa, Artificial Sequence
  Description of Artificial Sequence: Synthetic coding sequence
MCLRLGGLSVGDFRKVLMKTGLVLVVLGHVSFITAALFHGTVLRYVGTPQDAVALQYCVVNILSVTSAIVGKALLAACTFGSSELLALAPDCPFDPTRIYSSSLCLWGIALVLCVAENVFAVRCAQLTHQLLELRPWWGKSSHHMMRENPELVEGRDLLSCTSSEPLTL

SEQ ID NO: 15554 - protein, 222 aa, Artificial Sequence
  Description of Artificial Sequence: Synthetic coding sequence
MCLRLGGLSVGDFRKVLMKTGLVLVVLGHVSFITAALFHGTVLRYVGTPQDAVALQYCVVNILSVTSAIVVITSGIAAIVLSRYLPSTPLRWTVFSSSVACALLSLTCALGLLASIAMTFATQGKALLAACTFGSSELLALAPDCPFDPTRIYSSSLCLWGIALVLCVAENVFAVRCAQLTHQLLELRPWWGKSSHHMMRENPELVEGRDLLSCTSSEPLTL

SEQ ID NO: 15555 - protein, 277 aa, Artificial Sequence
  Description of Artificial Sequence: Synthetic coding sequence
MAADGERSPLLSEPIDGGAGGNGLVGPGGSGAGPGGGLTPSAPPYGAAFPPFPEGHPAVLPGEDPPPYSPLTSPDSGSAPMITCRVCQSLINVEGKMHQHVVKCGVCNEATPIKNAPPGKKYVRCPCNCLLICKVTSQRIACPRPYCKRIINLGPVHPGPLSPEPQPMGVRVICGHCKNTFLWTEFTDRTLARCPHCRKVSSIGRRYPRKRCICCFLLGLLLAVTATGLAFGTWKHARRYGGIYAAWAFVILLAVLCLGRALYWACMKVSHPVQNFS

SEQ ID NO: 15556 - protein, 284 aa, Artificial Sequence
  Description of Artificial Sequence: Synthetic coding sequence
MAADGERSPLLSEPIDGGAGGNGLVGPGGSGAGPGGGLTPSAPPYGAGKHAPPQAFPPFPEGHPAVLPGEDPPPYSPLTSPDSGSAPMITCRVCQSLINVEGKMHQHVVKCGVCNEATPIKNAPPGKKYVRCPCNCLLICKVTSQRIACPRPYCKRIINLGPVHPGPLSPEPQPMGVRVICGHCKNTFLWTEFTDRTLARCPHCRKVSSIGRRYPRKRCICCFLLGLLLAVTATGLAFGTWKHARRYGGIYAAWAFVILLAVLCLGRALYWACMKVSHPVQNFS

SEQ ID NO: 15557 - protein, 263 aa, Artificial Sequence
  Description of Artificial Sequence: Synthetic coding sequence
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGNFRLLAELSSPFVNQRWFFEALKYPKFSKAIVINGILMTVVFFIVRIASMLPHYGFMYSVYGTEPYIRLGVLIQLSWVISCVVLDVMNVMWMIKISKGCIKVISHIRQEKAKNSLQNGKLD

SEQ ID NO: 15558 - protein, 143 aa, Artificial Sequence
  Description of Artificial Sequence: Synthetic coding sequence
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGN

SEQ ID NO: 15559 - protein, 154 aa, Artificial Sequence
  Description of Artificial Sequence: Synthetic coding sequence
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGNFRLLAELSSPF

SEQ ID NO: 15560 - protein, 664 aa, Artificial Sequence
  Description of Artificial Sequence: Synthetic coding sequence
MKRRNADCSKLRRPLKRNRITEGIYGSTFLYLKFLVVWALVLLADFVLEFRFEYLWPFWLFIRSVYDSFRYQGLAFSVFFVCVAFTSNIICLLFIPIQWLFFAASTYVWVQYVWHTERGVCLPTVSLWILFVYIEAAIRFKDLKNFHVDLCRPFAAHCIGYPVVTLGFGFKSYVSYKMRLRKQKEVQKENEFYMQLLQQALPPEQQMLQKQEKEAEEAAKGLPDMDSSILIHHNGGIPANKKLSTTLPEIEYREKGKEKDKDAKKHNLGINNNNILQPVDSKIQEIEYMENHINSKRLNNDLVGSTENLLKEDSCTASSKNYKNASGVVNSSPRSHSATNGSIPSSSSKNEKKQKCTSKSPSTHKDLMENCIPNNQLSKPDALVRLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQELRKYKENEKDTEVLMSALSAMQDKTQHLENSLSAETRIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 15561 - protein, 306 aa, Artificial Sequence
  Description of Artificial Sequence: Synthetic coding sequence
MKRRNADCSKLRRPLKRNRITEGIYGRLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQELRKYKENEKDTEVLMSALSAMQDKTQHLENSLSAETRIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 15562 - protein, 437 aa, Artificial Sequence
  Description of Artificial Sequence: Synthetic coding sequence
MKRRNADCSKLRRPLKRNRITEGIYGSTFLYLKFLVVWALVLLADFVLEFRFEYLWPFWLFIRSVYDSFRYQGLAFSVFFVCVAFTSNIICLLFIPIQWLFFAASTYVWVQYVWHTERGVCLPTVSLWILFVYIEAAIRFKDLKNFHVDLCRPFAAHWLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQELRKYKENEKDTEVLMSALSAMQDKTQHLENSLSAETRIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 15563 - protein, 323 aa, Artificial Sequence
  Description of Artificial Sequence: Synthetic coding sequence
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 15564 - protein, 145 aa, Artificial Sequence
  Description of Artificial Sequence: Synthetic coding sequence
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQVRNNTAFQTSLLRWH

SEQ ID NO: 15565 - protein, 283 aa, Artificial Sequence
  Description of Artificial Sequence: Synthetic coding sequence
MAAPKGSLWVRTQLGLPPLLLLTMALAGGSGTASAEAFDSVLGDTASCHRACQLTYPLHTYPKVSASLYTVDHIEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSE

SEQ ID NO: 15566 - protein, 192 aa, Artificial Sequence
  Description of Artificial Sequence: Synthetic coding sequence
MSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 15567 - protein, 192 aa, Artificial Sequence; identical to SEQ ID NO: 15566
  Description of Artificial Sequence: Synthetic coding sequence

SEQ ID NO: 15568 - protein, 192 aa, Artificial Sequence; identical to SEQ ID NO: 15566
  Description of Artificial Sequence: Synthetic coding sequence

SEQ ID NO: 15569 - protein, 144 aa, Artificial Sequence
  Description of Artificial Sequence: Synthetic coding sequence
MSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEVNL

SEQ ID NO: 15570 - protein, 144 aa, Artificial Sequence; identical to SEQ ID NO: 15569
  Description of Artificial Sequence: Synthetic coding sequence

SEQ ID NO: 15571 - protein, 285 aa, Artificial Sequence
  Description of Artificial Sequence: Synthetic coding sequence
MAAPKGSLWVRTQLGLPPLLLLTMALAGGSGTASAEAFDSVLGDTASCHRACQLTYPLHTYPKVSASLYTVDHIEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEVN

SEQ ID NO: 15572 - protein, 342 aa, Artificial Sequence
  Description of Artificial Sequence: Synthetic coding sequence
MAAVALMPPPLLLLLLLASPPAASAPSARDPFAPQLGDTQNCQLRCRDRDLGPQPSQAGLEGASESPYDRAVLISACERGCRLFSICRFVARSSKPNATQTECEAACVEAYVKEAEQQACSHGCWSQPAEPEPEQKRKVLEAPSGALSLLDLFSTLCNDLVNSAQGFVSSTWTYYLQTDNGKVVVFQTQPIVESLGFQGGRLQRVEVTWRGSHPEALEVHVDPVGPLDKVRKAKIRVKTSSKAKVESEEPQDNDFLSCMSRRSGLPRWILACCLFLSVLVMLWLSCSTLVTAPGQHLKFQPLTLEQHKGFMMEPDWPLYPPPSHACEDSLPPYKLKLDLTKL

SEQ ID NO: 15573 - protein, 342 aa, Artificial Sequence; identical to SEQ ID NO: 15572
  Description of Artificial Sequence: Synthetic coding sequence

SEQ ID NO: 15574 - protein, 133 aa, Artificial Sequence
  Description of Artificial Sequence: Synthetic coding sequence
MRMSLAQRVLLTWLFTLLFLIMLVLKLDEKAPWNWFLIFIPVWIFDTILLVLLIVKMAGRCKSGFDPRHGSHNIKKKAWYLIAMLLKLAFCLALCAKLEQFTTMNLSYVFIPLWALLAGALTELGYNVFFVRD

SEQ ID NO: 15575 - protein, 210 aa, Artificial Sequence
  Description of Artificial Sequence: Synthetic coding sequence
MALPQMCDGSHLASTLRYCMTVSGTVVLVAGTLCFAWWSEGDATAQPGQLAPPTEYPVPEGPSPLLRSVSFVCCGAGGLLLLIGLLWSVKASIPGPPRWDPYHLSRDLYYLTVESSEKESCRTPKVVDIPTYEEAVSFPVAEGPPTPPAYPTEEALEPSGSRDALLSTQPAWPPPSYESISLALDAVSAETTPSATRSCSGLVQTARGGS

SEQ ID NO: 15576 - protein, 643 aa, Artificial Sequence
  Description of Artificial Sequence: Synthetic coding sequence
MAAVLALRVVAGLAAAALVAMLLEHYGLAGQPSPLPRPAPPRRPHPAPGPGDSNIFWGLQISDIHLSRFRDPGRAVDLEKFCSETIDIIQPALVLATGDLTDAKTKEQLGSRQHEVEWQTYQGILKKTRVMEKTKWLDIKGNHDAFNIPSLDSIKNYYRKYSAVRRDGSFHYVHSTPFGNYSFICVDATVNPGPKRPYNFFGILDKKKMEELLLLAKESSRSNHTIWFGHFTTSTILSPSPGIRSIMSSAIAYLCGHLHTLGGLMPVLHTRHFQGTLELEVGDWKDNRRYRIFAFDHDLFSFADLIFGKWPVVLITNPKSLLYSCGEHEPLERLLHSTHIRVLAFSLSSITSVTVKIDGVHLGQAVHVSGPIFVLKWNPRNYSSGTHNIEVIVQDSAGRSKSVHHIFSVQENNHLSFDPLASFILRTDHYIMARVLFVLIVLSQLTILIIFRYRGYPELKEPSGFINLTSFSLHVLSKINIFYYSVLLLTLYTVLGPWFFGEIIDGKFGCCFSFGIFVNGHFLQGSITFIIGILQLAFFNIPLMAYMCWSLLQRCFGHNFRSHLHQRKYLKIMPVHLLMLLLYIWQVYSCYFLYATYGTLAFLFSPLRTWLTLLTPVLIRYVWTLNSTKFGIFMVQLKSHLSS

SEQ ID NO: 15577 - protein, 807 aa, Artificial Sequence
  Description of Artificial Sequence: Synthetic coding sequence
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLTAIFRLHDDQILEWCGEDAIHYLSFQRHIIFLLVVVSFLSLCVILPVNLSGDLLDKDPYSFGRTTIANLQTDNDLLWLHTIFAVIYLFLTVGFMRHHTQSIKYKEENLVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTPYVPRILNGLASERTALSPQQQQQQTYGAIHNISGTIPGQCLAQSATGSVAAAPQEA

SEQ ID NO: 15578 - protein, 118 aa, Artificial Sequence
  Description of Artificial Sequence: Synthetic coding sequence
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLT

SEQ ID NO: 15579 - protein, 82 aa, Artificial Sequence
  Description of Artificial Sequence: Synthetic coding sequence
MKDRLLERITEEERHVQDQPLGMAFVTFQEKSMATYILKDFNACKCQSLQCKGEPQPSSHSRELYTSKWTVTFAADPEDICW

SEQ ID NO: 15580 - protein, 832 aa, Artificial Sequence
  Description of Artificial Sequence: Synthetic coding sequence
MLPFLLATLGTTALNNSNPKDYCYSARIRSTVLQGLPFGGVPTVLALDFMCFLALLFLFSILRKVAWDYGRLALVTDADRLRRQERDRVEQEYVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRHTSKMRYKEDDLVKRTLFINGISKYAESEKIKKHFEEAYPNCTVLEARPCYNVARLMFLDAERKKAERGKLYFTNLQSKENVPTMINPKPCGHLCCCVVRGCEQVEAIEYYTKLEQKLKEDYKREKEKVNEKPLGMAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 15581 - protein, 832 aa, Artificial Sequence; identical to SEQ ID NO: 15580
  Description of Artificial Sequence: Synthetic coding sequence

SEQ ID NO: 15582 - protein, 226 aa, Artificial Sequence
  Description of Artificial Sequence: Synthetic coding sequence
MLPFLLATLGTTALNNSNPKDYCYSARIRSTVLQGLPFGGVPTVLALDFMCFLALLFLFSILRKVAWDYGRLALVTDADRLRRQERDRVEQEYVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRH

SEQ ID NO: 15583 - protein, 806 aa, Artificial Sequence
  Description of Artificial Sequence: Synthetic coding sequence
MSASPDDLSTGGRLQNMTVDECFQSRNTVLQGQPFGGVPTVLCLNIALWVLVLVVYSFLRKAAWDYGRLALLIHNDSLTSLIYGEQSEKTSPSETSLEMERRDKGFCSWFFNSITMKDEDLINKCGDDARIYIVFQYHLIIFVLIICIPSLGIILPINYTGSVLDWSSHFARTTIVNVSTESKLLWLHSLLSFFYFITNFMFMAHHCLGFAPRNSQKVTRTLMITYVPKDIEDPELIIKHFHEAYPGSVVTRVHFCYDVRNLIDLDDQRRHAMRGRLFYTAKAKKTGKVMIRIHPCARLCFCKCWTCFKEVDAEQYYSELEEQLTDEFNAELNRVPLKRLDLIFVTFQDSRMAKRVRKDYKYVQCGVQPQQSSVTTIVKSYYWRVTMAPHPKDIIWKHLSVRRFFWWARFIAINTFLFFLFFFLTTPAIIMNTIDMYNVTRPIEKLQNPIVTQFFPSVMLWGFTVILPLIVYFSAFLEAHWTRSSQNLVMVHKCYIFLVFMVVILPSMGLTSLDVFLRWLFDIYYLEQASIRFQCVFLPDNGAFFVNYVITAALLGTGMELLRLGSLFCYSTRLFFSRSEPERVNIRKNQAIDFQFGREYAWMMNVFSVVMAYSITCPIIVPFGLLYLCMKHLTDRYNMYYSFAPTKLNEQIHMAAVSQAIFAPLLGLFWMLFFSILRLGSLHAITIFSLSTLLIAMVIAFVGIFLGKLRMVADYEPEEEEIQTVFDMEPSSTSSTPTSLLYVATVLQEPELNLTPASSPARHTYGTMNNQPEEGEEESGLRGFARELDSAQFQEGLELEGQNQYH

SEQ ID NO: 15584 - protein, 376 aa, Artificial Sequence
  Description of Artificial Sequence: Synthetic coding sequence
MNTIDMYNVTRPIEKLQNPIVTQFFPSVMLWGFTVILPLIVYFSAFLEAHWTRSSQNLVMVHKCYIFLVFMVVILPSMGLTSLDVFLRWLFDIYYLEQASIRFQCVFLPDNGAFFVNYVITAALLGTGMELLRLGSLFCYSTRLFFSRSEPERVNIRKNQAIDFQFGREYAWMMNVFSVVMAYSITCPIIVPFGLLYLCMKHLTDRYNMYYSFAPTKLNEQIHMAAVSQAIFAPLLGLFWMLFFSILRLGSLHAITIFSLSTLLIAMVIAFVGIFLGKLRMVADYEPEEEEIQTVFDMEPSSTSSTPTSLLYVATVLQEPELNLTPASSPARHTYGTMNNQPEEGEEESGLRGFARELDSAQFQEGLELEGQNQYH

SEQ ID NO: 15585 - protein, 50 aa, Artificial Sequence
  Description of Artificial Sequence: Synthetic coding sequence
MSASPDDLSTGGRLQNMTVDECFQSRNTVLQGQPFGGVPTVLCLNIALWV

SEQ ID NO: 15586 - protein, 164 aa, Artificial Sequence
  Description of Artificial Sequence: Synthetic coding sequence
MSASPDDLSTGGRLQNMTVDECFQSRNTVLQGQPFGGVPTVLCLNIALWVLVLVVYSFLRKAAWDYGRLALLIHNDSLTSLIYGEQSEKTSPSETSLEMERRDKGFCSWFFNSITMKDEDLINKCGDDARIYIVFQYHLIIFVLIICIPSLGIILPINYTGSVL

SEQ ID NO: 15587 - protein, 51 aa, Artificial Sequence
  Description of Artificial Sequence: Synthetic coding sequence
MSASPDDLSTGGRLQNMTVDECFQSRNTVLQGQPFGGVPTVLCLNIALWVL

SEQ ID NO: 15588 - protein, 36 aa, Artificial Sequence
  Description of Artificial Sequence: Synthetic coding sequence
MSASPDDLSTGGRLQNMTVDECFQSRNTVLQGQPFG

SEQ ID NO: 15589 - protein, 23 aa, Artificial Sequence
  Description of Artificial Sequence: Synthetic coding sequence
MSASPDDLSTGGRLQNMTVDECF

SEQ ID NO: 15590 - protein, 328 aa, Artificial Sequence
  Description of Artificial Sequence: Synthetic coding sequence
MRSPGGILLQALPRLLQHAALPGLAELPARWALPRGAGGDGPADRLPRGGGASAAAAAAAASGALLGAYLERHGPPEASELPEPGGALAGGPGSGGGGVVVGVAEVRNWRCCCLGSTCWCRSLVLVCVLAALCFASLALVRRYLHHLLLWVESLDSLLGVLLFVVGFIVVSFPCGWGYIVLNVAAGYLYGFVLGMGLMMVGVLIGTFIAHVVCKRLLTAWVAARIQSSEKLSAVIRVVEGGSGLKVVALARLTPIPFGLQNAVFSIIISIGLMFYVVHRAQVELNAAIVACEMELKSSLVKGNQPNTSGSSFYNKRTLTFSGGGINVV

SEQ ID NO: 15591 - protein, 380 aa, Artificial Sequence
  Description of Artificial Sequence: Synthetic coding sequence
MRSPGGILLQALPRLLQHAALPGLAELPARWALPRGAGGDGPADRLPRGGGASAAAAAAAASGALLGAYLERHGPPEASELPEPGGALAGGPGSGGGGVVVGVAEVRNWRCCCLGSTCWCRSLVLVCVLAALCFASLALVRRYLHHLLLWVESLDSLLGVLLFVVGFIVVSFPCGWGYIVLNVAAGYLYGFVLGMGLMMVGVLIGTFIAHVVCKRLLTAWVAARIQSSEKLSAVIRVVEGGSGLKVVALARLTPIPFGLQNAVFSITDLSLPNYLMASSVGLLPTQLLNSYLGTTLRTMEDVIAEQSVSGYFVFCLQIIISIGLMFYVVHRAQVELNAAIVACEMELKSSLVKGNQPNTSGSSFYNKRTLTFSGGGINVV

SEQ ID NO: 15592 - protein, 119 aa, Artificial Sequence
  Description of Artificial Sequence: Synthetic coding sequence
MPPRITDLSLPNYLMASSVGLLPTQLLNSYLGTTLRTMEDVIAEQSVSGYFVFCLQIIISIGLMFYVVHRAQVELNAAIVACEMELKSSLVKGNQPNTSGSSFYNKRTLTFSGGGINVV

SEQ ID NO: 15593 - protein, 51 aa, Artificial Sequence
  Description of Artificial Sequence: Synthetic coding sequence
MPPRITDLSLPNYLMASSVGLLPTQLLNSYLGTTLRTMEDVIAEQSVSGYF

SEQ ID NO: 15594 - protein, 240 aa, Artificial Sequence
  Description of Artificial Sequence: Synthetic coding sequence
MSRLLPLLRSRTARSLRPGPAAAAAPRPPSWCCCGRGLLALAPPGGLPGGPRRLGTHPKKEPMEALNTAQGARDFIYSLHSTERSCLLKELHRFESIAIAQEKLEAPPPTPGQLRYVFIHNAIPFIGFGFLDNAIMIVAGTHIEMSIGIILGISTMAAAALGNLVSDLAGLGLAGYVEALASRLGLSIPDLTPKQVDMWQTRLSTHLGKAVGVTIGCILGMFPLIFFGGGEEDEKLETKS

SEQ ID NO: 15595 - protein, 339 aa, Artificial Sequence
  Description of Artificial Sequence: Synthetic coding sequence
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 15596 - protein, 167 aa, Artificial Sequence
  Description of Artificial Sequence: Synthetic coding sequence
MSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 15597 - protein, 303 aa, Artificial Sequence
  Description of Artificial Sequence: Synthetic coding sequence
MLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 15598 - protein, 167 aa, Artificial Sequence; identical to SEQ ID NO: 15596
  Description of Artificial Sequence: Synthetic coding sequence

SEQ ID NO: 15599 - protein, 257 aa, Artificial Sequence
  Description of Artificial Sequence: Synthetic coding sequence
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVTKNAVQALIDKHQRIPGNIMSALLERFH

SEQ ID NO: 15600 - protein, 324 aa, Artificial Sequence
  Description of Artificial Sequence: Synthetic coding sequence
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVPIIPMFTQNIREGFRSLGGTRLFRWLYEKFRYPFAPMYGGFPVKLRTYLGDPIPYDPQITAEELAEKTKNAVQALIDKHQRIPGNIMSALLERFH

SEQ ID NO: 15601 - protein, 126 aa, Artificial Sequence
  Description of Artificial Sequence: Synthetic coding sequence
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALI

SEQ ID NO: 15602 - protein, 135 aa, Artificial Sequence
  Description of Artificial Sequence: Synthetic coding sequence
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGKQGYFHLCVAIHVCCIGTVLPFHFID

SEQ ID NO: 15603 - protein, 243 aa, Artificial Sequence
  Description of Artificial Sequence: Synthetic coding sequence
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVPIIPMFTQNIREGF

SEQ ID NO: 15604 - protein, 135 aa, Artificial Sequence; identical to SEQ ID NO: 15602
  Description of Artificial Sequence: Synthetic coding sequence

SEQ ID NO: 15605 - protein, 2 aa, Artificial Sequence
  Description of Artificial Sequence: Synthetic coding sequence
MI

SEQ ID NO: 15606 - protein, 164 aa, Artificial Sequence
  Description of Artificial Sequence: Synthetic coding sequence
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIP

SEQ ID NO: 15607 - protein, 91 aa, Artificial Sequence
  Description of Artificial Sequence: Synthetic coding sequence
MFTQNIREGFRSLGGTRLFRWLYEKFRYPFAPMYGGFPVKLRTYLGDPIPYDPQITAEELAEKTKNAVQALIDKHQRIPGNIMSALLERFH

SEQ ID NO: 15608 - protein, 247 aa, Artificial Sequence
  Description of Artificial Sequence: Synthetic coding sequence
MLRFIQKFSQASSKILKYSFPVGLRTSRTDILSLKMSLQQNFSPCPRPWLSSSFPAYMSKTQCYHTSPCSFKKQQKQALLARPSSTITYLTDSPKPALCVTLAGLIPFVAPPLVMLMTKTYIPILAFTQMAYGASFLSFLGGIRWGFALPEGSPAKPDYLNLASSAAPLFFSWFAFLISERLSEAIVTVIMGMGVAFHLELFLLPHYPNWFKALRIVVTLLATFSFIITLVVKSSFPEKGHKRPGQV

SEQ ID NO: 15609 - protein, 275 aa, Artificial Sequence
  Description of Artificial Sequence: Synthetic coding sequence
MQLQVFWTGLEYTCRLLGITTAAVLIGVGTETFLQGQFKSLAFYLLFTGAAVSICEGAYFVAQLLAICFQCQPGSLADRVREKAHWLGCFQKFLAYLLLSVACFLHPVLVWHVTIPGSMLIITGLAYFLLSKRKKRKAAPEVLASPEQYTDPSSSAVSTTGSGDTEQTYTFHGALKEGPSSLFIHMKSILKGTKKPSALQPPNTLMELSLEPADSLAKKKQVHFEDNLVRIVPSLAEGLDDGDSEPEETTSDTTPIIPPPQAPLFLSSLTATGLF

SEQ ID NO: 15610 - protein, 157 aa, Artificial Sequence
  Description of Artificial Sequence: Synthetic coding sequence
MLIITGLAYFLLSKRKKRKAAPEVLASPEQYTDPSSSAVSTTGSGDTEQTYTFHGALKEGPSSLFIHMKSILKGTKKPSALQPPNTLMELSLEPADSLAKKKQVHFEDNLVRIVPSLAEGLDDGDSEPEETTSDTTPIIPPPQAPLFLSSLTATGLF

SEQ ID NO: 15611 - protein, 256 aa, Artificial Sequence
  Description of Artificial Sequence: Synthetic coding sequence
MPPAQGYEFAAAKGPRDELGPSFPMASPPGLELKTLSNGPQAPRRSAPLGPVAPTREGVENACFSSEEHETHFQNPGNTRLGSSPSPPGGVSSLPRSQRDDLSLHSEEGPALEPVSRPVDYGFVSALVFLVSGILLVVTAYAIPREARVNPDTVTAREMERLEMYYARLGSHLDRCIIAGLGLLTVGGMLLSVLLMVSLCKGELYRRRTFVPGKGSRKTYGSINLRMRQLNGDGGQALVENEVVQVSETSHTLQRS

SEQ ID NO: 15612 - protein, 154 aa, Artificial Sequence
  Description of Artificial Sequence: Synthetic coding sequence
MPPAQGYEFAAAKGPRDELGPSFPMASPPGLELKTLSNGPQAPRRSAPLGPVAPTREGVENACFSSEEHETHFQNPGNTRLGSSPSPPGGVSSLPRSQRDDLSLHSEEGPALEPVSRPVDYGFVSALVFLVSGILLVVTAYAIPREARVNPDTV

SEQ ID NO: 15613 - protein, 138 aa, Artificial Sequence
  Description of Artificial Sequence: Synthetic coding sequence
MRPTADSFRLKKGNVFPNFDPCAQALQKSCHFALSFLIGKMGIIILSVCLICTRLLQEGIAQSKCLINVSFSLYSCFIVFVTISQDSETLSLDCDHRLFFSLPFTDPASGGQSQHSWPCPERSKNLPQVSKQLRNRAG

SEQ ID NO: 15614 - protein, 136 aa, Artificial Sequence
  Description of Artificial Sequence: Synthetic coding sequence
MWLDTRNLGIVISCWKGVCVPQTTTLEMFYNDNDRVEESSNSYQIRREFLLPACLPAFLSFSTSFSFFLSFLPLSLSLFLPFFPSFFLSLSLSPSFLPSFLRQGLALSPRLECDGAIMIHCSLNIPGSSDPPTSAS

SEQ ID NO: 15615 - protein, 394 aa, Artificial Sequence
  Description of Artificial Sequence: Synthetic coding sequence
MTEQETLALLEVKRSDSPEKSSPQALVPNGRQPEGEGGAESPGAESLRVGSSAGSPTAIEGAEDGLDSTVSEAATLPWGTGPQPSAPFPDPPGWRDIEPEPPESEPLTKLEELPEDDANLLPEKAARAFVPIDLQCIERQPQEDLIVRCEAGEGECRTFMPPRVTHPDPTERKWAEAVVRPPGCSCGGCGSCGDREWLRAVASVGAALILFPCLLYGAYAFLPFDVPRLPTMSSRLIYTLRCGVFATFPIVLGILVYGLSLLCFSALRPFGEPRREVEIHRRYVAQSVQLFILYFFNLAVLSTYLPQDTLKLLPLLTGLFAVSRLIYWLTFAVGRSFRGFGYGLTFLPLLSMLMWNLYYMFVVEPERMLTATESRLDYPDHARSASDYRPRPWG

SEQ ID NO: 15616 - protein, 175 aa, Artificial Sequence
  Description of Artificial Sequence: Synthetic coding sequence
MTEQETLALLEVKRDPGVRAEPVMLFCPSALWGATAGGGDPPAICGPVGPALYSLLLQPGRAFHLPAPGYPQTAPSAHWSLCRLPADLLADLCRGPLLPRLRLRPDVSATAVDADVEPLLHVRGGAGAHAHCHREPPGLPGPRPLGLRLQAPPLGLSLSALALGVGGSGLGLTHL

SEQ ID NO: 15617 - protein, 394 aa, Artificial Sequence; identical to SEQ ID NO: 15615
  Description of Artificial Sequence: Synthetic coding sequence

SEQ ID NO: 15618 - protein, 132 aa, Artificial Sequence
  Description of Artificial Sequence: Synthetic coding sequence
MTEQETLALLEVKRDPGVRAEPVMLFCPSALWGATAGGGDPPAICGPVGPALYSLLLQPGRAFHLPAPGYPQTAPSAHWSLCRLPADLLADLCRGPLLPRLRLRPDVSATAVDADVEPLLHVRGGAGAHAHC

SEQ ID NO: 15619 - protein, 168 aa, Artificial Sequence
  Description of Artificial Sequence: Synthetic coding sequence
MAEGARARGPRGCRDRDGPAGGAGKMAAPRRGRGSSTVLSSVPLQMLFYLSGTYYALYFLATLLMITYKSQVFSYPHRYLVLDLALLFLMGILEAVRLYLGTRGNLTEAERPLAASLALTAGTALLSAHFLLWQALVLWADWALSATLLALHGLEAVLQVVAIAAFTR

SEQ ID NO: 15620 - protein, 160 aa, Artificial Sequence
  Description of Artificial Sequence: Synthetic coding sequence
MAEGARARGPRGCRDRDGPAGGAGRGSSTVLSSVPLQMLFYLSGTYYALYFLATLLMITYKSQVFSYPHRYLVLDLALLFLMGILEAVRLYLGTRGNLTEAERPLAASLALTAGTALLSAHFLLWQALVLWADWALSATLLALHGLEAVLQVVAIAAFTR

SEQ ID NO: 15621 - protein, 255 aa, Artificial Sequence
  Description of Artificial Sequence: Synthetic coding sequence
MKVLATSFVLGSLGLAFYLPLVVTTPKTLAIPEKLQEAVGKVIINATTCTVTCGLGYKEETVCEVGPDGVRRKCQTRRLECLTNWICGMLHFTILIGKEFELSCLSSDILEFGQEAFRFTWRLARGVISTDDEVFKPFQANSHFVKFKYAQEYDSGTYRCDVQLVKNLRLVKRLYFGLRVLPPNLVNLNFHQSLTEDQKLIDEGLEVNLDSYSKPHHPKWKKKVASALGIGIAIGVVGGVLVRIVLCALRGGLQQ

SEQ ID NO: 15622 - protein, 343 aa, Artificial Sequence
  Description of Artificial Sequence: Synthetic coding sequence
MFSLPSLPSWLPGLPSLEWGSSLLDSLLQGLIGALGVLVLNSLLKVYFFVGCANDPQRRPEKERLRAQWASLETVHLAGLALFLTVVGSRVAALVVLEFSLRAVSTLLSLGKGSQGAAERLQLYLLCQYSLGCGLTCGLSFLQEGAPHRTLNLLLSLGLATLLGLGARRLHRHVCRLYELHSSQRYCGVCLGLLAHAHGLPQLLGRALAIAFAVGDLAAVALINQDFLTTSEAMRFWTPLTICYTLLVIYMQEEQRQHPGLQSQVQTVLVRMGGLFVLLLTVGRWLDLLGILVSLLGELWCLVGVRTLLDLCQIQDFPSQRPPVSTPSQPLPSAPQSQSSAPS

SEQ ID NO: 15623 - protein, 149 aa, Artificial Sequence
  Description of Artificial Sequence: Synthetic coding sequence
MTAQGGLVANRGRRFKWAIELSGPGGGSRGRSDRGSGQGDSLYPVGYLDKQVPDTSVQETDRILVEKRCWDIALGPLKQIPMNLFIMYMAGNTISIFPTMMVCMMAWRPIQALMAISAKNGVQWWRTAFVNMRKQRLVPMYLGLIYILL

SEQ ID NO: 15624 - protein, 183 aa, Artificial Sequence
  Description of Artificial Sequence: Synthetic coding sequence
MTAQGGLVANRGRRFKWAIELSGPGGGSRGRSDRGSGQGDSLYPVGYLDKQVPDTSVQETDRILVEKRCWDIALGPLKQIPMNLFIMYMAGNTISIFPTMMVCMMAWRPIQALMAISATFKMLESSSQKFLQGLVYLIGNLMGLALAVYKCQSMGLLPTHASDWLAFIEPPERMEFSGGGLLL

SEQ ID NO: 15625 - protein, 240 aa, Artificial Sequence
  Description of Artificial Sequence: Synthetic coding sequence
MVSPVTVVKSEGPKLVPFFKATCVYFVLWLPSSSPSWVSTLIKCLPIFCLWLFLLAHGLGFLLAHPSATRIFVGLVFSAVGDAFLIWQDQGYFVHGLLMFAVTHMFYASAFGMQPLALRTGLVMAALSGLCYALLYPCLSGAFTYLVGVYVALIGFMGWRAMAGLRLAGADWRWTELAAGSGALFFIISDLTIALNKFCFPVPYSRALIMSTYYVAQMLVALSAVESREPVEHYRLTKAN

SEQ ID NO: 15626 - protein, 240 aa, Artificial Sequence; identical to SEQ ID NO: 15625
  Description of Artificial Sequence: Synthetic coding sequence

SEQ ID NO: 15627 - protein, 226 aa, Artificial Sequence
  Description of Artificial Sequence: Synthetic coding sequence
MDAGKAGQTLKTHCSAQRPDVCRWLSPFILSCCVYFCLWIPEDQLSWFAALVKCLPVLCLAGFLWVMSPSGGYTQLLQGALVCSAVGDACLIWPAAFVPGMAAFATAHLLYVWAFGFSPLQPGLLLLIILAPGPYLSLVLQHLEPDMVLPVAAYGLILMAMLWRGLAQGGSAGWGALLFTLSDGVLAWDTFAQPLPHAHLVIMTTYYAAQLLITLSALRSPVPKTD

SEQ ID NO: 15628 - protein, 181 aa, Artificial Sequence
  Description of Artificial Sequence: Synthetic coding sequence
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTIQMPFLKKHFLDC

SEQ ID NO: 15629 - protein, 555 aa, Artificial Sequence
  Description of Artificial Sequence: Synthetic coding sequence
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 15630 - protein, 494 aa, Artificial Sequence
  Description of Artificial Sequence: Synthetic coding sequence
MAHSDTVVDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 15631 - protein, 531 aa, Artificial Sequence
  Description of Artificial Sequence: Synthetic coding sequence
MYKRRVVYLSDVSQNPVSPGWIRKGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 15632 - protein, 555 aa, Artificial Sequence
  Description of Artificial Sequence: Synthetic coding sequence
MVAACRSVAGLLPRRRRCFPARAPLLRVALCLLCWTPAAVRAVPELGLWLETVNDKSGPLIFRKTMFNSTDIKLSVKSFHCSGPVKFTIVWHLKYHTCHNEHSNLEELFQKHKLSVDEDFCHYLKNDNCWTTKNENLDCNSDSQVFPSLNNKELINIRNVSNQERSMDVVARTQKDGFHIFIVSIKTENTDASWNLNVSLSMIGPHGYISASDWPLMIFYMVMCIVYILYGILWLTWSACYWKDILRIQFWIAAVIFLGMLEKAVFYSEYQNISNTGLSTQGLLIFAELISAIKRTLARLLVIIVSLGYGIVKPRLGTVMHRVIGLGLLYLIFAAVEGVMRVIGGSNHLAVVLDDIILAVIDSIFVWFIFISLAQTMKTLRLRKNTVKFSLYRHFKNTLIFAVLASIVFMGWTTKTFRIAKCQSDWMERWVDDAFWSFLFSLILIVIMFLWRPSANNQRYAFMPLIDDSDDEIEEFMVTSENLTEGIKLRASKSVSNGTAKPATSENFDEDLKWVEENIPSSFTDVALPVLVDSDEEIMTRSEMAEKMFSSEKIM

SEQ ID NO: 15633 - protein, 159 aa, Artificial Sequence
  Description of Artificial Sequence: Synthetic coding sequence
MADVPGAQRAVPGDGPEPRDPLDCWACAVLVTAQNLLVAAFNLLLLVLVLGTILLPAVTMLGFGFLCHSQFLRSQAPPCTAHLRDPGFTALLVTGFLLLVPLLVLALASYRRLCLRLRLADCLVPYSRALYRRRRAPQPRQIRASPGSQAVPTSGKVWV

SEQ ID NO: 15634 - protein, 159 aa, Artificial Sequence
  Description of Artificial Sequence: Synthetic coding sequence
MLHVLASLPLLLLLVTSASTHAWSRPLWYQVGLDLQPWGCQPKSVEGCRGGLSCPGYWLGPGASRIYPVAAVMITTTMLMICRKILQGRRRSQATKGEHPQVTTEPCGPWKRRAPISDHTLLRGVLHMLDALLVHIEGHLRHLATQRQIQIKGTSTQSG

SEQ ID NO: 15635 - protein, 259 aa, Artificial Sequence
  Description of Artificial Sequence: Synthetic coding sequence
MCPENAEDCEQAVVHVETTLYLVPCLNDCGPYGQCLLLRRHSYLYASCSCKAGWRGWSCTDNSTAQTVAQQRAATLLLTLSNLMFLAPIAVSVRRFFLVEASVYAYTMFFSTFYHACDQPGEAVLCILSYDTLQYCDFLGSGAAIWVTILCMARLKTVLKYAYRCGHRRQCYPTSWQRWAFYLLPGVSMASVGIAIYTSMMTSDNYYYTHSIWHILLAGSAALLLPPPDQPAEPWACSQKFPCHYQICKNDREELYAVT

SEQ ID NO: 15636 - protein, 771 aa, Artificial Sequence
  Description of Artificial Sequence: Synthetic coding sequence
MGRAGTGTGGEAVAAVVAGPLLLLLLARPPPASAGYSGKSEVGLVSEHFSQAPQRLSFYSWYGSARLFRFRVPPDAVLLRWLLQVSRESGAACTDAEITVHFRSGAPPVINPLGTSFPDDTAVQPSFQVGVPLSTTPRSNASVNVSHPAPGDWFVAAHLPPSSQKIELKGLAPTCAYVFQPELLVTRVVEISIMEPDVPLPQTLLSHPSYLKVFVPDYTRELLLELRDCVSNGSLGCPVRLTVGPVTLPSNFQKVLTCTGAPWPCRLLLPSPPWDRWLQVTAESLVGPLGTVAFSAVAALTACRPRSVTIQPLLQSSQNQSFNASSGLLSPSPDHQDLGRSGRVDRSPFCLTNYPVTREDMDVVSVHFQPLDRVSVRVCSDTPSVMRLRLNTGMDSGGSLTISLRANKTEMRNETVVVACVNAASPFLGFNTSLNCTTAFFQGYPLSLSAWSRRANLIIPYPETDNWYLSLQLMCPENAEDCEQAVVHVETTLYLVPCLNDCGPYGQCLLLRRHSYLYASCSCKAGWRGWSCTDNSTAQTVAQQRAATLLLTLSNLMFLAPIAVSVRRFFLVEASVYAYTMFFSTFYHACDQPGEAVLCILSYDTLQYCDFLGSGAAIWVTILCMARLKTVLKYVLFLLGTLVIAMSLQLDRRGMWNMLGPCLFAFVIMASMWAYRCGHRRQCYPTSWQRWAFYLLPGVSMASVGIAIYTSMMTSDNYYYTHSIWHILLAGSAALLLPPPDQPAEPWACSQKFPCHYQICKNDREELYAVT

SEQ ID NO: 15637 - protein, 472 aa, Artificial Sequence
  Description of Artificial Sequence: Synthetic coding sequence
MNMPQSLGNQPLPPEPPSLGTPAEGPGTTSPPEHCWPVRPTLRNELDTFSVHFYIFFGPSVALPPERPAVFAMRLLPVLDSGGVLSLELQLNASSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTFYHACDQPGIVVFCIMDYDVLQFCDFLGSLMSVWVTVIAMARLQPVVKQVLYLLGAMLLSMALQLDRHGLWNLLGPSLFALGILATAWTVRSVRRRHCYPPTWRRWLFYLCPGSLIAGSAVLLYAFVETRDNYFYIHSIWHMLIAGSVGFLLPPRAKTDHGVPSGARARGCGYQLCINEQEELGLVGPGGATVSSICAS

SEQ ID NO: 15638 - protein, 472 aa, Artificial Sequence; identical to SEQ ID NO: 15637
  Description of Artificial Sequence: Synthetic coding sequence

SEQ ID NO: 15639 - protein, 338 aa, Artificial Sequence
  Description of Artificial Sequence: Synthetic coding sequence
MNMPQSLGNQPLPPEPPSLGTPAEGPGTTSPPEHCWPVRPTLRNELDTFSVHFYIFFGPSVALPPERPAVFAMRLLPVLDSGGVLSLELQLNASSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTVCGGVCILSLGACAWWWVTVCISTTFSEGLGMSVPSLCLLQTETAVLPKLSCIDNGHFCKTHWSK

SEQ ID NO: 15640 - protein, 338 aa, Artificial Sequence; identical to SEQ ID NO: 15639
  Description of Artificial Sequence: Synthetic coding sequence

SEQ ID NO: 15641 - protein, 183 aa, Artificial Sequence
  Description of Artificial Sequence: Synthetic coding sequence
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 15642 - protein, 183 aa, Artificial Sequence; identical to SEQ ID NO: 15641
  Description of Artificial Sequence: Synthetic coding sequence

SEQ ID NO: 15643 - protein, 186 aa, Artificial Sequence
  Description of Artificial Sequence: Synthetic coding sequence
MKLLSLVAVVGCLLVPPAEANKVRESSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 15644 - protein, 186 aa, Artificial Sequence; identical to SEQ ID NO: 15643
  Description of Artificial Sequence: Synthetic coding sequence

SEQ ID NO: 15645 - protein, 183 aa, Artificial Sequence; identical to SEQ ID NO: 15641
  Description of Artificial Sequence: Synthetic coding sequence

SEQ ID NO: 15646 - protein, 114 aa, Artificial Sequence
  Description of Artificial Sequence: Synthetic coding sequence
MKLLSLVAVVGCLLVPPAEANKVREVSLQHLVTTTVHGHPVYRADSESSEDIRCKCICPPYRNISGHIYNQNVSQKDCNCLHVVEPMPVPGHDVEAYCLLCECRYEERSTTTIK

SEQ ID NO: 15647 - protein, 138 aa, Artificial Sequence
  Description of Artificial Sequence: Synthetic coding sequence
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSM

SEQ ID NO: 15648 - protein, 151 aa, Artificial Sequence
  Description of Artificial Sequence: Synthetic coding sequence
MKLLSLVAVVGCLLVPPAEANKSSEDIRCKCICPPYRNISGHIYNQNVSQKDCPVSLCCSNCLHVVEPMPVPGHDVEAYCLLCECRYEERSTTTIKVIIVIYLSVVGALLLYMAFLMLVDPLIRKPDAYTEQLHNEEENEDARSMAAAAAS

SEQ ID NO: 15649 - protein, 122 aa, Artificial Sequence
  Description of Artificial Sequence: Synthetic coding sequence
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKTN

SEQ ID NO: 15650 - protein, 139 aa, Artificial Sequence
  Description of Artificial Sequence: Synthetic coding sequence
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKHPQCLTYSRCYVSAFGIHA

SEQ ID NO: 15651 - protein, 172 aa, Artificial Sequence
  Description of Artificial Sequence: Synthetic coding sequence
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKTNKAWAKGDIQGAGAASRRAFLLGVLAVGLGVCTYAAALVTLAAYLASRDPP

SEQ ID NO: 15652 - protein, 133 aa, Artificial Sequence
  Description of Artificial Sequence: Synthetic coding sequence
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKTRPSCPYSPHCEP

SEQ ID NO: 15653 - protein, 123 aa, Artificial Sequence
  Description of Artificial Sequence: Synthetic coding sequence
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKPSL

SEQ ID NO: 15654 - protein, 127 aa, Artificial Sequence
  Description of Artificial Sequence: Synthetic coding sequence
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKLPLQPSL

SEQ ID NO: 15655 - protein, 60 aa, Artificial Sequence
  Description of Artificial Sequence: Synthetic coding sequence
  MOD_RES (1)..(1): Any amino acid
XWDGGSRLSPFLPHDHLGLAVFSMLCCFWPVGIAAFCLAQKHPQCLTYSRCYVSAFGIHA

SEQ ID NO: 15656 - protein, 114 aa, Artificial Sequence
  Description of Artificial Sequence: Synthetic coding sequence
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAA

SEQ ID NO: 15657 - protein, 133 aa, Artificial Sequence; identical to SEQ ID NO: 15652
  Description of Artificial Sequence: Synthetic coding sequence

SEQ ID NO: 15658 - protein, 87 aa, Artificial Sequence
  Description of Artificial Sequence: Synthetic coding sequence
  MOD_RES (1)..(1): Any amino acid
XLPSVSAGLGEPRPPDVEDMSSSDSDSDWDGGSRLSPFLPHDHLGLAVFSMLCCFWPVGIAAFCLAQKHPQCLTYSRCYVSAFGIHA

SEQ ID NO: 15659 - protein, 159 aa, Artificial Sequence
  Description of Artificial Sequence: Synthetic coding sequence
MSQAWVPGLAPTLLFSLLAGPQKIAAKCGLILACPKGFKCCGDSCCQENELFPGPVRIFVIIFLVILSVFCICGLAKCFCRNCREPEPDSPVDCRGPLELPSIIPPERVRVSLSAPPPPYSEVILKPSLGPTPTEPPPPYSFRPEEYTGDQRGIDNPAF

SEQ ID NO: 15660 - protein, 159 aa, Artificial Sequence; identical to SEQ ID NO: 15659
  Description of Artificial Sequence: Synthetic coding sequence

SEQ ID NO: 15661 - protein, 110 aa, Artificial Sequence
  Description of Artificial Sequence: Synthetic coding sequence
MAAVVAKREGPPFISEAAVRGNAAVLDYCRTSVSALSGATAGILGLTGLYGFIFYLLASVLLSLLLILKAGRRWNKYFKSRRPLFTGGLIGGLFTYVLFWTFLYGMVHVY

SEQ ID NO: 15662 - protein, 110 aa, Artificial Sequence; identical to SEQ ID NO: 15661
  Description of Artificial Sequence: Synthetic coding sequence

SEQ ID NO: 15663 - protein, 226 aa, Artificial Sequence
  Description of Artificial Sequence: Synthetic coding sequence
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQEQSAI

SEQ ID NO: 15664 - protein, 226 aa, Artificial Sequence; identical to SEQ ID NO: 15663
  Description of Artificial Sequence: Synthetic coding sequence

SEQ ID NO: 15665 - protein, 137 aa, Artificial Sequence
  Description of Artificial Sequence: Synthetic coding sequence
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISP

SEQ ID NO: 15666 - protein, 222 aa, Artificial Sequence
  Description of Artificial Sequence: Synthetic coding sequence
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQE

SEQ ID NO: 15667 - protein, 226 aa, Artificial Sequence; identical to SEQ ID NO: 15663
  Description of Artificial Sequence: Synthetic coding sequence

SEQ ID NO: 15668 - protein, 258 aa, Artificial Sequence
  Description of Artificial Sequence: Synthetic coding sequence
MVGILPLCCSGCVPSLCCSSYVPSVAPTAAHSVRVPHSAGHCGQRVLACSLPQVFLKPWIFVEHFSSWLSLELFSFLRYLGTLLCACGHRLREGLLLPCLLGVGSWLLFNNWTGGSWFSLHLQQVSLSQGSHVAAFLPEAIGPGVPVPVSGESTSAQQSHAGWQLSAEADACPSVLYSEVLEWNKNINTYTSFHDFCLILGIFLFCFVLAVIGLPYIKPGLSLSVALLWQSLILLSSLVQQDSQVHTWGCLFSTFTST

SEQ ID NO: 15669 - protein, 189 aa, Artificial Sequence
  Description of Artificial Sequence: Synthetic coding sequence
MVGILPLCCSGCVPSLCCSSYVPSVAPTAAHSVRVPHSAGHCGQRVLACSLPQVFLKPWIFVEHFSSWLSLELFSFLRYLGTLLCACGHRLREGLLLPCLLGVGSWLLFNNWTGGSWFSLHLQQVSLSQGSHVAAFLPEAIGPGVPVPVSGESTSAQQSHAGWQLSAEADACPSVLYSEVLEWNKNINT

SEQ ID NO: 15670 - protein, 168 aa, Artificial Sequence [sequence omitted]

SEQ ID NO: 15671 - protein, 453 aa, Artificial Sequence
  Description of Artificial Sequence: Synthetic coding sequence
MAIFRQLSLGAKATLAAVTVFVSMIASRSYLAESLELRAWRWLLRLQLALFVNSLLLIGSLYIWRSTVSNLCHSPAAESTCFQLWKVVVLAFLALAHSSFFTMFFLVAEEPYLFSLAAYSCLGAYIIMLFFLFILSGMEQAYQLLAWRSGRVVGSLEKTRKLVLRPALAVGVTAVLSVAGILNAAQPPAVKTVEVPIHQLPASMNNLKIVLLSDIHLGPTVGRTKMEMFVRMVNVLEPDITVIVGDLSDSEASVLRTAVAPLGQLHSHLGAYFVTGNHEYYTSDVSNWFALLESLHVQPLHNENVKISATRAQRGGGGSGSGSEDEDWICLAGVDDIEADILHYSGHGMDLDKALEGCSPDHTIILLAHQPLAAKRALQARPDINLILSGHTHAGQIFPLNVAAYLLNPFFAGLYQVAQATFVYVSPGTAYYGIPMRLGSRAEITELILQRSP

SEQ ID NO: 15672 - protein, 316 aa, Artificial Sequence
  Description of Artificial Sequence: Synthetic coding sequence
MEQAYQLLAWRSGRVVGSLEKTRKLVLRPALAVGVTAVLSVAGILNAAQPPAVKTVEVPIHQLPASMNNLKIVLLSDIHLGPTVGRTKMEMFVRMVNVLEPDITVIVGDLSDSEASVLRTAVAPLGQLHSHLGAYFVTGNHEYYTSDVSNWFALLESLHVQPLHNENVKISATRAQRGGGGSGSGSEDEDWICLAGVDDIEADILHYSGHGMDLDKALEGCSPDHTIILLAHQPLAAKRALQARPDINLILSGHTHAGQIFPLNVAAYLLNPFFAGLYQVAQATFVYVSPGTAYYGIPMRLGSRAEITELILQRSP

SEQ ID NO: 15673 - protein, 293 aa, Artificial Sequence
  Description of Artificial Sequence: Synthetic coding sequence
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLLCRCHNLPVLQLLRSAHLRGFPPGLLRLGAQDPLLLQMPSGRDRGARCTPTPALRCGPAGGPGGCRGCWGLSCQLLEHAVRLCRRGGLPG

SEQ ID NO: 15674 - protein, 373 aa, Artificial Sequence
  Description of Artificial Sequence: Synthetic coding sequence
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLVYSLVVILPKTPLKERISLPSRRSFYVYAGILALLNLLQGLGSVLLCFDIIEGLCCVDATTFLYFSFFAPLIYVAFLRGFFGSEPKILFSYKCQVDETEEPDVHLPQPYAVARREGLEAAGAAGASAASYSSTQFDSAGGVAYLDDIASMPCHTGSINSTDSERWKAINA

SEQ ID NO: 15675 - protein, 373 aa, Artificial Sequence; identical to SEQ ID NO: 15674
  Description of Artificial Sequence: Synthetic coding sequence

SEQ ID NO: 15676 - protein, 41 aa, Artificial Sequence
  Description of Artificial Sequence: Synthetic coding sequence
MDTLEEVTWANGSTALPPPLAPNISVPHRCLLLLYEDIGTS

SEQ ID NO: 15677 - protein, 203 aa, Artificial Sequence
  Description of Artificial Sequence: Synthetic coding sequence
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFL

SEQ ID NO: 15678 - protein, 373 aa, Artificial Sequence; identical to SEQ ID NO: 15674
  Description of Artificial Sequence: Synthetic coding sequence

SEQ ID NO: 15679 - protein, 204 aa, Artificial Sequence
  Description of Artificial Sequence: Synthetic coding sequence
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLV

SEQ ID NO: 15680 - protein, 166 aa, Artificial Sequence
  Description of Artificial Sequence: Synthetic coding sequence
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQ

SEQ ID NO: 15681 - protein, 358 aa, Artificial Sequence
  Description of Artificial Sequence: Synthetic coding sequence
MRATPLAAPAGSLSRKKRLELDDNLDTERPVQKRARSGPQPRLPPCLLPLSPPTAPDRATAVATASRLGPYVLLEPEEGGRAYQALHCPTGTEYTCKVYPVQEALAVLEPYARLPPHKHVARPTEVLAGTQLLYAFFTRTHGDMHSLVRSRHRIPEPEAAVLFRQMATALAHCHQHGLVLRDLKLCRFVFADRERKKLVLENLEDSCVLTGPDDSLWDKHACPAYVGPEILSSRASYSGKAADVWSLGVALFTMLAGHYPFQDSEPVLLFGKIRRGAYALPAGLSAPARCLVRCLLRREPAERLTATGILLHPWLRQDPMPLAPTRSHLWEAAQVVPDGLGLDEAREEEGDREVVLYG

SEQ ID NO: 15682 - protein, 385 aa, Artificial Sequence
  Description of Artificial Sequence: Synthetic coding sequence
MVLMHLAVKNNRMSANNDHFLTPTWQQMRATPLAAPAGSLSRKKRLELDDNLDTERPVQKRARSGPQPRLPPCLLPLSPPTAPDRATAVATASRLGPYVLLEPEEGGRAYQALHCPTGTEYTCKVYPVQEALAVLEPYARLPPHKHVARPTEVLAGTQLLYAFFTRTHGDMHSLVRSRHRIPEPEAAVLFRQMATALAHCHQHGLVLRDLKLCRFVFADRERKKLVLENLEDSCVLTGPDDSLWDKHACPAYVGPEILSSRASYSGKAADVWSLGVALFTMLAGHYPFQDSEPVLLFGKIRRGAYALPAGLSAPARCLVRCLLRREPAERLTATGILLHPWLRQDPMPLAPTRSHLWEAAQVVPDGLGLDEAREEEGDREVVLYG

SEQ ID NO: 15683 - protein, 271 aa, Artificial Sequence
  Description of Artificial Sequence: Synthetic coding sequence
MRATPLAAPAGSLSRKKRLELDDNLDTERPVQKRARSGPQPRLPPCLLPLSPPTAPDRATAVATASRLGPYVLLEPEEGGRAYQALHCPTGTEYTCKVYPVQEALAVLEPYARLPPHKHVARPTEVLAGTQLLYAFFTRTHGDMHSLVRSRHRIPEPEAAVLFRQMATALAHCHQHGLVLRDLKLCRFVFADRERKKLVLENLEDSCVLTGPDDSLWDKHACPAYVGPEILSSRASYSGKAADVWSLGVALFTMLAGHYPFQDSEPVLLFG

SEQ ID NO: 15684 - protein, 395 aa, Artificial Sequence
  Description of Artificial Sequence: Synthetic coding sequence
MASAASVTSLADEVNCPICQGTLREPVTIDCGHNFCRACLTRYCEIPGPDLEESPTCPLCKEPFRPGSFRPNWQLANVVENIERLQLVSTLGLGEEDVCQEHGEKIYFFCEDDEMQLCVVCREAGEHATHTMRFLEDAAAPYREQIHKCLKCLRKEREEIQEIQSRENKRMQVLLTQVSTKRQQVISEFAHLRKFLEEQQSILLAQLESQDGDILRQRDEFDLLVAGEICRFSALIEELEEKNERPARELLTDIRSTLIRCETRKCRKPVAVSPELGQRIRDFPQQALPLQREMKMFLEKLCFELDYEPAHISLDPQTSHPKLLLSEDHQRAQFSYKWQNSPDNPQRFDRATCVLAHTGITGGRHTWVWMARVPGDSGCCQFCSPPSVLGTEVAA

SEQ ID NO: 15685 - protein, 481 aa, Artificial Sequence
  Description of Artificial Sequence: Synthetic coding sequence
MASAASVTSLADEVNCPICQGTLREPVTIDCGHNFCRACLTRYCEIPGPDLEESPTCPLCKEPFRPGSFRPNWQLANVVENIERLQLVSTLGLGEEDVCQEHGEKIYFFCEDDEMQLCVVCREAGEHATHTMRFLEDAAAPYREQIHKCLKCLRKEREEIQEIQSRENKRMQVLLTQVSTKRQQVISEFAHLRKFLEEQQSILLAQLESQDGDILRQRDEFDLLVAGEICRFSALIEELEEKNERPARELLTDIRSTLIRCETRKCRKPVAVSPELGQRIRDFPQQALPLQREMKMFLEKLCFELDYEPAHISLDPQTSHPKLLLSEDHQRAQFSYKWQNSPDNPQRFDRATCVLAHTGITGGRHTWVVSIDLAHGGSCTVGVVSEDVQRKGELRLRPEEGVWAVRLAWGFVSALGSFPTRLTLKEQPRQVRVSLDYEVGWVTFTNAVTREPIYTFTASFTRKVIPFFGLWGRGSSFSLSS

SEQ ID NO: 15686 - protein, 481 aa, Artificial Sequence
  Description of Artificial Sequence: Synthetic coding sequence
MASAASVTSLADEVNCPICQGTLREPVTIDCGHNFCRACLTRYCEIPGPDLEESPTCPLCKEPFRPGSFRPNWQLANVVENIERLQLVSTLGLGEEDVCQEHGEKIYFFCEDDEMQLCVVCREAGEHATHTMRFLEDAAAPYREQIHKCLKCLRKEREEIQEIQSRENKRMQVLLTQVSTKRQQVISEFAHLRKFLEEQQSILLAQLESQDGDILRQRDEFDLLVAGEICRFSALIEELEEKNERPARELLTDIRSTLIRCETRKCRKPVAVSPELGQRIRDFPQQALPLQREMKMFLENLPNHLVIPTAHISLDPQTSHPKLLLSEDHQRAQFSYKWQNSPDNPQRFDRATCVLAHTGITGGRHTWVVSIDLAHGGSCTVGVVSEDVQRKGELRLRPEEGVWAVRLAWGFVSALGSFPTRLTLKEQPRQVRVSLDYEVGWVTFTNAVTREPIYTFTASFTRKVIPFFGLWGRGSSFSLSS

SEQ ID NO: 15687 - protein, 564 aa, Artificial Sequence
  Description of Artificial Sequence: Synthetic coding sequence
MAELDLMAPGPLPRATAQPPAPLSPDSGSPSPDSGSASPVEEEDVGSSEKLGRETEEQDSDSAEQGDPAGEGKEVLCDFCLDDTRRVKAVKSCLTCMVNYCEEHLQPHQVNIKLQSHLLTEPVKDHNWRYCPAHHSPLSAFCCPDQQCICQDCCQEHSGHTIVSLDAARRDKEAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 15688 - protein, 564 aa, Artificial Sequence; identical to SEQ ID NO: 15687
  Description of Artificial Sequence: Synthetic coding sequence

SEQ ID NO: 15689 - protein, 474 aa, Artificial Sequence
  Description of Artificial Sequence: Synthetic coding sequence
MEAEDIQEELTCPICLDYFQDPVSIECGHNFCRGCLHRNWAPGGGPFPCPECRHPSAPAALRPNWALARLTEKTQRRRLGPVPPGLCGRHWEPLRLFCEDDQRPVCLVCRESQEHQTHAMAPIDEAFESYREKLLKSQRNLVAKMKKVMHLQDVEVKNATQWKDKIKSQRMRISTEFSKLHNFLVEEEDLFLQRLNKEEEETKKKLNENTLKLNQTIASLKKLILEVGEKSQAPTLELLQNPKEVLTRSEIQDVNYSLEAVKVKTVCQIPLMKEMLKRFQVAVNLAEDTAHPKLVFSQEGRYVKNTASASSWPVFSSAWNYFAGWRNPQKTAFVERFQHLPCVLGKNVFTSGKHYWEVESRDSLEVAVGVCREDVMGITDRSKMSPDVGIWAIYWSAAGYWPLIGFPGTPTQQEPALHRVGVYLDRGTGNVSFYSAVDGVHLHTFSCSSVSRLRPFFWLSPLASLVIPPVTDRK

SEQ ID NO: 15690 - protein, 294 aa, Artificial Sequence
  Description of Artificial Sequence: Synthetic coding sequence
MEAEDIQEELTCPICLDYFQDPVSIECGHNFCRGCLHRNWAPGGGPFPCPECRHPSAPAALRPNWALARLTEKTQRRRLGPVPPGLCGRHWEPLRLFCEDDQRPVCLVCRESQEHQTHAMAPIDEAFESYREKLLKSQRNLVAKMKKVMHLQDVEVKNATQWKDKIKSQRMRISTEFSKLHNFLVEEEDLFLQRLNKEEEETKKKLNENTLKLNQTIASLKKLILEVGEKSQAPTLELLQNPKEVLTRSEIQDVNYSLEAVKVKTVCQIPLMKEMLKRFQATKIKTQKQNRHNM

SEQ ID NO: 15691 - protein, 500 aa, Artificial Sequence
  Description of Artificial Sequence: Synthetic coding sequence
MEAEDIQEELTCPICLDYFQDPVSIECGHNFCRGCLHRNWAPGGGPFPCPECRHPSAPAALRPNWALARLTEKTQRRRLGPVPPGLCGRHWEPLRLFCEDDQRPVCLVCRESQEHQTHAMAPIDEAFESYRTGNFDIHVDEWKRRLIRLLLYHFKQEEKLLKSQRNLVAKMKKVMHLQDVEVKNATQWKDKIKSQRMRISTEFSKLHNFLVEEEDLFLQRLNKEEEETKKKLNENTLKLNQTIASLKKLILEVGEKSQAPTLELLQNPKEVLTRSEIQDVNYSLEAVKVKTVCQIPLMKEMLKRFQVAVNLAEDTAHPKLVFSQEGRYVKNTASASSWPVFSSAWNYFAGWRNPQKTAFVERFQHLPCVLGKNVFTSGKHYWEVESRDSLEVAVGVCREDVMGITDRSKMSPDVGIWAIYWSAAGYWPLIGFPGTPTQQEPALHRVGVYLDRGTGNVSFYSAVDGVHLHTFSCSSVSRLRPFFWLSPLASLVIPPVTDRK

SEQ ID NO: 15692 - protein, 330 aa, Artificial Sequence
  Description of Artificial Sequence: Synthetic coding sequence
MKKVMHLQDVEVKNATQWKDKIKSQRMRISTEFSKLHNFLVEEEDLFLQRLNKEEEETKKKLNENTLKLNQTIASLKKLILEVGEKSQAPTLELLQNPKEVLTRSEIQDVNYSLEAVKVKTVCQIPLMKEMLKRFQVAVNLAEDTAHPKLVFSQEGRYVKNTASASSWPVFSSAWNYFAGWRNPQKTAFVERFQHLPCVLGKNVFTSGKHYWEVESRDSLEVAVGVCREDVMGITDRSKMSPDVGIWAIYWSAAGYWPLIGFPGTPTQQEPALHRVGVYLDRGTGNVSFYSAVDGVHLHTFSCSSVSRLRPFFWLSPLASLVIPPVTDRK

SEQ ID NO: 15693 - protein, 403 aa, Artificial Sequence
  Description of Artificial Sequence: Synthetic coding sequence
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDTHWTDLTHLIEKLKEQKSHSEKMIQGDKEAVLQYFKELNDTLEQKKKSFLTALCDVGNLINQEYTPQIERMKEIREQQLELMALTISLQEESPLKFLEKVDDVRQHVQILKQRPLPEVQPVEIYPRVSKILKEEWSRTEIGQIKNVLIPKMKISPKRMSCSWPGKDEKEVEFLKILNIVVVTLISVILMSILFFNQHIITFLSEITLIWFSEASLSVYQSLSNSLHKVKNILCHIFYLLKEFVWKIVSH

SEQ ID NO: 15694 - protein, 114 aa, Artificial Sequence
  Description of Artificial Sequence: Synthetic coding sequence
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKK

SEQ ID NO: 15695 - protein, 155 aa, Artificial Sequence
  Description of Artificial Sequence: Synthetic coding sequence
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDT

SEQ ID NO: 15696 - protein, 177 aa, Artificial Sequence
  Description of Artificial Sequence: Synthetic coding sequence
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDTHWTDLTHLIEKLKEQKSHSEKM

SEQ ID NO: 15697 - protein, 111 aa, Artificial Sequence
  Description of Artificial Sequence: Synthetic coding sequence
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLL

SEQ ID NO: 15698 - protein, 323 aa, Artificial Sequence
  Description of Artificial Sequence: Synthetic coding sequence
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDTHWTDLTHLIEKLKEQKSHSEKMIQGDKEAVLQYFKELNDTLEQKKKSFLTALCDVGNLINQEYTPQIERMKEIREQQLELMALTISLQEESPLKFLEKVDDVRQHVQILKQRPLPEVQPVEIYPRVSKILKEEWSRTEIGQIKNVLIPKMKISPKRMSCSWPDEGTDK

SEQ ID NO: 15699 - protein, 459 aa, Artificial Sequence
  Description of Artificial Sequence: Synthetic coding sequence
MAGLKRRVPLHSLRYFISMVGLFSKPGLLPWYARNPPGWSQLFLGTVCKGDFTRVIATKCQKGQKSQKKPSHLGPLDGSWQERLADVVTPLWRLSYEEQLKPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEELHVQKEIVKEFFIRGPGAACGLTSLYFQESTMTRCSHQQSPYQLLFGEPYIFEELLSLKIRISPDAFFQINTAGAEMLYRTVGELTGVNSDTILLDICCGTGVIGLSLAQHTSRVLGIELLEQAVEDARWTAAFNGITNSEFHTGQAEKILPGLLKSKEDGQSIVAVVNPARAGLHYKVIQAIRNFRAIHTLVFVSCKLHGESTRNVIELCCPPDPAKKLLGEPFVLQQAVPVDLFPHTPHCELVLLFTR

SEQ ID NO: 15700 - protein, 494 aa, Artificial Sequence
  Description of Artificial Sequence: Synthetic coding sequence
MAGLKRRVPLHSLRYFISMVGLFSKPGLLPWYARNPPGWSQLFLGTVCKGDFTRVIATKCQKGQKSQKKPSHLGPLDGSWQERLADVVTPLWRLSYEEQLKVKFAAQKKILQRLESYIQMLNGVSVTTAVPKSERLSCLLHPIIPSPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEELHVQKEIVKEFFIRGPGAACGLTSLYFQESTMTRCSHQQSPYQLLFGEPYIFEELLSLKIRISPDAFFQINTAGAEMLYRTVGELTGVNSDTILLDICCGTGVIGLSLAQHTSRVLGIELLEQAVEDARWTAAFNGITNSEFHTGQAEKILPGLLKSKEDGQSIVAVVNPARAGLHYKVIQAIRNFRAIHTLVFVSCKLHGESTRNVIERSLILLECSGMVSAHYSLHLPGSSDSPASAS

SEQ ID NO: 15701 - protein, 504 aa, Artificial Sequence
  Description of Artificial Sequence: Synthetic coding sequence
MAGLKRRVPLHSLRYFISMVGLFSKPGLLPWYARNPPGWSQLFLGTVCKGDFTRVIATKCQKGQKSQKKPSHLGPLDGSWQERLADVVTPLWRLSYEEQLKVKFAAQKKILQRLESYIQMLNGVSVTTAVPKSERLSCLLHPIIPSPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEELHVQKEIVKEFFIRGPGAACGLTSLYFQESTMTRCSHQQSPYQLLFGEPYIFEELLSLKIRISPDAFFQINTAGAEMLYRTVGELTGVNSDTILLDICCGTGVIGLSLAQHTSRVLGIELLEQAVEDARWTAAFNGITNSEFHTGQAEKILPGLLKSKEDGQSIVAVVNPARAGLHYKVIQAIRNFRAIHTLVFVSCKLHGESTRNVIELCCPPDPAKKLLGEPFVLQQAVPVDLFPHTPHCELVLLFTR

SEQ ID NO: 15702 - protein, 504 aa, Artificial Sequence; identical to SEQ ID NO: 15701
  Description of Artificial Sequence: Synthetic coding sequence

SEQ ID NO: 15703 - protein, 459 aa, Artificial Sequence; identical to SEQ ID NO: 15699
  Description of Artificial Sequence: Synthetic coding sequence

SEQ ID NO: 15704 - protein, 504 aa, Artificial Sequence; identical to SEQ ID NO: 15701
  Description of Artificial Sequence: Synthetic coding sequence

SEQ ID NO: 15705 - protein, 513 aa, Artificial Sequence
  Description of Artificial Sequence: Synthetic coding sequence
MSYGSIARGGGLGSRGPFGGPSRQGCQPLECARCWTEYGIRHFPCPSPESKLQNRCVGKDGEGDLGPAGTPIVPRARKRGPGVAPEGSRMPEPTSSPTIGPRKDSAAGPHGRMAGPSTTRAKKRKPNFCPQETEVLVSKVSKHHQLLFGTGLLKAEPTRRYRVWSRILQAVNALGYCRRDVVDLKHKWRDLRAVVRRKLGDLRKAAHGPSPGSGKPQALALTPVEQVVAKTFSCQALPSEGFSLEPPRATQVDPCNLQELFQEMSANVFRINSSVTSLERSLQSLGTPSDTQELRDSLHTAQQETNKTIAASASSVKQMAELLRSSCPQERLQQERPQLDRLKTQLSDAIQCYGVVQKKIAEKSRALLPMAQRGSKQSPQAPFAELADDEKVFNGSDNMWQGQEQALLPDITEEDLEAIRLREEAILQMESNLLDVNQIIKDLASMVSEQGEAVDSIEASLEAASSHAEAARQLLAGASRHQLQRHKIKCCFLSAGVTALLVIIIIIATSVRK

SEQ ID NO: 15706 - protein, 277 aa, Artificial Sequence
  Description of Artificial Sequence: Synthetic coding sequence
MSYGSIARGGGLGSRGPFGGPSRQGCQPLATQVDPCNLQELFQEMSANVFRINSSVTSLERSLQSLGTPSDTQELRDSLHTAQQETNKTIAASASSVKQMAELLRSSCPERLQQERPQLDRLKTQLSDAIQCYGVVQKKIAEKSRALLPMAQRGSKQQSPQAPFAELADDEKVFNGSDNMWQGQEQALLPDITEEDLEAIRLREEAILQMESNLLDVNQIIKDLASMVSEQGEAVDSIEASLEAASSHAEAARQLLAGASRHQLMRRTRPPAACGCP

SEQ ID NO: 15707 - protein, 513 aa, Artificial Sequence
  Description of Artificial Sequence: Synthetic coding sequence
MSYGSIARGGGLGSRGPFGGPSRQGCQPLECARCWTEYGIRHFPCPSPESKLQNRCVGKDGEGDLGPAGTPIVPRARKRGPGVAPEGSRMPEPTSSPTIGPRKDSAAGPHGRMAGPSTTRAKKRKPNFCPQETEVLVSKVSKHHQLLFGTGLLKAEPTRRYRVWSRILQAVNALGYCRRDVVDLKHKWRDLRAVVRRKLGDLRKAAHGPSPGSGKPQALALTPVEQVVAKTFSCQALPSEGFSLEPPRATQVDPCNLQELFQEMSANVFRINSSVTSLERSLQSLGTPSDTQELRDSLHTAQQETNKTIAASASSVKQMAELLRSSCPERLQQERPQLDRLKTQLSDAIQCYGVVQKKIAEKSRALLPMAQRGSKQQSPQAPFAELADDEKVFNGSDNMWQGQEQALLPDITEEDLEAIRLREEAILQMESNLLDVNQIIKDLASMVSEQGEAVDSIEASLEAASSHAEAARQLLAGASRHQLQRHKIKCCFLSAGVTALLVIIIIIATSVRK

SEQ ID NO: 15708 - protein, 150 aa, Artificial Sequence
  Description of Artificial Sequence: Synthetic coding sequence
MSYGSIARGGGLGSRGPFGGPSRQGCQPLECARCWTEYGIRHFPCPSPESKLQNRCVGKDGEGDLGPAGTPIVPRARKRGPGVAPEGSRMPEPTSSPTIGPRKDSAAGPHGRMAGPSTTRAKKRKPNFCPQETEVLVSKVSKHHQLLFGT

SEQ ID NO: 15709 - protein, 512 aa, Artificial Sequence
  Description of Artificial Sequence: Synthetic coding sequence
MSYGSIARGGGLGSRGPFGGPSRQGCQPLECARCWTEYGIRHFPCPSPESKLQNRCVGKDGEGDLGPAGTPIVPRARKRGPGVAPEGSRMPEPTSSPTIGPRKDSAAGPHGRMAGPSTTRAKKRKPNFCPQETEVLVSKVSKHHQLLFGTGLLKAEPTRRYRVWSRILQAVNALGYCRRDVVDLKHKWRDLRAVVRRKLGDLRKAAHGPSPGSGKPQALALTPVEQVVAKTFSCQALPSEGFSLEPPRATQVDPCNLQELFQEMSANVFRINSSVTSLERSLQSLGTPSDTQELRDSLHTAQQETNKTIAASASSVKQMAELLRSSCPERLQQERPQLDRLKTQLSDAIQCYGVVQKKIAEKSRALLPMAQRGSKQSPQAPFAELADDEKVFNGSDNMWQGQEQALLPDITEEDLEAIRLREEAILQMESNLLDVNQIIKDLASMVSEQGEAVDSIEASLEAASSHAEAARQLLAGASRHQLQRHKIKCCFLSAGVTALLVIIIIIATSVRK

SEQ ID NO: 15710 - protein, 561 aa, Artificial Sequence
  Description of Artificial Sequence: Synthetic coding sequence
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQVCKAKAAIHQILTENTPVSEQLSVPQRSVGRIIGRGGETIRSICKASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLL

SEQ ID NO: 15711 - protein, 557 aa, Artificial Sequence
  Description of Artificial Sequence: Synthetic coding sequence
MSTERTSWTSLSTIQKIALGLGIPASATVAYILYRRYRESREERLTFVGEDDIEIEMRVPQEAVKLIIGRQGANIKQTGARIDVDTEDVGDERVLLISGFPVQVCKAKAAIHQILTENTPVSEQLSVPQRSVGRIIGRGGETIRSICKASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLL

SEQ ID NO: 15712 - protein, 561 aa, Artificial Sequence; identical to SEQ ID NO: 15710
  Description of Artificial Sequence: Synthetic coding sequence

SEQ ID NO: 15713 - protein, 516 aa, Artificial Sequence
  Description of Artificial Sequence: Synthetic coding sequence
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLL

SEQ ID NO: 15714 - protein, 561 aa, Artificial Sequence; identical to SEQ ID NO: 15710
  Description of Artificial Sequence: Synthetic coding sequence

SEQ ID NO: 15715 - protein, 337 aa, Artificial Sequence
  Description of Artificial Sequence: Synthetic coding sequence
MTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLL

SEQ ID NO: 15716 - protein, 561 aa, Artificial Sequence; identical to SEQ ID NO: 15710
  Description of Artificial Sequence: Synthetic coding sequence

SEQ ID NO: 15717 - protein, 131 aa, Artificial Sequence
  Description of Artificial Sequence: Synthetic coding sequence
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQVCKAKAAIHQILTENTPVSEQLSV

SEQ ID NO: 15718 - protein, 417 aa, Artificial Sequence
  Description of Artificial Sequence: Synthetic coding sequence
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 15719 - protein, 423 aa, Artificial Sequence
  Description of Artificial Sequence: Synthetic coding sequence
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQVRQRLGSL

SEQ ID NO: 15720 - protein, 417 aa, Artificial Sequence; identical to SEQ ID NO: 15718
  Description of Artificial Sequence: Synthetic coding sequence

SEQ ID NO: 15721 - protein, 285 aa, Artificial Sequence
  Description of Artificial Sequence: Synthetic coding sequence
MECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 15722 - protein, 189 aa, Artificial Sequence
  Description of Artificial Sequence: Synthetic coding sequence
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLSISLIMWNALYTAEKVIIRWTLLTEACYFGVQFLVVTATLAETGLMSLGILLLLVSRLLFVVISIYYYYQVGRRPKKA

SEQ ID NO: 15723 - protein, 136 aa, Artificial Sequence
  Description of Artificial Sequence: Synthetic coding sequence
MTTGRCIAPRVWQFVSAVLFSGIAIMALAFPDQLYDAVFDGAQVTSKTPIRLYGGALLSISLIMWNALYTAEKVIIRWTLLTEACYFGVQFLVVTATLAETGLMSLGILLLLVSRLLFVVISIYYYYQVGRRPKKA

SEQ ID NO: 15724 - protein, 189 aa, Artificial Sequence; identical to SEQ ID NO: 15722
  Description of Artificial Sequence: Synthetic coding sequence

SEQ ID NO: 15725 - protein, 189 aa, Artificial Sequence; identical to SEQ ID NO: 15722
  Description of Artificial Sequence: Synthetic coding sequence

SEQ ID NO: 15726 - protein, 98 aa, Artificial Sequence
  Description of Artificial Sequence: Synthetic coding sequence
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVT

SEQ ID NO: 15727 - protein, 73 aa, Artificial Sequence
  Description of Artificial Sequence: Synthetic coding sequence
MAAKQPPPLMKKHSQTDLVSRLKTRKILGVGGEDDDGEVHRSKISQVLGNEIKFTIREPLGLRVWQFVSAVLF

SEQ ID NO: 15728 - protein, 158 aa, Artificial Sequence
  Description of Artificial Sequence: Synthetic coding sequence
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLSISLIMWNALYTAEKVIIRWTLLTEACYFGVQFLVVTATLAETGLMS

SEQ ID NO: 15729 - protein, 79 aa, Artificial Sequence
  Description of Artificial Sequence: Synthetic coding sequence
MAAKQPPPLMKKHSQTDLVSRLKTRKILGVGGEDDDGEVHRSKISQVLGNEIKFTIREPLGLRVWQFVSAVLFSGIAIM

SEQ ID NO: 15730 - protein, 93 aa, Artificial Sequence
  Description of Artificial Sequence: Synthetic coding sequence
MAAKQPPPLMKKHSQTDLVSRLKTRKILGVGGEDDDGEVHRSKISQVLGNEIKFTIREPLGLRVWQFVSAVLFSGIAIMALAFPDQLYDAVFD

SEQ ID NO: 15731 - protein, 62 aa, Artificial Sequence
  Description of Artificial Sequence: Synthetic coding sequence
MAAKQPPPLMKKHSQTDLVSRLKTRKILGVGGEDDDGEVHRSKISQVLGNEIKFTIREPLGL

SEQ ID NO: 15732 - protein, 189 aa, Artificial Sequence; identical to SEQ ID NO: 15722
  Description of Artificial Sequence: Synthetic coding sequence

SEQ ID NO: 15733 - protein, 393 aa, Artificial Sequence
  Description of Artificial Sequence: Synthetic coding sequence
MAPPPPSPQLLLLAALARLLGPSEVMAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSALRFPSASPGSLKAKQSMAGIPGRESNAPSVPTVSLLPGAPGGNASSRTEAQVPNGQGSPGGCVCSSQASPAPRAAAPPRAARGPTPRTEEAAWAAMALTFLLVLLTLATLCTRLHRNFRRGESIYWGPTADSQDTVAAVLKRRLLQPSRRVKRSRRRPLLPPTPDSGPEGESSE

SEQ ID NO: 15734 - protein, 137 aa, Artificial Sequence
  Description of Artificial Sequence: Synthetic coding sequence
AKQSMAGIPGRESNAPSVPTVSLLPGAPGGNASSRTEAQVPNGQGPRGLCLFKSGFPGPSRSSPRAARGPTPRTEEAAWAAMALTFLLVLLTLATLCTRLHRNFRRGESIYWGPTADSQDTTPPPAHDSGPEGESSE

SEQ ID NO: 15735 - protein, 534 aa, Artificial Sequence
  Description of Artificial Sequence: Synthetic coding sequence
MQAARVDYIAPWWVVWLHSVPHVGLRLQPVNSTFSPGDESYQESLLFLGLVAAVCLGLNLIFLVAYLVCACHCRRDDAVQTKQHHSCCITWTAVVAGLICCAAVGVGFYGNSETNDGAYQLMYSLDDANHTFSGIDALVSGTTQKMKVDLEQHLARLSEIFAARGDYLQTLKFIQQMAGSVVVQLSGLPVWREVTMELTKLSDQTGYVEYYRWLSYLLLFILDLVICLIACLGLAKRSKCLLASMLCCGALSLLLSWASLAADGSAAVATSDFCVAPDTFILNVTEGQISTEVTRYYLYCSQSGSSPFQQTLTTFQRALTTMQIQVAGLLQFAVPLFSTAEEDLLAIQLLLNSSESSLHQLTAMVDCRGLHKDYLDALAGICYDGLQGLLYLGLFSFLAALAFSTMICAGPRAWKHFTTRNRDYDDIDDDDPFNPQAWRMAAHSPPRGQLHSFCSYSSGLGSQTSLQPPAQTISNAPVSEYMNQAMLFGRNPRYENVPLIGRASPPPTYSPSMRATYLSVADEHLRHYGNQFPA

SEQ ID NO: 15736 - protein, 213 aa, Artificial Sequence
  Description of Artificial Sequence: Synthetic coding sequence
MQIQVAGLLQFAVPLFSTAEEDLLAIQLLLNSSESSLHQLTAMVDCRGLHKDYLDALAGICYDGLQGLLYLGLFSFLAALAFSTMICAGPRAWKHFTTRNRDYDDIDDDDPFNPQAWRMAAHSPPRGQLHSFCSYSSGLGSQTSLQPPAQTISNAPVSEYMNQAMLFGRNPRYENVPLIGRASPPPTYSPSMRATYLSVADEHLRHYGNQFPA

SEQ ID NO: 15737 - protein, 523 aa, Artificial Sequence
  Description of Artificial Sequence: Synthetic coding sequence
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHANRTVAGVQDRVWDTAVGLNHTAEPSLQTLERQLAGRPEPLRAVQRLQGLLETLLGYTAAIPFWRNTAVSLEVLAEQVDLYDWYRWLGYLGLLLLDVIICLLVLVGLIRSSKGILVGVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 15738 - protein, 352 aa, Artificial Sequence
  Description of Artificial Sequence: Synthetic coding sequence
MPSGVPGCWPQLPLKGPWRPTPRPRVPVPWRTPRFACRWLGYLGLLLLDVIICLLVLVGLIRSSKGILVGVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 15739 - protein, 491 aa, Artificial Sequence
  Description of Artificial Sequence: Synthetic coding sequence
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHANRTVAGVQDRVWDTAVGLNHTAEPSLQTLERQLAGRPEPLRAVQRLQGLLETLLGYTAAIPFWRNTAVSLEVLAEQVDLYDWYRVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 15740 - protein, 202 aa, Artificial Sequence
  Description of Artificial Sequence: Synthetic coding sequence
MAEYLASIFGTEKDKVNCSFYFKIGVCRHGDRCSRLHNKPTFSQEVFTELQEKYGEIEEMNVCDNLGDHLVGNVYVKFRREEDGERAVAELSNRWFNGQAVHGNVPEVASATSCICGPFPRTSRGSSMGGDPGAGHPRGSILATIPERGTIGVPLITGMAASEALAPLPFTPNRDRCSWQDLSSKPPSLSCPILPRLPGSIM

SEQ ID NO: 15741 - protein, 181 aa, Artificial Sequence
  Description of Artificial Sequence: Synthetic coding sequence
MAEYLASIFGTEKDKVNCSFYFKIGVCRHGDRCSRLHNKPTFSQEVFTELQEKYGEIEEMNVCDNLGDHLVGNVYVKFRREEDGERAVAELSNRWFNGQAVHGELSPVTDFRESCCRQYEMGECTRGGFCNFMHLRPISQNLQRQLYGRGPRRRSPPRFHTGHHPRERNHRCSPDHWHGRF

SEQ ID NO: 15742 - protein, 183 aa, Artificial Sequence
  Description of Artificial Sequence: Synthetic coding sequence
MCATTLGTTSWATSMSSSGGRRMESGPWLNSVTAGSTGRLCTGMYPRWLLQLHASAAHFPEPPEAALWAGTQAQVPQDQPAMSPHVLRPLYPQMSLTLSPSNHVPKNFFFFFFFEMEPHSVAQAGVHWHHLGSWQLPPPGFKQFSASASQIAGITGTCHHARLIFVFLVEMGFHHLGQAGLNS

SEQ ID NO: 15743 - protein, 220 aa, Artificial Sequence
  Description of Artificial Sequence: Synthetic coding sequence
MAEYLASIFGTEKDKVNCSFYFKIGVCRHGDRCSRLHNKPTFSQTIVLLNLYRNPQNTAQTADGSHCHVSDVEVQEHYDSFFEEVFTELQEKYGEIEEMNVCDNLGDHLVGNVYVKFRREEDGERAVAELSNRWFNGQAVHGELSPVTDFRESCCRQYEMGECTRGGFCNFMHLRPISQNLQRQLYGRGPRRRSPPRFHTGHHPRERNHRCSPDHWHGRF

SEQ ID NO: 15744 - protein, 309 aa, Artificial Sequence
  Description of Artificial Sequence: Synthetic coding sequence
MCFFFSLQEEFLDKHTLMRVLSSGGKLGSRGEGAQLCCWMLLFSWRVSGGQQTRRLCRRAFCWSPVPSPSCSPSSCLTARSSLCMTFTQSRTTSSLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 15745 - protein, 344 aa, Artificial Sequence
  Description of Artificial Sequence: Synthetic coding sequence
MFTSTGSSGLYKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSGFLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 15746 - protein, 63 aa, Artificial Sequence
  Description of Artificial Sequence: Synthetic coding sequence
MAAATLTSKLYSLLFRRTSTFALTIIVGVMFFERAFDQGADAIYDHINEGKLWKHIKHKYENK

SEQ ID NO: 15747 - protein, 132 aa, Artificial Sequence
  Description of Artificial Sequence: Synthetic coding sequence
MAAATLTSKLYSLLFRRPPPSPSPSSWASCSSSAPSIKARTLSTTTSTRGSCGNTSSTSMRTSSSLEAPIQARRTRSTQQLFAQSWSLSLKMMLKVLFMDHHSLLARNGFTYKTDSLPSAVFEVCLVSMLRK

SEQ ID NO: 15748 - protein, 62 aa, Artificial Sequence
  Description of Artificial Sequence: Synthetic coding sequence
MAAATLTSKLYSLLFRRTSTFALTIIVGVMFFERAFDQGADAIYDHINEGVRACAIPDLGPA

SEQ ID NO: 15749 - protein, 82 aa, Artificial Sequence
  Description of Artificial Sequence: Synthetic coding sequence
MAAATLTSKLYSLLFRRTSTFALTIIVGVMFFERAFDQGADAIYDHINEGVRACAIPPWTRLRGDSGVEKLWKHIKHKYENK

SEQ ID NO: 15750 - protein, 56 aa, Artificial Sequence
  Description of Artificial Sequence: Synthetic coding sequence
MVTRFLGPRYRELVKNWVPTAYTWGAVGAVGLVWATDWRLILDWVPYINGKFKKDN

SEQ ID NO: 15751 - protein, 5176 aa, Artificial Sequence
  Description of Artificial Sequence: Synthetic coding sequence
MATSGGEEAAAAAPAPGTPATGADTTPGWEVAVRPLLSASYSAFEMKELPQLVASVIESESEILHHEKQYEPFYSSFVALSTHYITTVCSLIPRNQLQSVAAACKVLIEFSLLRLENPDEACAVSQKHLILLIKGLCTGCSRLDRTEIITFTAMMKSAKLPQTVKTLSDVEDQKELASPVSPELRQKEVQMNFLNQLTSVFNPRTVASQPISTQTLVEGENDEQSSTDQASAIKTKNVFIAQNVASLQELGGSEKLLRVCLNLPYFLRYINRFQDAVLANSFFIMPATVADATAVRNGFHSLVIDVTMALDTLSLPVLEPLNPSRLQDVTVLSLSCLYAGVSVATCMAILHVGSAQQVRTGSTSSKEDDYESDAATIVQKCLEIYDMIGQAISSSRRAGGEHYQNFQLLGAWCLLNSLFLILNLSPTALADKGKEKDPLAALRVRDILSRTKEGVGSPKLGPGKGHQGFGVLSVILANHAIKLLTSLFQDLQVEALHKGWETDGPPAALSIMAQSTSIQRIQRLIDSVPLMNLLLTLLSTSYRKACVLQRQRKGSMSSDASASTDSNTYYEDDFSSTEEDSSQDDDSEPILGQWFEETISPSKEKAAPPPPPPPPPLESSPRVKSPSKQAPGEKGNILASRKDPELFLGLASNILNFITSSMLNSRNNFIRNYLSVSLSEHHMATLASIIKEVDKDGLKGSSDEEFAAALYHFNHSLVTSDLQSPNLQNTLLQQLGVAPFSEGPWPLYIHPQSLSVLSRLLLIWQHKASAQGDPDVPECLKVWDRFLSTMKQNALQGVVPSETEDLNVEHLQMLLLIFHNFTETGRRAILSLFVQIIQELSVNMDAQMRFVPLILARLLLIFDYLLHQYSKAPVYLFEQVQHNLLSPPFGWASGSQDSNSRRATTPLYHGFKEVEENWSKHFSSDAVPHPRFYCVLSPEASEDDLNRLDSVACDVLFSKLVKYDELYAALTALLAAGSQLDTVRRKENKNVTALEACALQYYFLILWRILGILPPSKTYINQLSMNSPEMSECDILHTLRWSSRLRISSYVNWIKDHLIKQGMKAEHASSLLELASTTKCSSVKYDVEIVEEYFARQISSFCSIDCTTILQLHEIPSLQSIYTLDAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEEMENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 15752 - protein, 212 aa, Artificial Sequence
  Description of Artificial Sequence: Synthetic coding sequence
MVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQVVPRCKGHLDKGLGLDQKTAS

SEQ ID NO: 15753 - protein, 890 aa, Artificial Sequence
  Description of Artificial Sequence: Synthetic coding sequence
MLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEEMENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 15754 - protein, 258 aa, Artificial Sequence
  Description of Artificial Sequence: Synthetic coding sequence
MGPGKKGRCREEGPGRGRRAWIIRGSGSSRQGWVGSVESSKRSANVTRQRQIEQILPALAAGSCFHPAFILSCRFSSRTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 15755 - protein, 5159 aa, Artificial Sequence
  Description of Artificial Sequence: Synthetic coding sequence
MATSGGEEAAAAAPAPGTPATGADTTPGWEVAVRPLLSASYSAFEMKELPQLVASVIESESEILHHEKQYEPFYSSFVALSTHYITTVCSLIPRNQLQSVAAACKVLIEFSLLRLENPDEACAVSQKHLILLIKGLCTGCSRLDRTEIITFTAMMKSAKLPQTVKTLSDVEDQKELASPVSPELRQKEVQMNFLNQLTSVFNPRTVASQPISTQTLVEGENDEQSSTDQASAIKTKNVFIAQNVASLQELGGSEKLLRVCLNLPYFLRYINRFQDAVLANSFFIMPATVADATAVRNGFHSLVIDVTMALDTLSLPVLEPLNPSRLQDVTVLSLSCLYAGVSVATCMAILHVGSAQQVRTGSTSSKEDDYESDAATIVQKCLEIYDMIGQAISSSRRAGGEHYQNFQLLGAWCLLNSLFLILNLSPTALADKGKEKDPLAALRVRDILSRTKEGVGSPKLGPGKGHQGFGVLSVILANHAIKLLTSLFQDLQVEALHKGWETDGPPAALSIMAQSTSIQRIQRLIDSVPLMNLLLTLLSTSYRKACVLQRQRKGSMSSDASASTDSNTYYEDDFSSTEEDSSQDDDSEPILGQWFEETISPSKEKAAPPPPPPPPPLESSPRVKSPSKQAPGEKGNILASRKDPELFLGLASNILNFITSSMLNSRNNFIRNYLSVSLSEHHMATLASIIKEVDKDGLKGSSDEEFAAALYHFNHSLVTSDLQSPNLQNTLLQQLGVAPFSEGPWPLYIHPQSLSVLSRLLLIWQHKASAQGDPDVPECLKVWDRFLSTMKQNALQGVVPSETEDLNVEHLQMLLLIFHNFTETGRRAILSLFVQIIQELSVNMDAQMRFVPLILARLLLIFDYLLHQYSKAPVYLFEQVQHNLLSPPFGWASGSQDSNSRRATTPLYHGFKEVEENWSKHFSSDAVPHPRFYCVLSPEASEDDLNRLDSVACDVLFSKLVKYDELYAALTALLAAGSQLDTVRRKENKNVTALEACALQYYFLILWRILGILPPSKTYINQLSMNSPEMSECDILHTLRWSSRLRISSYVNWIKDHLIKQGMKAEHASSLLELASTTKCSSVKYDVEIVEEYFARQISSFCSIDCTTILQLHEIPSLQSIYTLDAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLESSETESLTKLDRLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEEMENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 15756 - protein, 5183 aa, Artificial Sequence
  Description of Artificial Sequence: Synthetic coding sequence
MATSGGEEAAAAAPAPGTPATGADTTPGWEVAVRPLLSASYSAFEMKELPQLVASVIESESEILHHEKQYEPFYSSFVALSTHYITTVCSLIPRNQLQSVAAACKVLIEFSLLRLENPDEACAVSQKHLILLIKGLCTGCSRLDRTEIITFTAMMKSAKLPQTVKTLSDVEDQKELASPVSPELRQKEVQMNFLNQLTSVFNPRTVASQPISTQTLVEGENDEQSSTDQASAIKTKNVFIAQNVASLQELGGSEKLLRVCLNLPYFLRYINRFQDAVLANSFFIMPATVADATAVRNGFHSLVIDVTMALDTLSLPVLEPLNPSRLQDVTVLSLSCLYAGVSVATCMAILHVGSAQQVRTGSTSSKEDDYESDAATIVQKCLEIYDMIGQAISSSRRAGGEHYQNFQLLGAWCLLNSLFLILNLSPTALADKGKEKDPLAALRVRDILSRTKEGVGSPKLGPGKGHQGFGVLSVILANHAIKLLTSLFQDLQVEALHKGWETDGPPAALSIMAQSTSIQRIQRLIDSVPLMNLLLTLLSTSYRKACVLQRQRKGSMSSDASASTDSNTYYEDDFSSTEEDSSQDDDSEPILGQWFEETISPSKEKAAPPPPPPPPPLESSPRVKSPSKQAPGEKGNILASRKDPELFLGLASNILNFITSSMLNSRNNFIRNYLSVSLSEHHMATLASIIKEVDKDGLKGSSDEEFAAALYHFNHSLVTSDLQSPNLQNTLLQQLGVAPFSEGPWPLYIHPQSLSVLSRLLLIWQHKASAQGDPDVPECLKVWDRFLSTMKQNALQGVVPSETEDLNVEHLQMLLLIFHNFTETGRRAILSLFVQIIQELSVNMDAQMRFVPLILARLLLIFDYLLHQYSKAPVYLFEQVQHNLLSPPFGWASGSQDSNSRRATTPLYHGFKEVEENWSKHFSSDAVPHPRFYCVLSPEASEDDLNRLDSVACDVLFSKLVKYDELYAALTALLAAGSQLDTVRRKENKNVTALEACALQYYFLILWRILGILPPSKTYINQLSMNSPEMSECDILHTLRWSSRLRISSYVNWIKDHLIKQGMKAEHASSLLELASTTKCSSVKYDVEIVEEYFARQISSFCSIDCTTILQLHEIPSLQSIYTLDAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEEMENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 15757 - protein, 5204 aa, Artificial Sequence
  Description of Artificial Sequence: Synthetic coding sequence
MATSGGEEAAAAAPAPGTPATGADTTPGWEVAVRPLLSASYSAFEMKELPQLVASVIESESEILHHEKQYEPFYSSFVALSTHYITTVCSLIPRNQLQSVAAACKVLIEFSLLRLENPDEACAVSQKHLILLIKGLCTGCSRLDRTEIITFTAMMKSAKLPQTVKTLSDVEDQKELASPVSPELRQKEVQMNFLNQLTSVFNPRTVASQPISTQTLVEGENDEQSSTDQASAIKTKNVFIAQNVASLQELGGSEKLLRVCLNLPYFLRYINRFQDAVLANSFFIMPATVADATAVRNGFHSLVIDVTMALDTLSLPVLEPLNPSRLQDVTVLSLSCLYAGVSVATCMAILHVGSAQQVRTGSTSSKEDDYESDAATIVQKCLEIYDMIGQAISSSRRAGGEHYQNFQLLGAWCLLNSLFLILNLSPTALADKGKEKDPLAALRVRDILSRTKEGVGSPKLGPGKGHQGFGVLSVILANHAIKLLTSLFQDLQVEALHKGWETDGPPAALSIMAQSTSIQRIQRLIDSVPLMNLLLTLLSTSYRKACVLQRQRKGSMSSDASASTDSNTYYEDDFSSTEEDSSQDDDSEPILGQWFEETISPSKEKAAPPPPPPPPPLESSPRVKSPSKQAPGEKGNILASRKDPELFLGLASNILNFITSSMLNSRNNFIRNYLSVSLSEHHMATLASIIKEVDKDGLKGSSDEEFAAALYHFNHSLVTSDLQSPNLQNTLLQQLGVAPFSEGPWPLYIHPQSLSVLSRLLLIWQHKASAQGDPDVPECLKVWDRFLSTMKQNALQGVVPSETEDLNVEHLQMLLLIFHNFTETGRRAILSLFVQIIQELSVNMDAQMRFVPLILARLLLIFDYLLHQYSKAPVYLFEQVQHNLLSPPFGWASGSQDSNSRRATTPLYHGFKEVEENWSKHFSSDAVPHPRFYCVLSPEASEDDLNRLDSVACDVLFSKLVKYDELYAALTALLAAGSQLDTVRRKENKNVTALEACALQYYFLILWRILGILPPSKTYINQLSMNSPEMSECDILHTLRWSSRLRISSYVNWIKDHLIKQGMKAEHASSLLELASTTKCSSVKYDVEIVEEYFARQISSFCSIDCTTILQLHEIPSLQSIYTLDAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEEMENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKQTTPTVGGIDTGSLEPCVCEKVPTSNTEGGWSCSLAEYIRHNDMPIYEAADKALKTFQEEFMPVETFSEFLDVAGLLSEITDPESFLKDLLNSVP

SEQ ID NO: 15758 - protein, 2058 aa, Artificial Sequence
  Description of Artificial Sequence: Synthetic coding sequence
LVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLESSETESLTKLDRLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKK

SEQ ID NO: 15759 - protein, 1672 aa, Artificial Sequence
  Description of Artificial Sequence: Synthetic coding sequence
RFLSTMKQNALQGVVPSETEDLNVEHLQMLLLIFHNFTETGRRAILSLFVQIIQELSVNMDAQMRFVPLILARLLLIFDYLLHQYSKAPVYLFEQVQHNLLSPPFGWASGSQDSNSRRATTPLYHGFKEVEENWSKHFSSDAVPHPRFYCVLSPEASEDDLNRLDSVACDVLFSKLVKYDELYAALTALLAAGSQLDTVRRKENKNVTALEACALQYYFLILWRILGILPPSKTYINQLSMNSPEMSECDILHTLRWSSRLRISSYVNWIKDHLIKQGMKAEHASSLLELASTTKCSSVKYDVEIVEEYFARQISSFCSIDCTTILQLHEIPSLQSIYTLDAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKQDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFSESPTPGADSVLIVTAKLGATGLWLSNILGSLHSADFSVLSSGNFELHLMY

SEQ ID NO: 15760 - protein, 984 aa, Artificial Sequence
  Description of Artificial Sequence: Synthetic coding sequence
DFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKE

SEQ ID NO: 15761 - protein, 706 aa, Artificial Sequence
  Description of Artificial Sequence: Synthetic coding sequence
MRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEEMENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 15762 - protein, 847 aa, Artificial Sequence
  Description of Artificial Sequence: Synthetic coding sequence
MAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEEMENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 15763 - protein, 1318 aa, Artificial Sequence
  Description of Artificial Sequence: Synthetic coding sequence
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQASRIWQELEAEEEPVPEGSGPLGPWGPQDWVGPLPRGPTTPDEGCLRYFVLGTVAALVALVLNVFYPLVSQSRWR

SEQ ID NO: 15764 - protein, 515 aa, Artificial Sequence
  Description of Artificial Sequence: Synthetic coding sequence
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEELLLDWRQSAEEVIVKLRVGVGPLQLEDVDAAFTDTDCVVRFAGGQQWGGVFYAEIKSSCAKVQTRKGSLLHLTLPKKVPMLTWPSLLKKPLGTQELVPGLRCQENGQELSPIALEPGPEPHRAKQEARNQKRAQGRGEVGAGAGPGAQAGPSAKRAVHLCRGPEGDGSRDDPGPRGDAPPFVADPATQVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGPGGPGCTRCSGWCKGCRADRSNPSGFNPTRRCSPPPDRPGGGPGCGEG

SEQ ID NO: 15765 - protein, 1384 aa, Artificial Sequence
  Description of Artificial Sequence: Synthetic coding sequence
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLKKPLGTQELVPGLRCQENGQELSPIALEPGPEPHRAKQEARNQKRAQGRGEVGAGAGPGAQAGPSAKRAVHLCRGPEGDGSRDDPGPRGDAPPFVADPATQVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQGLGPGQAPEVAPTRTAPERFAPPVDRPAPTYSNMEEVD

SEQ ID NO: 15766 - protein, 1419 aa, Artificial Sequence
  Description of Artificial Sequence: Synthetic coding sequence
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLKKPLGTQELVPGLRCQENGQELSPIALEPGPEPHRAKQEARNQKRAQGRGEVGAGAGPGAQAGPSAKRAVHLCRGPEGDGSRDDPGPRGDAPPFVADPATQVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQASRIWQELEAEEEPVPEGSGPLGPWGPQDWVGPLPRGPTTPDEGCLRYFVLGTVAALVALVLNVFYPLVSQSRWR

SEQ ID NO: 15767 - protein, 1372 aa, Artificial Sequence
  Description of Artificial Sequence: Synthetic coding sequence
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKKKPLGTQELVPGLRCQENGQELSPIALEPGPEPHRAKQEARNQKRAQGRGEVGAGAGPGAQAGPSAKRAVHLCRGPEGDGSRDDPGPRGDAPPFVADPATQVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQGLGPGQAPEVAPTRTAPERFAPPVDRPAPTYSNMEEVD

SEQ ID NO: 15768 - protein, 1118 aa, Artificial Sequence
  Description of Artificial Sequence: Synthetic coding sequence
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQQKRQETGREDGGTLAKGSLENVLDSKDKTQKSNGEKNEKCETKEKGAITAKELYTMMTDKNISLIIMDARRMQDYQDSCILHSLSVPEEAISPGVTASWIEAHLPDDSKDTWKKRGNVEYVVLLDWFSSAKDLQIGTTLRSLKDALFKWESKTVLRNEPLVLEGGYENWLLCYPQYTTNAKVTPPPRRQNEEVSISLDFTYPSLEESIPSKPAAQTPPASIEVDENIELISGQNERMGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEKELRERQQEEQKEKLRKEEQEQKAKKKQEAEENEITEKQQKAKEEMEKKESEQAKKEDKETSAKRGKEITGVKRQSKSEHETSDAKKSVEDRGKRCPTPEIQKKSTGDVPHTSVTGDSGSGKPFKIKGQPESGILRTGTFREDTDDTERNKAQREPLTRARSEEMGRIVPGLPSGWAKFLDPITGTFRYYHSPTNTVHMYPPEMAPSSAPPSTPPTHKAKPQIPAERDREPSKLKRSYSSPDITQAIQEEEKRKPTVTPTVNRENKPTCYPKAEISRLSASQIRNLNPVFGGSGPALTGLRNLGNTCYMNSILQCLCNAPHLADYFNRNCYQDDINRSNLLGHKGEVAEEFGIIMKALWTGQYRYISPKDFKITIGKINDQFAGYSQQDSQELLLFLMDGLHEDLNKADNRKRYKEENNDHLDDFKAAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHYGGLDGGHYTAYCKNAARQRWFKFDDHEVSDISVSSVKSSAAYILFYTSLGPRVTDVAT

SEQ ID NO: 15769 - protein, 331 aa, Artificial Sequence
  Description of Artificial Sequence: Synthetic coding sequence
LTGLRNLGNTCYMNSILQCLCNAPHLADYFLTGKYMSNLLGHKGEVAEEFGIIMKALWTGQYRYISPKDFKITIGKINDQFAGYSQQDSQELLLFLMDGLHEDLNKFQADNRKRYKEETAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHYGGLDGGHYTAYCKNAARQRWFKFDDHEVSDISVSSVKSSAAYILFYTSLGPRVTDVAT

SEQ ID NO: 15770 - protein, 1118 aa, Artificial Sequence; identical to SEQ ID NO: 15768
  Description of Artificial Sequence: Synthetic coding sequence

SEQ ID NO: 15771 - protein, 1118 aa, Artificial Sequence; identical to SEQ ID NO: 15768
  Description of Artificial Sequence: Synthetic coding sequence

SEQ ID NO: 15772 - protein, 135 aa, Artificial Sequence
  Description of Artificial Sequence: Synthetic coding sequence
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQ

SEQ ID NO: 15773 - protein, 96 aa, Artificial Sequence
  Description of Artificial Sequence: Synthetic coding sequence
MPAVASVPKELYLSSSLKDLNKKTEVKPEKISTKSYVHSALKIFKTAEECRLDRDEERAYVLYMKYVTVYNLIKKRPDFKQQQDYFHSILGPGNIK

SEQ ID NO: 15774 - protein, 73 aa, Artificial Sequence
  Description of Artificial Sequence: Synthetic coding sequence
MPAVASVPKELYLSSSLKDLNKKTEVKPEKISTKSYVHSALKIFKTAEECRLDRDEERAYVLYMKYVTVYNLI

SEQ ID NO: 15775 - protein, 43 aa, Artificial Sequence
  Description of Artificial Sequence: Synthetic coding sequence
MSSTSSKRAPTTATQRLKQDYLRIKKDPVPYICAEPLPSNILE

SEQ ID NO: 15776 - protein, 318 aa, Artificial Sequence
  Description of Artificial Sequence: Synthetic coding sequence
METRYNLKSPAVKRLMKEAAELKDPTDHYHAQPLEDNLFEWHFTVRGPPDSDFDGGVYHGRIVLPPEYPMKPPSIILLTANGRFEVGKKICLSISGHHPETWQPSWSIRTALLAIIGFMPTKGEGAIGSLDYTPEERRALAKKSQDFCCEGCGSAMKDVLLPLKSGSDSSQADQEAKELARQISFKAEVNSSGKTISESDLNHSFSLTDLQDDIPTTFQGATASTSYGLQNSSAASFHQPTQPVAKNTSMSPRQRRAQQQSQRRLSTSPDVIQGHQPRDNHTDHGGSAVLIVILTLALAALIFRRIYLANEYIFDFEL

SEQ ID NO: 15777 - protein, 303 aa, Artificial Sequence [sequence omitted]

SEQ ID NO: 15778 - protein, 224 aa, Artificial Sequence
  Description of Artificial Sequence: Synthetic coding sequence
MWPQDIAGRHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 15779 - protein, 207 aa, Artificial Sequence
  Description of Artificial Sequence: Synthetic coding sequence
MTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 15780 - protein, 207 aa, Artificial Sequence; identical to SEQ ID NO: 15779
  Description of Artificial Sequence: Synthetic coding sequence

SEQ ID NO: 15781 - protein, 259 aa, Artificial Sequence
  Description of Artificial Sequence: Synthetic coding sequence
MSSTSSKRAPTTATQRLKQDYLRIKKDPVPYICAEPLPSNILEWHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 15782 - protein, 259 aa, Artificial Sequence; identical to SEQ ID NO: 15781
  Description of Artificial Sequence: Synthetic coding sequence

SEQ ID NO: 15783 - protein, 207 aa, Artificial Sequence; identical to SEQ ID NO: 15779
  Description of Artificial Sequence: Synthetic coding sequence

SEQ ID NO: 15784 - protein, 275 aa, Artificial Sequence
  Description of Artificial Sequence: Synthetic coding sequence
MSSTSSKRAPTTATQRLKQDYLRIKKDPVPYICAEPLPSNILEWFKRFSWLSLLSSWDYRHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 15785 - protein, 101 aa, Artificial Sequence
  Description of Artificial Sequence: Synthetic coding sequence
MSSTSSKRAPTTATQRLKQDYLRIKKDPVPYICAEPLPSNILEWFKRFSWLSLLSSWDYRHYVVRGPEMTPYEGGYYHGKLIFPREFPFKPPSIYMITPNG

SEQ ID NO: 15786 - protein, 196 aa, Artificial Sequence
  Description of Artificial Sequence: Synthetic coding sequence
MSSTSSKRAPTTATQRLKQDYLRIKKDPVPYICAEPLPSNILEWHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETH

SEQ ID NO: 15787 - protein, 43 aa, Artificial Sequence; identical to SEQ ID NO: 15775
  Description of Artificial Sequence: Synthetic coding sequence

SEQ ID NO: 15788 - protein, 71 aa, Artificial Sequence
  Description of Artificial Sequence: Synthetic coding sequence
MSSTSSKRAPTTATQRLKQDYLRIKKDPVPYICAEPLPSNILEWHYVVRGPEMTPYEGGYYHGKLIFPREF

SEQ ID NO: 15789 - protein, 147 aa, Artificial Sequence
  Description of Artificial Sequence: Synthetic coding sequence
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 15790 - protein, 147 aa, Artificial Sequence; identical to SEQ ID NO: 15789
  Description of Artificial Sequence: Synthetic coding sequence

SEQ ID NO: 15791 - protein, 148 aa, Artificial Sequence
  Description of Artificial Sequence: Synthetic coding sequence
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRLAREWTEKYAML

SEQ ID NO: 15792 - protein, 147 aa, Artificial Sequence; identical to SEQ ID NO: 15789
  Description of Artificial Sequence: Synthetic coding sequence

SEQ ID NO: 15793 - protein, 149 aa, Artificial Sequence
  Description of Artificial Sequence: Synthetic coding sequence
MLSNRKCLSKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 15794 - protein, 147 aa, Artificial Sequence; identical to SEQ ID NO: 15789
  Description of Artificial Sequence: Synthetic coding sequence

SEQ ID NO: 15795 - protein, 147 aa, Artificial Sequence; identical to SEQ ID NO: 15789
  Description of Artificial Sequence: Synthetic coding sequence

SEQ ID NO: 15796 - protein, 147 aa, Artificial Sequence; identical to SEQ ID NO: 15789
  Description of Artificial Sequence: Synthetic coding sequence

SEQ ID NO: 15797 - protein, 147 aa, Artificial Sequence; identical to SEQ ID NO: 15789
  Description of Artificial Sequence: Synthetic coding sequence

SEQ ID NO: 15798 - protein, 78 aa, Artificial Sequence
  Description of Artificial Sequence: Synthetic coding sequence
MALKRINKELSDLARDPPAQCSAGPVGDDMFHWQATIMGPNDSPYQGGVFFLTIHFPTDYPFKPPKVAFTTRIYHPNI

SEQ ID NO: 15799 - protein, 96 aa, Artificial Sequence
  Description of Artificial Sequence: Synthetic coding sequence
MALKRINKELSDLARDPPAQCSAGPVGDDMFHWQATIMGPNDSPYQGGVFFLTIHFPTDYPFKPPKVAFTTRIYHPNINSNGSICLDILRSQWSPA

SEQ ID NO: 15800 - protein, 49 aa, Artificial Sequence
  Description of Artificial Sequence: Synthetic coding sequence
MALKRINKELSDLARDPPAQCSAGPVGDDMFHWQATIMGPNDSPYQGGV

SEQ ID NO: 15801 - protein, 508 aa, Artificial Sequence
  Description of Artificial Sequence: Synthetic coding sequence
MLWFQGAIPAAIATAKRSGAVFVVFVAGDDEQSTQMAASWEDDKVTEASSNSFVAIKIDTKSEACLQFSQIYPVVCVPSSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLTKKLEERREEKRKEEEQREIKKEIERRKTGKEMLDYKRKQEEELTKRMLEERNREKAEDRAARERIKQQIALDRAERAARFAKTKEEVEAAKAAALLAKQAEMEVKRESYARERSTVARIQFRLPDGSSFTNQFPSDAPLEEARQFAAQTVGNTYGNFSLATMFPRREFTKEDYKKKLLDLELAPSASVVLLPAGRPTASIVHSSSGDIWTLLGTVLYPFLAIWRLISNFLFSNPPPTQTSVRVTSSEPPNPASSSKSEKREPVRKRVLEKRGDDFKKEGKIYRLRTQDDGEDENNTWNGNSTQQM

SEQ ID NO: 15802 - protein, 490 aa, Artificial Sequence
  Description of Artificial Sequence: Synthetic coding sequence
MLWFQGAIPAAIATAKRSGAVFVVFVAGDDEQSTQMAASWEDDKVTEASSNSFVAIKIDTKSEACLQFSQIYPVVCVPSSFFIGDSGIPLEVIAGSVSADELVTRIHKVRQMHLLKTASFEPNNTCENSQSRNAELCEIPPTSDTKSDTATGGESAGHATSSQEPSGCSDQRPAEDLNIRVERLTKKLEERREEKRKEEEQREIKKEIERRKTGKEMLDYKRKQEEELTKRMLEERNREKAEDRAARERIKQQIALDRAERAARFAKTKEEVEAAKAAALLAKQAEMEVKRESYARERSTVARIQFRLPDGSSFTNQFPSDAPLEEARQFAAQTVGNTYGNFSLATMFPRREFTKEDYKKKLLDLELAPSASVVLLPAGRPTASIVHSSSGDIWTLLGTVLYPFLAIWRLISNFLFSNPPPTQTSVRVTSSEPPNPASSSKSEKREPVRKRVLEKRGDDFKKEGKIYRLRTQDDGEDENNTWNGNSTQQM

SEQ ID NO: 15803 - protein, 489 aa, Artificial Sequence
  Description of Artificial Sequence: Synthetic coding sequence
MAAHGGSAASSALKGLIQQFTTITGASESVGKHMLEACNNNLEMAVTMFLDGGGIAEEPSTSSASVSTVRPHTEEEVRAPIPQKQEILVEPEPLFGAPKRRRPARSIFDGFRDFQTETIRQEQELRNGGAIDKKLTTLADLFRPPIDLMHKGSFETAKECGQMQNKWLMINIQNVQDFACQCLNRDVWSNEAVKNIIREHFIFWQVYHDSEEGQRYIQFYKLGDFPYVSILDPRTGQKLVEWHQLDVSSFLDQVTGFLGEHGQLDGLSSSPPKKCARSESLIDASEDSQLEAAIRASLQETHFDSTQTKQDSRSDEESESELFSGSEEFISVCGSDEEEEVENLAKSRKSPHKDLGHRKEENRRPLTEPPVRTDPGTATNHQGLPAVDSEILEMPPEKADGVVEGIDVNGPKAQLMLRYPDGKREQITLPEQAKLLALVKHVQSKGYPNERFELLTNFPRRKLSHLDYDITLQEAGLCPQETVFVQERN

SEQ ID NO: 15804 - protein, 341 aa, Artificial Sequence
  Description of Artificial Sequence: Synthetic coding sequence
MHKGSFETAKECGQMQNKWLMINIQNVQDFACQCLNRDVWSNEAVKNIIREHFIFWQVYHDSEEGQRYIQFYKLGDFPYVSILDPRTGQKLVEWHQLDVSSFLDQVTGFLGEHGQLDGLSSSPPKKCARSESLIDASEDSQLEAAIRASLQETHFDSTQTKQDSRSDEESESELFSGSEEFISVCGSDEEEEVENLAKSRKSPHKDLGHRKEENRRPLTEPPVRTDPGTATNHQGLPAVDSEILEMPPEKADGVVEGIDVNGPKAQLMLRYPDGKREQITLPEQAKLLALVKHVQSKGYPNERFELLTNFPRRKLSHLDYDITLQEAGLCPQETVFVQERN

SEQ ID NO: 15805 - protein, 527 aa, Artificial Sequence
  Description of Artificial Sequence: Synthetic coding sequence
MRSDKSALVFLLLQLFCVGCGFCGKVLVWPCDMSHWLNVKVILEELIVRGHEVTVLTHSKPSLIDYRKPSALKFEVVHMPQDRTEENEIFVDLALNVLPGLSTWQSVIKLNDFFVEIRGTLKMMCESFIYNQTLMKKLQETNYDVMLIDPVIPCGDLMAELLAVPFVLTLRISVGGNMERSCGKLPAPLSYVPVPMTGLTDRMTFLERVKNSMLSVLFHFWIQDYDYHFWEEFYSKALGRPTTLCETVGKAEIWLIRTYWDFEFPQPYQPNFEFVGGLHCKPAKALPKEMENFVQSSGEDGIVVFSLGSLFQNVTEEKANIIASALAQIPQKVLWRYKGKKPSTLGANTRLYDWIPQNDLLGHPKTKAFITHGGMNGIYEAIYHGVPMVGVPIFGDQLDNIAHMKAKGAAVEINFKTMTSEDLLRALRTVITDSSYKENAMRLSRIHHDQPVKPLDRAVFWIEFVMRHKGAKHLRSAAHDLTWFQHYSIDVIGFLLACVATAIFLFTKCFLFSCQKFNKTRKIEKRE

SEQ ID NO: 15806 - protein, 238 aa, Artificial Sequence
  Description of Artificial Sequence: Synthetic coding sequence
MENFVQSSGEDGIVVFSLGSLFQNVTEEKANIIASALAQIPQKVLWRYKGKKPSTLGANTRLYDWIPQNDLLGHPKTKAFITHGGMNGIYEAIYHGVPMVGVPIFGDQLDNIAHMKAKGAAVEINFKTMTSEDLLRALRTVITDSSYKENAMRLSRIHHDQPVKPLDRAVFWIEFVMRHKGAKHLRSAAHDLTWFQHYSIDVIGFLLACVATAIFLFTKCFLFSCQKFNKTRKIEKRE

SEQ ID NO: 15807 - protein, 528 aa, Artificial Sequence
  Description of Artificial Sequence: Synthetic coding sequence
MALKWTTVLLIQLSFYFSSGSCGKVLVWAAEYSLWMNMKTILKELVQRGHEVTVLASSASILFDPNDSSTLKLEVYPTSLTKTEFENIIMQLVKRLSEIQKDTFWLPFSQEQEILWAINDIIRNFCKDVVSNKKLMKKLQESRFDIVFADAYLPCGELLAELFNIPFVYSHSFSPGYSFERHSGGFIFPPSYVPVVMSKLSDQMTFMERVKNMLYVLYFDFWFQIFNMKKWDQFYSEVLGRPTTLSETMRKADIWLMRNSWNFKFPHPFLPNVDFVGGLHCKPAKPLPKEMEEFVQSSGENGVVVFSLGSMVSNMTEERANVIATALAKIPQKVLWRFDGNKPDALGLNTRLYKWIPQNDLLGHPKTRAFITHGGANGIYEAIYHGIPMVGIPLFFDQPDNIAHMKAKGAAVRVDFNTMSSTDLLNALKTVINDPSYKENIMKLSRIQHDQPVKPLDRAVFWIEFVMRHKGAKHLRVAAHNLTWFQYHSLDVIGFLLACVATVLFIITKCCLFCFWKFARKGKKGKRD

SEQ ID NO: 15808 - protein, 523 aa, Artificial Sequence
  Description of Artificial Sequence: Synthetic coding sequence
MVGQRVLLLVAFLLSGVLLSEAAKILTISTLGGSHYLLLDRVSQILQEHGHNVTMLHQSGKFLIPDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQDLDNFIANFGDAGFVLVAFGSMLNTHQSQEVLKKMHNAFAHLPQGVIWTCQSSHWPRDVHLATNVKIVDWLPQSDLLAHPSIRLFVTHGGQNSVMEAIRHGVPMVGLPVNGDQHGNMVRVVAKNYGVSIRLNQVTADTLTLTMKQVIEDKRYKSAVVAASVILHSQPLSPAQRLVGWIDHILQTGGATHLKPYAFQQPWHEQYLIDVFVFLLGLTLGTMWLCGKLLGVVARWLRGARKVKKT

SEQ ID NO: 15809 - protein, 252 aa, Artificial Sequence
  Description of Artificial Sequence: Synthetic coding sequence
MLHQSGKFLIPDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQNGQPALFTTPSLFSSGVYPEPLRWL

SEQ ID NO: 15810 - protein, 541 aa, Artificial Sequence
  Description of Artificial Sequence: Synthetic coding sequence
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPNDMCGFVIAHLLGVKYAVFSTGLWYPAEVGAPAPLAYVPEFNSLLTDRMNLLQRMKNTGVYLISRLGVSFLVLPKYERIMQKYNLLPEKSMYDLVHGSSLWMLCTDVALEFPRPTLPNVVYVGGILTKPASPLPEDLQRWVNGANEHGFVLVSFGAGVKYLSEDIANKLAGALGRLPQKVIWRFSGPKPKNLGNNTKLIEWLPQNDLLGHSKIKAFLSHGGLNSIFETIYHGVPVVGIPLFGDHYDTMTRVQAKGMGILLEWKTVTEKELYEALVKVINNPSYRQRAQKLSEIHKDQPGHPVNRTIYWIDYIIRHNGAHHLRAAVHQISFCQYFLLDIAFVLLLGAALLYFLLSWVTKFIYRKIKSLWSRNKHSTVNGHYHNGILNGKYKRNGHIKHEKKVK

SEQ ID NO: 15811 - protein, 541 aa, Artificial Sequence; identical to SEQ ID NO: 15810
  Description of Artificial Sequence: Synthetic coding sequence

SEQ ID NO: 15812 - protein, 141 aa, Artificial Sequence
  Description of Artificial Sequence: Synthetic coding sequence
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPND

SEQ ID NO: 15813 - protein, 329 aa, Artificial Sequence
  Description of Artificial Sequence: Synthetic coding sequence
MKLLRRAWRRRAALGLGTLALCGAALLYLARCAAEPGDPRAMSGRSPPPPAPARAAAFLAVLVASAPRAAERRSVIRSTWLARRGAPGDVWARFAVGTAGLGAEERRALEREQARHGDLLLLPALRDAYENLTAKVLAMLAWLDEHVAFEFVLKADDDSFARLDALLAELRAREPARRRRLYWGFFSGRGRVKPGGRWREAAWQLCDYYLPYALGGGYVLSADLVHYLRLSRDYLRAWHSEDVSLGAWLAPVDVQREHDPRFDTEYRSRGCSNQYLVTHKQSLEDMLEKHATLAREGRLCKREVQLRLSYVYDWSAPPSQCCQRREGIP

SEQ ID NO: 15814 - protein, 326 aa, Artificial Sequence
  Description of Artificial Sequence: Synthetic coding sequence
MASKVSCLYVLTVVCWASALWYLSITRPTSSYTGSKPFSHLTVARKNFTFGNIRTRPINPHSFEFLINEPNKCEKNIPFLVILISTTHKEFDARQAIRETWGDENNFKGIKIATLFLLGKNADPVLNQMVEQESQIFHDIIVEDFIDSYHNLTLKTLMGMRWVATFCSKAKYVMKTDSDIFVNMDNLIYKLLKPSTKPRRRYFTGYVINGGPIRDVRSKWYMPRDLYPDSNYPPFCSGTGYIFSADVAELIYKTSLHTRLLHLEDVYVGLCLRKLGIHPFQNSGFNHWKMAYSLCRYRRVITVHQISPEEMHRIWNDMSSKKHLRC

SEQ ID NO: 15815 - protein, 326 aa, Artificial Sequence; identical to SEQ ID NO: 15814
  Description of Artificial Sequence: Synthetic coding sequence

SEQ ID NO: 15816 - protein, 415 aa, Artificial Sequence
  Description of Artificial Sequence: Synthetic coding sequence
MQMSYAIRCAFYQLLLAALMLVAMLQLLYLSLLSGLHGQEEQDQYFEFFPPSPRSVDQVKAQLRTALASGGVLDASGDYRVYRGLLKTTMDPNDVILATHASVDNLLHLSGLLERWEGPLSVSVFAATKEEAQLATVLAYALSSHCPDMRARVAMHLVCPSRYEAAVPDPREPGEFALLRSCQEVFDKLARVAQPGINYALGTNVSYPNNLLRNLAREGANYALVIDVDMVPSEGLWRGLREMLDQSNQWGGTALVVPAFEIRRARRMPMNKNELVQLYQVGEVRPFYYGLCTPCQAPTNYSRWVNLPEESLLRPAYVVPWQDPWEPFYVAGGKVPTFDERFRQYGFNRISQACELHVAGFDFEVLNEGFLVHKGFKEALKFHPQKEAENQHNKILYRQFKQELKAKYPNSPRRC

SEQ ID NO: 15817 - protein, 186 aa, Artificial Sequence
  Description of Artificial Sequence: Synthetic coding sequence
MVPSEGLWRGLREMLDQSNQWGGTALVVPAFEIRRARRMPMNKNELVQLYQVGEVRPFYYGLCTPCQAPTNYSRWVNLPEESLLRPAYVVPWQDPWEPFYVAGGKVPTFDERFRQYGFNRISQACELHVAGFDFEVLNEGFLVHKGFKEALKFHPQKEAENQHNKILYRQFKQELKAKYPNSPRRC

SEQ ID NO: 15818 - protein, 397 aa, Artificial Sequence
  Description of Artificial Sequence: Synthetic coding sequence
MSVGRRRIKLLGILMMANVFIYFIMEVSKSSSQEKNGKGEVIIPKEKFWKISTPPEAYWNREQEKLNRQYNPILSMLTNQTGEAGRLSNISHLNYCEPDLRVTSVVTGFNNLPDRFKDFLLYLRCRNYSLLIDQPDKCAKKPFLLLAIKSLTPHFARRQAIRESWGQESNAGNQTVVRVFLLGQTPPEDNHPDLSDMLKFESEKHQDILMWNYRDTFFNLSLKEVLFLRWVSTSCPDTEFVFKGDDDVFVNTHHILNYLNSLSKTKAKDLFIGDVIHNAGPHRDKKLKYYIPEVVYSGLYPPYAGGGGFLYSGHLALRLYHITDQVHLYPIDDVYTGMCLQKLGLVPEKHKGFRTFDIEEKNKNNICSYVDLMLVHSRKPQEMIDIWSQLQSAHLKC

SEQ ID NO: 15819 - protein, 397 aa, Artificial Sequence; identical to SEQ ID NO: 15818
  Description of Artificial Sequence: Synthetic coding sequence

SEQ ID NO: 15820 - protein, 378 aa, Artificial Sequence
  Description of Artificial Sequence: Synthetic coding sequence
MRMLVSGRRVKKWQLIIQLFATCFLASLMFFWEPIDNHIVSHMKSYSYRYLINSYDFVNDTLSLKHTSAGPRYQYLINHKEKCQAQDVLLLLFVKTAPENYDRRSGIRRTWGNENYVRSQLNANIKTLFALGTPNPLEGEELQRKLAWEDQRYNDIIQQDFVDSFYNLTLKLLMQFSWANTYCPHAKFLMTADDDIFIHMPNLIEYLQSLEQIGVQDFWIGRVHRGAPPIRDKSSKYYVSYEMYQWPAYPDYTAGAAYVISGDVAAKVYEASQTLNSSLYIDDVFMGLCANKIGIVPQDHVFFSGEGKTPYHPCIYEKMMTSHGHLEDLQDLWKNATDPKVKTISKGFFGQIYCRLMKIILLCKISYVDTYPCRAAFI

SEQ ID NO: 15821 - protein, 378 aa, Artificial Sequence; identical to SEQ ID NO: 15820
  Description of Artificial Sequence: Synthetic coding sequence

SEQ ID NO: 15822 - protein, 62 aa, Artificial Sequence
  Description of Artificial Sequence: Synthetic coding sequence
MRMLVSGRRVKKWQLIIQLFATCFLASLMFFWEPIDNHIVSHMKSYSYRYLINSYDFVNDTL

SEQ ID NO: 15823 - protein, 81 aa, Artificial Sequence
  Description of Artificial Sequence: Synthetic coding sequence
MRMLVSGRRVKKWQLIIQLFATCFLASLMFFWEPIDNHIVSHMKSYSYRYLINSYDFVNDTLSLKHTSAGPRYQYLINHKE

SEQ ID NO: 15824 - protein, 378 aa, Artificial Sequence; identical to SEQ ID NO: 15820
  Description of Artificial Sequence: Synthetic coding sequence

SEQ ID NO: 15825 - protein, 50 aa, Artificial Sequence
  Description of Artificial Sequence: Synthetic coding sequence
MRMLVSGRRVKKWQLIIQLFATCFLASLMFFWEPIDNHIVSHMKSYSYRY

SEQ ID NO: 15826 - protein, 401 aa, Artificial Sequence
  Description of Artificial Sequence: Synthetic coding sequence
MSLWKKTVYRSLCLALALLVAVTVFQRSLTPGQFLQEPPPPTLEPQKAQKPNGQLVNPNNFWKNPKDVAAPTPMASQGPQAWDVTTTNCSANINLTHQPWFQVLEPQFRQFLFYRHCRYFPMLLNHPEKCRGDVYLLVVVKSVITQHDRREAIRQTWGRERQSAGGGRGAVRTLFLLGTASKQEERTHYQQLLAYEDRLYGDILQWGFLDTFFNLTLKEIHFLKWLDIYCPHVPFIFKGDDDVFVNPTNLLEFLADRQPQENLFVGDVLQHARPIRRKDNKYYIPGALYGKASYPPYAGGGGFLMAGSLARRLHHACDTLELYPIDDVFLGMCLEVLGVQPTAHEGFKTFGISRNRNSRMNKEPCFFRAMLVVHKLLPPELLAMWGLVHSNLTCSRKLQVL

SEQ ID NO: 15827 - protein, 397 aa, Artificial Sequence
  Description of Artificial Sequence: Synthetic coding sequence
MRCPKCLLCLSALLTLLGLKVYIEWTSESRLSKAYPSPRGTPPSPTPANPEPTLPANLSTRLGQTIPLPFAYWNQQQWRLGSLPSGDSTETGGCQAWGAAAATEIPDFASYPKDLRRFLLSAACRSFPQWLPGGGGSQVSSCSDTDVPYLLLAVKSEPGRFAERQAVRETWGSPAPGIRLLFLLGSPVGEAGPDLDSLVAWESRRYSDLLLWDFLDVPFNQTLKDLLLLAWLGRHCPTVSFVLRAQDDAFVHTPALLAHLRALPPASARSLYLGEVFTQAMPLRKPGGPFYVPESFFEGGYPAYASGGGYVIAGRLAPWLLRAAARVAPFPFEDVYTGLCIRALGLVPQAHPGFLTAWPADRTADHCAFRNLLLVRPLGPQASIRLWKQLQDPRLQC

SEQ ID NO: 15828 - protein, 402 aa, Artificial Sequence
  Description of Artificial Sequence: Synthetic coding sequence
MRRRLRLRRDALLTLLLGASLGLLLYAQRDGAAPTASAPRGRGRAAPRPTPGPRAFQLPDAGAAPPAYEGDTPAPPTPTGPFDFARYLRAKDQRRFPLLINQPHKCRGDGAPGGRPDLLIAVKSVAEDFERRQAVRQTWGAEGRVQGALVRRVFLLGVPRGAGSGGADEVGEGARTHWRALLRAESLAYADILLWAFDDTFFNLTLKEIHFLAWASAFCPDVRFVFKGDADVFVNVGNLLEFLAPRDPAQDLLAGDVIVHARPIRTRASKYYIPEAVYGLPAYPAYAGGGGFVLSGATLHRLAGACAQVELFPIDDVFLGMCLQRLRLTPEPHPAFRTFGIPQPSAAPHLSTFDPCFYRELVVVHGLSAADIWLMWRLLHGPHGPACAHPQPVAAGPFQWDS

SEQ ID NO: 15829 - protein, 527 aa, Artificial Sequence; identical to SEQ ID NO: 15805
  Description of Artificial Sequence: Synthetic coding sequence

SEQ ID NO: 15830 - protein, 238 aa, Artificial Sequence; identical to SEQ ID NO: 15806
  Description of Artificial Sequence: Synthetic coding sequence

SEQ ID NO: 15831 - protein, 528 aa, Artificial Sequence; identical to SEQ ID NO: 15807
  Description of Artificial Sequence: Synthetic coding sequence

SEQ ID NO: 15832 - protein, 608 aa, Artificial Sequence
  Description of Artificial Sequence: Synthetic coding sequence
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELGMIFNERDQELRDLGYQKHAFNMLISDRLGYHRDVPDTRNAACKEKFYPPDLPAASVVICFYNEAFSALLRTVHSVIDRTPAHLLHEIILVDDDSDFDDLKGELDEYVQKYLPGKIKVIRNTKREGLIRGRMIGAAHATGEVLVFLDSHCEVNVMWLQPLLAAIREDRHTVVCPVIDIISADTLAYSSSPVVRGGFNWGLHFKWDLVPLSELGRAEGATAPIKSPTMAGGLFAMNRQYFHELGQYDSGMDIWGGENLEISFRIWMCGGKLFIIPCSRVGHIFRKRRPYGSPEGQDTMTHNSLRLAHVWLDEYKEQYFSLRPDLKTKSYGNISERVELRKKLGCKSFKWYLDNVYPEMQISGSHAKPQQPIFVNRGPKRPKVLQRGRLYHLQTNKCLVAQGRPSQKGGLVVLKACDYSDPNQIWIYNEEHELVLNSLLCLDMSETRSSDPPRLMKCHGSGGSQQWTFGKNNRLYQVSVGQCLRAVDPLGQKGSVAMAICDGSSSQQWHLEG

SEQ ID NO: 15833 - protein, 202 aa, Artificial Sequence
  Description of Artificial Sequence: Synthetic coding sequence
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELGMIFNERDQELRDLGYQKHAFNMLISDRLGYHRDVPDTRNAACKEKFYPPDLPAASVVICFYNEAFSALLRTVHSVIDRTPAHLLHEIILVDDDSDFGKECCTW

SEQ ID NO: 15834 - protein, 186 aa, Artificial Sequence
  Description of Artificial Sequence: Synthetic coding sequence
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELGMIFNERDQELRDLGYQKHAFNMLISDRLGYHRDVPDTRNAACKEKFYPPDLPAASVVICFYNEAFSALLRTVHSVIDRTPAHLLHEI

SEQ ID NO: 15835 - protein, 133 aa, Artificial Sequence
  Description of Artificial Sequence: Synthetic coding sequence
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELDVKKSSTHLTCQLLVLLSVSIMKRFLPCFGQCTVS

SEQ ID NO: 15836 - protein, 608 aa, Artificial Sequence; identical to SEQ ID NO: 15832
  Description of Artificial Sequence: Synthetic coding sequence

SEQ ID NO: 15837 - protein, 98 aa, Artificial Sequence
  Description of Artificial Sequence: Synthetic coding sequence
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSEL

SEQ ID NO: 15838 - protein, 608 aa, Artificial Sequence; identical to SEQ ID NO: 15832
  Description of Artificial Sequence: Synthetic coding sequence

SEQ ID NO: 15839 - protein, 608 aa, Artificial Sequence; identical to SEQ ID NO: 15832
  Description of Artificial Sequence: Synthetic coding sequence

SEQ ID NO: 15840 - protein, 160 aa, Artificial Sequence
  Description of Artificial Sequence: Synthetic coding sequence
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELGMIFNERDQELRDLGYQKHAFNMLISDRLGYHRDVPDTRNAACKEKFYPPDLPAASVVICFY

SEQ ID NO: 15841 - protein, 527 aa, Artificial Sequence
  Description of Artificial Sequence: Synthetic coding sequence
MPQPESQKAAILGCGQGGMIFNERDQELRDLGYQKHAFNMLISDRLGYHRDVPDTRNAACKEKFYPPDLPAASVVICFYNEAFSALLRTVHSVIDRTPAHLLHEIILVDDDSDFDDLKGELDEYVQKYLPGKIKVIRNTKREGLIRGRMIGAAHATGEVLVFLDSHCEVNVMWLQPLLAAIREDRHTVVCPVIDIISADTLAYSSSPVVRGGFNWGLHFKWDLVPLSELGRAEGATAPIKSPTMAGGLFAMNRQYFHELGQYDSGMDIWGGENLEISFRIWMCGGKLFIIPCSRVGHIFRKRRPYGSPEGQDTMTHNSLRLAHVWLDEYKEQYFSLRPDLKTKSYGNISERVELRKKLGCKSFKWYLDNVYPEMQISGSHAKPQQPIFVNRGPKRPKVLQRGRLYHLQTNKCLVAQGRPSQKGGLVVLKACDYSDPNQIWIYNEEHELVLNSLLCLDMSETRSSDPPRLMKCHGSGGSQQWTFGKNNRLYQVSVGQCLRAVDPLGQKGSVAMAICDGSSSQQWHLEG

SEQ ID NO: 15842 - protein, 940 aa, Artificial Sequence
  Description of Artificial Sequence: Synthetic coding sequence
MNRIRKFFRGSGRVLAFIFVASVIWLLFDMAALRLSFSEINTRVIKEDIVRRERIGFRVQPDQGKIFYSSIKEMKPPLRGHGKGAWGKENVRKTEESVLKVEVDLDQTQRERKMQNALGRGKVVPLWHPAHLQTLPVTPNKQKTDGRGTKPEASSHQGTPKQTTAQGAPKTSFIAAKGTQVVKISVHMGRVSLKQEPRKSHSPSSDTSKLAAERDLNVTISLSTDRPKQRSQAVANERAHPASTAVPKSGEAMALNKTKTQSKEVNANKHKANTSLPFPKFTVNSNRLRKQSINETPLGSLSKDDGARGAHGKKLNFSESHLVIITKEEEQKADPKEVSNSKTKTIFPKVLGKSQSKHISRNRSEMSSSSLAPHRVPLSQTNHALTGGLEPAKINITAKAPSTEYNQSHIKALLPEDSGTHQVLRIDVTLSPRDPKAPGQFGRPVVVPHGKEKEAERRWKEGNFNVYLSDLIPVDRAIEDTRPAGCAEQLVHNNLPTTSVIMCFVDEVWSTLLRSVHSVINRSPPHLIKEILLVDDFSTKDYLKDNLDKYMSQFPKVRILRLKERHGLIRARLAGAQNATGDVLTFLDSHVECNVGWLEPLLERVYLSRKKVACPVIEVINDKDMSYMTVDNFQRGIFVWPMNFGWRTIPPDVIAKNRIKETDTIRCPVMAGGLFSIDKSYFFELGTYDPGLDVWGGENMELSFKVWMCGGEIEIIPCSRVGHIFRNDNPYSFPKDRMKTVERNLVRVAEVWLDEYKELFYGHGDHLIDQGLDVGNLTQQRELRKKLKCKSFKWYLENVFPDLRAPIVRASGVLINVALGKCISIENTTVILEDCDGSKELQQFNYTWLRLIKCGEWCIAPIPDKGAVRLHPCDNRNKGLKWLHKSTSVFHPELVNHIVFENNQQLLCLEGNFSQKILKVAACDPVKPYQKWKFEKYYEA

SEQ ID NO: 15843 - protein, 558 aa, Artificial Sequence
  Description of Artificial Sequence: Synthetic coding sequence
MRKIRANAIAILTVAWILGTFYYLWQDNRAHAASSGGRGAQRAGRRSEQLREDRTIPLIVTGTPSKGFDEKAYLSAKQLKAGEDPYRQHAFNQLESDKLSPDRPIRDTRHYSCPSVSYSSDLPATSVIITFHNEARSTLLRTVKSVLNRTPANLIQEIILVDDFSSDPEDCLLLTRIPKVKCLRNDRREGLIRSRVRGADVAAATVLTFLDSHCEVNTEWLPPMLQRVKEDHTRVVSPIIDVISLDNFAYLAASADLRGGFDWSLHFKWEQIPLEQKMTRTDPTRPIRTPVIAGGIFVIDKSWFNHLGKYDAQMDIWGGENFELSFRVWMCGGSLEIVPCSRVGHVFRKRHPYNFPEGNALTYIRNTKRTAEVWMDEYKQYYYEARPSAIGKAFGSVATRIEQRKKMNCKSFRWYLENVYPELTVPVKEALPGIIKQGVNCLESQGQNTAGDFLLGMGICRGSAKNPQPAQAWLFSDHLIQQQGKCLAATSTLMSSPGSPVILQMCNPREGKQKWRRKGSFIQHSVSGLCLETKPAQLVTSKCQADAQAQQWQLLPHT

SEQ ID NO: 15844 - protein, 558 aa, Artificial Sequence; identical to SEQ ID NO: 15843
  Description of Artificial Sequence: Synthetic coding sequence

SEQ ID NO: 15845 - protein, 184 aa, Artificial Sequence
  Description of Artificial Sequence: Synthetic coding sequence
MDEYKQYYYEARPSAIGKAFGSVATRIEQRKKMNCKSFRWYLENVYPELTVPVKEALPGIIKQGVNCLESQGQNTAGDFLLGMGICRGSAKNPQPAQAWLFSDHLIQQQGKCLAATSTLMSSPGSPVILQMCNPREGKQKWRRKGSFIQHSVSGLCLETKPAQLVTSKCQADAQAQQWQLLPHT

SEQ ID NO: 15846 - protein, 542 aa, Artificial Sequence
  Description of Artificial Sequence: Synthetic coding sequence
MRKIRANAIAILTVAWILGTFYYLWQDNRAHAASSGGRGAQRAGRRSEQLREDRTIPLIVTGTPSKGFDEKAYLSAKQLKAGEDPYRQHAFNQLESDKLSPDRPIRDTRHYSCPSVSYSSDLPATSVIITFHNEARSTLLRTVKSVLNRTPANLIQEIILVDDFSSDPEDCLLLTRIPKVKCLRNDRREGLIRSRVRGADVAAATVLTFLDSHCEVNTEWLPPMLQRVKEDHTRVVSPIIDVISLDNFAYLAASADLRGGFDWSLHFKWEQIPLEQKMTRTDPTRPIRTPVIAGGIFVIDKSWFNHLGKYDAQMDIWGGENFELSFRVWMCGGSLEIVPCSRVGHVFRKRHPYNFPEGNALTYIRNTKRTAEVWMDEYKQYYYEARPSAIGKAFGSVATRIEQRKKMNCKSFRWYLENVYPELTVPVKEALPGIIKQGVNCLESQGQNTAGDFLLGMGICRGSAKNPQPAQAWLFSDHLIQQQGKCLAATSTLMSSPGSPVILQMCNPREGKQVSLLASGPEAQQPEGPCLRVADLGRRAPD

SEQ ID NO: 15847 - protein, 639 aa, Artificial Sequence
  Description of Artificial Sequence: Synthetic coding sequence
MLLRKRYRHRPCRLQFLLLLLMLGCVLMMVAMLHPPHHTLHQTVTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDGKARQQWRFDQINAVDER

SEQ ID NO: 15848 - protein, 196 aa, Artificial Sequence
  Description of Artificial Sequence: Synthetic coding sequence
MERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDEKPASSGVLTRSMLWMNDECQCQKEKRILAIKIQLQVNLKSLYIS

SEQ ID NO: 15849 - protein, 607 aa, Artificial Sequence
  Description of Artificial Sequence: Synthetic coding sequence
MVCTRKTKTLVSTCVILSGMTNIICLLYVGWVTNYIASVYVRGQEPAPDKKLEEDKGDTLKIIERLDHLENVIKQHIQEAPAKPEEAEAEPFTDSSLFAHWGQELSPEGRRVALKQFQYYGYNAYLSDRLPLDRPLPDLRPSGCRNLSFPDSLPEVSIVFIFVNEALSVLLRSIHSAMERTPPHLLKEIILVDDNSSNEELKEKLTEYVDKVNSQKPGFIKVVRHSKQEGLIRSRVSGWRAATAPVVALFDAHVEFNVGWAEPVLTRIKENRKRIISPSFDNIKYDNFEIEEYPLAAQGFDWELWCRYLNPPKAWWKLENSTAPIRSPALIGCFIVDRQYFQEIGLLDEGMEVYGGENVELGIRVWQCGGSVEVLPCSRIAHIERAHKPYTEDLTAHVRRNALRVAEVWMDEFKSHVYMAWNIPQEDSGIDIGDITARKALRKQLQCKTFRWYLVSVYPEMRMYSDIIAYGVLQNSLKTDLCLDQGPDTENVPIMYICHGMTPQNVYYTSSQQIHVGILSPTVDDDDNRCLVDVNSRPRLIECSYAKAKRMKLHWQFSQGGPIQNRKSKRCLELQENSDLEFGFQLVLQKCSGQHWSITNVLRSLAS

SEQ ID NO: 15850 - protein, 443 aa, Artificial Sequence
  Description of Artificial Sequence: Synthetic coding sequence
MRNAIIQGLFYGSLTFGIWTALLFIYLHHNHVSSWQKKSQEPLSAWSPGKKVHQQIIYGSEQIPKPHVIVKRTDEDKAKSMLGTDFNHTNPELHKELLKYGFNVIISRSLGIEREVPDTRSKMCLQKHYPARLPTASIVICFYNEECNALFQTMSSVTNLTPHYFLEEIILVDDMSKVDDLKEKLDYHLETFRGKVKIIRNKKREGLIRARLIGASHASGDVLVFLDSHCEVNRVWLEPLLHAIAKDPKMVVCPLIDVIDDRTLEYKPSPLVRGTFDWNLQFKWDNVFSYEMDGPEGSTKPIRSPAMSGGIFAIRRHYFNEIGQYDKDMDFWGRENLELSLRIWMCGGQLFIIPCSRVGHISKKQTGKPSTIISAMTHNYLRLVHVWLDEYKEQFFLRKPGLKYVTYGNIRERVELRKRLGCKSFQWYLDNVFPELEASVNSL

SEQ ID NO: 15851 - protein, 443 aa, Artificial Sequence; identical to SEQ ID NO: 15850
  Description of Artificial Sequence: Synthetic coding sequence

SEQ ID NO: 15852 - protein, 226 aa, Artificial Sequence
  Description of Artificial Sequence: Synthetic coding sequence
MKRKQKRFLQMTLLFTVALIFLPNVGLWSLYKDKHLVKSAEPGEQQTFPLGLGDGQFYSWTDGLRRKDWHDYESIQKEAMRSGKGEHGKPYPLTEEDHDDSAYRENGFNIFVSNNIALERSLPDIRHANCKHKMYLERLPNTSIIIPFHNEGWTSLLRTIHSIINRTPGSLIAEIILVDDFSEREHLKDKLEEYMARFSKVRIVRTKKREGSGPVSWGHLWPEEKS

SEQ ID NO: 15853 - protein, 601 aa, Artificial Sequence
  Description of Artificial Sequence: Synthetic coding sequence
MKRKQKRFLQMTLLFTVALIFLPNVGLWSLYKDKHLVKSAEPGEQQTFPLGLGDGQFYSWTDGLRRKDWHDYESIQKEAMRSGKGEHGKPYPLTEEDHDDSAYRENGFNIFVSNNIALERSLPDIRHANCKHKMYLERLPNTSIIIPFHNEGWTSLLRTIHSIINRTPGSLIAEIILVDDFSEREHLKDKLEEYMARFSKVRIVRTKKREGLIRTRLLGASMARGEVLTFLDSHCEVNVNWLPPLLNQIALNHKTIVCPMIDVIDHNHFGYEAQAGDAMRGAFDWEMYYKRIPIPPELQRADPSDPFESPVMAGGLFAVDRKWFWELGGYDPGLEIWGGEQYEISFKVWMCGGEMFDVPCSRVGHIYRKYVPYKVPSGTSLARNLKRVAETWMDEFAEYIYQRRPEYRHLSTGDISAQKELRKQLKCKDFKWFMAAVAWDVPKYYPPVEPPPAAWGEIRNVAANLCVDSKHGATGTELRLDICVKDGSERTWSHEQLFTFGWREDIRPGEPLHTRKFCFDAISHNSPVTLYDCHGMKGNQLWGYRKDRTLFHPVSNSCMDCNPAEKKIFMARCDPLSETQQWIFEHINMTVLEKFNHHANS

SEQ ID NO: 15854 - protein, 522 aa, Artificial Sequence
  Description of Artificial Sequence: Synthetic coding sequence
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRSATNGKSETITADVNHNLKDANDVPIQCEISPLISYAGEGLESYVADKEFHAPLIIDENGVHELVKNGI

SEQ ID NO: 15855 - protein, 521 aa, Artificial Sequence
  Description of Artificial Sequence: Synthetic coding sequence
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRATNGKSETITADVNHNLKDANDVPIQCEISPLISYAGEGLESYVADKEFHAPLIIDENGVHELVKNGI

SEQ ID NO: 15856 - protein, 522 aa, Artificial Sequence; identical to SEQ ID NO: 15854
  Description of Artificial Sequence: Synthetic coding sequence

SEQ ID NO: 15857 - protein, 505 aa, Artificial Sequence
  Description of Artificial Sequence: Synthetic coding sequence
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRLKDANDVPIQCEISPLISYAGEGLESYVADKEFHAPLIIDENGVHELVKNGI

SEQ ID NO: 15858 - protein, 220 aa, Artificial Sequence
  Description of Artificial Sequence: Synthetic coding sequence
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAP

SEQ ID NO: 15859 - protein, 1591 aa, Artificial Sequence
  Description of Artificial Sequence: Synthetic coding sequence
MSLLCVRVKRAKFQGSPDKFNTYVTLKVQNVKSTTVAVRGDQPSWEQDFMFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCSFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEIPDDGDPSLPQWLPEGPAGGLYGIDSMPDLRRKKPLPLVSDLSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 15860 - protein, 1610 aa, Artificial Sequence
  Description of Artificial Sequence: Synthetic coding sequence
MSLLCVRVKRAKFQGSPDKFNTYVTLKVQNVKSTTVAVRGDQPSWEQDFMFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCSFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEIPDDGDPSLPQWLPEGPAGGLYGIDSMPDLRRKKPLPLVSDLSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQVHDGKGIRFTANEDIRPEKGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 15861 - protein, 1622 aa, Artificial Sequence
  Description of Artificial Sequence: Synthetic coding sequence
MSLLCVRVKRAKFQGSPDKFNTYVTLKVQNVKSTTVAVRGDQPSWEQDFMFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCCHWTYLGWGEQQTFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEIPDDGDPSLPQWLPEGPAGGLYGIDSMPDLRRKKPLPLVSDLSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQVHDGKGIRFTANEDIRPEKGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 15862 - protein, 1197 aa, Artificial Sequence [sequence omitted]

SEQ ID NO: 15863 - protein, 2214 aa, Artificial Sequence
  Description of Artificial Sequence: Synthetic coding sequence
MVANFFKSLILPYIHKLCKGMFTKKLGNTNKNKEYRQQKKDQDFPTAGQTKSPKFSYTFKSTVKKIAKCSSTHNLSTEEDEASKEFSLSPTFSYRVAIANGLQKNAKVTNSDNEDLLQELSSIESSYSESLNELRSSTENQAQSTHTMPVRRNRKSSSSLAPSEGSSDGERTLHGLKLGALRKLRKWKKSQECVSSDSELSTMKKSWGIRSKSLDRTVRNPKTNALEPGFSSSGCISQTHDVMEMIFKELQGISQIETELSELRGHVNALKHSIDEISSSVEVVQSEIEQLRTGFVQSRRETRDIHDYIKHLGHMGSKASLRFLNVTEERFEYVESVVYQILIDKMGFSDAPNAIKIEFAQRIGHQRDCPNAKPRPILVYFETPQQRDSVLKKSYKLKGTGIGISTDILTHDIRERKEKGIPSSQTYESMAIKLSTPEPKIKKNNWQSPDDSDEDLESDLNRNSYAVLSKSELLTKGSTSKPSSKSHSARSKNKTANSSRISNKSDYDKISSQLPESDILEKQTTTHYADATPLWHSQSDFFTAKLSRSESDFSKLCQSYSEDFSENQFFTRTNGSSLLSSSDRELWQRKQEGTATLYDSPKDQHLNGGVQGIQGQTETENTETVDSGMSNGMVCASGDRSHYSDSQLSLHEDLSPWKEWNQGADLGLDSSTQEGFDYETNSLFDQQLDVYNKDLEYLGKCHSDLQDDSESYDLTQDDNSSPCPGLDNEPQGQWVGQYDSYQGANSNELYQNQNQLSMMYRSQSELQSDDSEDAPPKSWHSRLSIDLSDKTFSFPKFGSTLQRAKSALEVVWNKSTQSLSGYEDSGSSLMGRFRTLSQSTANESSTTLDSDVYTEPYYYKAEDEEDYTEPVADNETDYVEVMEQVLAKLENRTSITETDEQMQAYDHLSYETPYETPQDEGYDGPADDMVSEEGLEPLNETSAEMEIREDENQNIPEQPVEITKPKRIRPSFKEAALRAYKKQMAELEEKILAGDSSSVDEKARIVSGNDLDASKFSALQVCGGAGGGLYGIDSMPDLRRKKTLPIVRDVAMTLAARKSGLSLAMVIRTSLNNEELKMHVFKKTLQALIYPMSSTIPHNFEVWTATTPTYCYECEGLLWGIARQGMKCLECGVKCHEKCQDLLNADCLQRAAEKSSKHGAEDKTQTIITAMKERMKIREKNRPEVFEVIQEMFQISKEDFVQFTKAAKQSVLDGTSKWSAKITITVVSAQGLQAKDKTGSSDPYVTVQVGKNKRRTKTIFGNLNPVWDEKFYFECHNSTDRIKVRVWDEDDDIKSRVKQHFKKESDDFLGQTIVEVRTLSGEMDVWYNLEKRTDKSAVSGAIRLKINVEIKGEEKVAPYHIQYTCLHENLFHYLTEVKSNGGVKIPEVKGDEAWKVFFDDASQEIVDEFAMRYGIESIYQAMTHFSCLSSKYMCPGVPAVMSTLLANINAFYAHTTVSTNIQVSASDRFAATNFGREKFIKLLDQLHNSLRIDLSKYRENFPASNTERLQDLKSTVDLLTSITFFRMKVLELQSPPKASMVVKDCVRACLDSTYKYIFDNCHELYSQLTDPSKKQDIPREDQGPTTKNLDFWPQLITLMVTIIDEDKTAYTPVLNQFPQELNMGKISAEIMWTLFALDMKYALEEHENQRLCKSTDYMNLHFKVKWFYNEYVRELPAFKDAVPEYSLWFEPFVMQWLDENEDVSMEFLHGALGRDKKDGFQQTSEHALFSCSVVDVFAQLNQSFEIIKKLECPNPEALSHLMRRFAKTINKVLLQYAAIVSSDFSSHCDKENVPCILMNNIQQLRVQLEKMFESMGGKELDSEASTILKELQVKLSGVLDELSVTYGESFQVIIEECIKQMSFELNQMRANGNTTSNKNSAAMDAEIVLRSLMDFLDKTLSLSAKICEKTVLKRVLKELWKLVLNKIEKQIVLPPLTDQTGPQMIFIAAKDLGQLSKLKEHMIREDARGLTPRQCAIMEVVLATIKQYFHAGGNGLKKNFLEKSPDLQSLRYALSLYTQTTDALIKKFIDTQTSQSRSSKDAVGQISVHVDITATPGTGDHKVTVKVIAINDLNWQTTAMFRPFVEVCILGPNLGDKKRKQGTKTKSNTWSPKYNETFQFILGKENRPGAYELHLSVKDYCFAREDRIIGMTVIQLQNIAEKGSYGAWYPLLKNISMDETGLTILRILSQRTSDDVAKEFVRLKSETRSTEESA

SEQ ID NO: 15864 - protein, 2212 aa, Artificial Sequence
  Description of Artificial Sequence: Synthetic coding sequence
MVANFFKSLILPYIHKLCKGMFTKKLGNTNKNKEYRQQKKDQDFPTAGQTKSPKFSYTFKSTVKKIAKCSSTHNLSTEEDEASKEFSLSPTFSYRVAIANGLQKNAKVTNSDNEDLLQELSSIESSYSESLNELRSSTENQAQSTHTMPVRRNRKSSSSLAPSEGSSDGERTLHGLKLGALRKLRKWKKSQECVSSDSELSTMKKSWGIRSKSLDRTVRNPKTNALEPGFSSSGCISQTHDVMEMIFKELQGISQIETELSELRGHVNALKHSIDEISSSVEVVQSEIEQLRTGFVQSRRETRDIHDYIKHLGHMGSKASLRFLNVTEERFEYVESVVYQILIDKMGFSDAPNAIKIEFAQRIGHQRDCPNAKPRPILVYFETPQQRDSVLKKSYKLKGTGIGISTDILTHDIRERKEKGIPSSQTYESMAIKLSTPEPKIKKNNWQSPDDSDEDLESDLNRNSYAVLSKSELLTKGSTSKPSSKSHSARSKNKTANSSRISNKSDYDKISSQLPESDILEKQTTTHYADATPLWHSQSDFFTAKLSRSESDFSKLCQSYSEDFSENQFFTRTNGSSLLSSSDRELWQRKQEGTATLYDSPKDQHLNGGVQGIQGQTETENTETVDSGMSNGMVCASGDRSHYSDSQLSLHEDLSPWKEWNQGADLGLDSSTQEGFDYETNSLFDQQLDVYNKDLEYLGKCHSDLQDDSESYDLTQDDNSSPCPGLDNEPQGQWVGQYDSYQGANSNELYQNQNQLSMMYRSQSELQSDDSEDAPPKSWHSRLSIDLSDKTFSFPKFGSTLQRAKSALEVVWNKSTQSLSGYEDSGSSLMGRFRTLSQSTANESSTTLDSDVYTEPYYYKAEDEEDYTEPVADNETDYVEVMEQVLAKLENRTSITETDEQMQAYDHLSYETPYETPQDEGYDGPADDMVSEEGLEPLNETSAEMEIREDENQNIPEQPVEITKPKRIRPSFKEAALRAYKKQMAELEEKILAGDSSSVDEKARIVSGNDLDASKFSALQVCGGAGGGLYGIDSMPDLRRKKTLPIVRDVTLAARKSGLSLAMVIRTSLNNEELKMHVFKKTLQALIYPMSSTIPHNFEVWTATTPTYCYECEGLLWGIARQGMKCLECGVKCHEKCQDLLNADCLQRAAEKSSKHGAEDKTQTIITAMKERMKIREKNRPEVFEVIQEMFQISKEDFVQFTKAAKQSVLDGTSKWSAKITITVVSAQGLQAKDKTGSSDPYVTVQVGKNKRRTKTIFGNLNPVWDEKFYFECHNSTDRIKVRVWDEDDDIKSRVKQHFKKESDDFLGQTIVEVRTLSGEMDVWYNLEKRTDKSAVSGAIRLKINVEIKGEEKVAPYHIQYTCLHENLFHYLTEVKSNGGVKIPEVKGDEAWKVFFDDASQEIVDEFAMRYGIESIYQAMTHFSCLSSKYMCPGVPAVMSTLLANINAFYAHTTVSTNIQVSASDRFAATNFGREKFIKLLDQLHNSLRIDLSKYRENFPASNTERLQDLKSTVDLLTSITFFRMKVLELQSPPKASMVVKDCVRACLDSTYKYIFDNCHELYSQLTDPSKKQDIPREDQGPTTKNLDFWPQLITLMVTIIDEDKTAYTPVLNQFPQELNMGKISAEIMWTLFALDMKYALEEHENQRLCKSTDYMNLHFKVKWFYNEYVRELPAFKDAVPEYSLWFEPFVMQWLDENEDVSMEFLHGALGRDKKDGFQQTSEHALFSCSVVDVFAQLNQSFEIIKKLECPNPEALSHLMRRFAKTINKVLLQYAAIVSSDFSSHCDKENVPCILMNNIQQLRVQLEKMFESMGGKELDSEASTILKELQVKLSGVLDELSVTYGESFQVIIEECIKQMSFELNQMRANGNTTSNKNSAAMDAEIVLRSLMDFLDKTLSLSAKICEKTVLKRVLKELWKLVLNKIEKQIVLPPLTDQTGPQMIFIAAKDLGQLSKLKEHMIREDARGLTPRQCAIMEVVLATIKQYFHAGGNGLKKNFLEKSPDLQSLRYALSLYTQTTDALIKKFIDTQTSQSRSSKDAVGQISVHVDITATPGTGDHKVTVKVIAINDLNWQTTAMFRPFVEVCILGPNLGDKKRKQGTKTKSNTWSPKYNETFQFILGKENRPGAYELHLSVKDYCFAREDRIIGMTVIQLQNIAEKGSYGAWYPLLKNISMDETGLTILRILSQRTSDDVAKEFVRLKSETRSTEESA

SEQ ID NO: 15865 - protein, 2214 aa, Artificial Sequence
  Description of Artificial Sequence: Synthetic coding sequence
MVANFFKSLILPYIHKLCKGMFTKKLGNTNKNKEYRQQKKDQDFPTAGQTKSPKFSYTFKSTVKKIAKCSSTHNLSTEEDEASKEFSLSPTFSYRVAIANGLQKNAKVTNSDNEDLLQELSSIESSYSESLNELRSSTENQAQSTHTMPVRRNRKSSSSLAPSEGSSDGERTLHGLKLGALRKLRKWKKSQECVSSDSELSTMKKSWGIRSKSLDRTVRNPKTNALEPGFSSSGCISQTHDVMEMIFKELQGISQIETELSELRGHVNALKHSIDEISSSVEVVQSEIEQLRTGFVQSRRETRDIHDYIKHLGHMGSKASLRFLNVTEERFEYVESVVYQILIDKMGFSDAPNAIKIEFAQRIGHQRDCPNAKPRPILVYFETPQQRDSVLKKSYKLKGTGIGISTDILTHDIRERKEKGIPSSQTYESMAIKLSTPEPKIKKNNWQSPDDSDEDLESDLNRNSYAVLSKSELLTKGSTSKPSSKSHSARSKNKTANSSRISNKSDYDKISSQLPESDILEKQTTTHYADATPLWHSQSDFFTAKLSRSESDFSKLCQSYSEDFSENQFFTRTNGSSLLSSSDRELWQRKQEGTATLYDSPKDQHLNGGVQGIQGQTETENTETVDSGMSNGMVCASGDRSHYSDSQLSLHEDLSPWKEWNQGADLGLDSSTQEGFDYETNSLFDQQLDVYNKDLEYLGKCHSDLQDDSESYDLTQDDNSSPCPGLDNEPQGQWVGQYDSYQGANSNELYQNQNQLSMMYRSQSELQSDDSEDAPPKSWHSRLSIDLSDKTFSFPKFGSTLQRAKSALEVVWNKSTQSLSGYEDSGSSLMGRFRTLSQSTANESSTTLDSDVYTEPYYYKAEDEEDYTEPVADNETDYVEVMEQVLAKLENRTSITETDEQMQAYDHLSYETPYETPQDEGYDGPADDMVSEEGLEPLNETSAEMEIREDENQNIPEQPVEITKPKRIRPSFKEAALRAYKKQMAELEEKILAGVSLDVDLEARIVSGNDLDASKFSALQVCGGAGGGLYGIDSMPDLRRKKTLPIVRDVLLTLAARKSGLSLAMVIRTSLNNEELKMHVFKKTLQALIYPMSSTIPHNFEVWTATTPTYCYECEGLLWGIARQGMKCLECGVKCHEKCQDLLNADCLQRAAEKSSKHGAEDKTQTIITAMKERMKIREKNRPEVFEVIQEMFQISKEDFVQFTKAAKQSVLDGTSKWSAKITITVVSAQGLQAKDKTGSSDPYVTVQVGKNKRRTKTIFGNLNPVWDEKFYFECHNSTDRIKVRVWDEDDDIKSRVKQHFKKESDDFLGQTIVEVRTLSGEMDVWYNLEKRTDKSAVSGAIRLKINVEIKGEEKVAPYHIQYTCLHENLFHYLTEVKSNGGVKIPEVKGDEAWKVFFDDASQEIVDEFAMRYGIESIYQAMTHFSCLSSKYMCPGVPAVMSTLLANINAFYAHTTVSTNIQVSASDRFAATNFGREKFIKLLDQLHNSLRIDLSKYRENFPASNTERLQDLKSTVDLLTSITFFRMKVLELQSPPKASMVVKDCVRACLDSTYKYIFDNCHELYSQLTDPSKKQDIPREDQGPTTKNLDFWPQLITLMVTIIDEDKTAYTPVLNQFPQELNMGKISAEIMWTLFALDMKYALEEHENQRLCKSTDYMNLHFKVKWFYNEYVRELPAFKDAVPEYSLWFEPFVMQWLDENEDVSMEFLHGALGRDKKDGFQQTSEHALFSCSVVDVFAQLNQSFEIIKKLECPNPEALSHLMRRFAKTINKVLLQYAAIVSSDFSSHCDKENVPCILMNNIQQLRVQLEKMFESMGGKELDSEASTILKELQVKLSGVLDELSVTYGESFQVIIEECIKQMSFELNQMRANGNTTSNKNSAAMDAEIVLRSLMDFLDKTLSLSAKICEKTVLKRVLKELWKLVLNKIEKQIVLPPLTDQTGPQMIFIAAKDLGQLSKLKEHMIREDARGLTPRQCAIMEVVLATIKQYFHAGGNGLKKNFLEKSPDLQSLRYALSLYTQTTDALIKKFIDTQTSQSRSSKDAVGQISVHVDITATPGTGDHKVTVKVIAINDLNWQTTAMFRPFVEVCILGPNLGDKKRKQGTKTKSNTWSPKYNETFQFILGKENRPGAYELHLSVKDYCFAREDRIIGMTVIQLQNIAEKGSYGAWYPLLKNISMDETGLTILRILSQRTSDDVAKEFVRLKSETRSTEESA

SEQ ID NO: 15866 - protein, 518 aa, Artificial Sequence
  Description of Artificial Sequence: Synthetic coding sequence
MCPQESSFQPSQFLLLVGVPVASVLLLAQCLRWHCPRRLLGACWTLNGQEEPVSQPTPQLENEVSRQHLPATLPEMVAFYQELHTPTQGQTMVRQLMHKLLVFSAREVDHRGGCLMLQDTGISLLIPPGAVAVGRQERVSLILVWDLSDAPSLSQAQGLVSPVVACGPHGASFLKPCTLTFKHCAEQPSHARTYSSNTTLLDAKVWRPLGRPGAHASRDECRIHLSHFSLYTCVLEAPVGREARKWLQLAVFCSPLVPGQSHLQLRIYFLNNTPCALQWALTNEQPHGGRLRGPCQLFDFNGARGDQCLKLTYISEGWENVDDSSCQLVPHLHIWHGKCPFRSFCFRRKAADENEDCSALTNEIIVTMHTFQDGLETKYMEILRFQASEEESWAAPPPVSQPPPCNRLPPELFEQLRMLLEPNSITGNDWRRLASHLGLCGMKIRFLSCQRSPAAAILELFEEQNGSLQELHYLMTVMERLDCASAIQNYLSGTHGGSPGPERGGARDNQGLELDEKL

SEQ ID NO: 15867 - protein, 518 aa, Artificial Sequence; identical to SEQ ID NO: 15866
  Description of Artificial Sequence: Synthetic coding sequence

SEQ ID NO: 15868 - protein, 953 aa, Artificial Sequence
  Description of Artificial Sequence: Synthetic coding sequence
MGRAAATAGGGGGARRWLPWLGLCFWAAGTAAARGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVNGGWSSWTEWSACNVRCGRGWQKRSRTCTNPAPLNGGAFCEGMSVQKITCTSLCPVDGSWEVWSEWSVCSPECEHLRIRECTAPPPRNGGKFCEGLSQESENCTDGLCILDKKPLHEIKPQSIENASDIALYSGLGAAVVAVAVLVIGVTLYRRSQSDYGVDVIDSSALTGGFQTFNFKTVRQGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 15869 - protein, 948 aa, Artificial Sequence
  Description of Artificial Sequence: Synthetic coding sequence
MILVLVKALSDVCAGTSGFLLDFSSQTSPGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVNGGWSSWTEWSACNVRCGRGWQKRSRTCTNPAPLNGGAFCEGMSVQKITCTSLCPVDGSWEVWSEWSVCSPECEHLRIRECTAPPPRNGGKFCEGLSQESENCTDGLCILDKKPLHEIKPQSIENASDIALYSGLGAAVVAVAVLVIGVTLYRRSQSDYGVDVIDSSALTGGFQTFNFKTVRQGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 15870 - protein, 259 aa, Artificial Sequence
  Description of Artificial Sequence: Synthetic coding sequence
MLPSTSVNSLVQGNGVLNSRDAARHTAGAKRYKYLRRLFRFRQMDFEFAAWQMLYLFTSPQRVYRNFHYRKQTKDQWARDDPAFLVLLSIWLCVSTIGFGFVLDMGFFETIKLLLWVVLIDCVGVGLLIATLMWFISNKYLVKRQSRDYDVEWGYAFDVHLNAFYPLLVILHFIQLFFINHVILTDTFIGYLVGNTLWLVAVGYYIYVTFLGYSALPFLKNTVILLYPFAPLILLYGLSLALGWNFTHTLCSFYKYRVK

SEQ ID NO: 15871 - protein, 276 aa, Artificial Sequence
  Description of Artificial Sequence: Synthetic coding sequence
MFLQNTCKRNVFLPSRKMLPSTSVNSLVQGNGVLNSRDAARHTAGAKRYKYLRRLFRFRQMDFEFAAWQMLYLFTSPQRVYRNFHYRKQTKDQWARDDPAFLVLLSIWLCVSTIGFGFVLDMGFFETIKLLLWVVLIDCVGVGLLIATLMWFISNKYLVKRQSRDYDVEWGYAFDVHLNAFYPLLVILHFIQLFFINHVILTDTFIGYLVGNTLWLVAVGYYIYVTFLGYSALPFLKNTVILLYPFAPLILLYGLSLALGWNFTHTLCSFYKYRVK

SEQ ID NO: 15872 - protein, 276 aa, Artificial Sequence; identical to SEQ ID NO: 15871
  Description of Artificial Sequence: Synthetic coding sequence

SEQ ID NO: 15873 - protein, 1036 aa, Artificial Sequence
  Description of Artificial Sequence: Synthetic coding sequence
MEVVGDFEYSKRDLVGHGAFAVVFRGRHRQKTDWEVAIKSINKKNLSKSQILLGKEIKILKELQHENIVALYDVQELPNSVFLVMEYCNGGDLADYLQAKGTLSEDTIRVFLHQIAAAMRILHSKGIIHRDLKPQNILLSYANRRKSSVSGIRIKIADFGFARYLHSNMMAATLCGSPMYMAPEVIMSQHYDAKADLWSIGTVIYQCLVGKPPFQANSPQDLRMFYEKNRSLMPSIPRETSPYLANLLLGLLQRNQKDRMDFEAFFSHPFLEQGPVKKSCPVPVPMYSGSVSGSSCGSSPSCRFASPPSLPDMQHIQEENLSSPPLGPPNYLQVSKDSASTSSKNSSCDTDDFVLVPHNISSDHSCDMPVGTAGRRASNEFLVCGGQCQPTVSPHSETAPIPVPTQIRNYQRIEQNLTSTASSGTNVHGSPRSAVVRRSNTSPMGFLRPGSCSPVPADTAQTVGRRLSTGSSRPYSPSPLVGTIPEQFSQCCCGHPQGHDSRSRNSSGSPVPQAQSPQSLLSGARLQSAPTLTDIYQNKQKLRKQHSDPVCPSHTGAGYSYSPQPSRPGSLGTSPTKHLGSSPRSSDWFFKTPLPTIIGSPTKTTAPFKIPKTQASSNLLALVTRHGPAEEQSKDGNEPRECAHCLLVQGSERQRAEQQSKAVFGRSVSTGKLSDQQGKTPICRHQGSTDSLNTERPMDIAPAGACGGVLAPPAGTAASSKAVLFTVGSPPHSAAAPTCTHMFLRTRTTSVGPSNSGGSLCAMSGRVCVGSPPGPGFGSSPPGAEAAPSLRYVPYGASPPSLEGLITFEAPELPEETLMEREHTDTLRHLNVMLMFTECVLDLTAMRGGNPELCTSAVSLYQIQESVVVDQISQLSKDWGRVEQLVLYMKAAQLLAASLHLAKAQIKSGKLSPSTAVKQVVKNLNERYKFCITMCKKLTEKLNRFFSDKQRFIDEINSVTAEKLIYNCAVEMVQSAALDEMFQQTEDIVYRYHKAALLLEGLSRILQDPADIENVHKYKCSIERRLSALCHSTATV

SEQ ID NO: 15874 - protein, 1036 aa, Artificial Sequence; identical to SEQ ID NO: 15873
  Description of Artificial Sequence: Synthetic coding sequence

SEQ ID NO: 15875 - protein, 843 aa, Artificial Sequence
  Description of Artificial Sequence: Synthetic coding sequence
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQANGFWVGPLGGGSASESDPTGFLHDSRHRLSSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGL

SEQ ID NO: 15876 - protein, 748 aa, Artificial Sequence
  Description of Artificial Sequence: Synthetic coding sequence
MDQHQHLNKTAESASSEKKKTRRCNGFKMFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETHINPSENSTSSLSTCLINQTLSFNGTSPEIVEKDCVKESGSHMWIYVFMGNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTVFYNCSCVEVTGLQNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGIVQPELKALAIGFHSMIMRSLGGILVPIYFGALIDTTCMKWSTNSCGARGACRIYNSTYLGRAFFGLKVALIFPVLVLLTVFIFVVRKKSHGKDTKVLENERQVMDEANLEFLNDSEHFVPSAEEQ

SEQ ID NO: 15877 - protein, 193 aa, Artificial Sequence
  Description of Artificial Sequence: Synthetic coding sequence
MSPCGGEDIVADHVASYGVNLYQSYGPSGQYTHEFDGDEQFYVDLGRKETVWCLPVLRQFRFDPQFALTNIAVLKHNLNSLIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWVHGFLSF

SEQ ID NO: 15878 - protein, 253 aa, Artificial Sequence
  Description of Artificial Sequence: Synthetic coding sequence
GCLGKRMILNKALMLGALALTTVMSPCGGEDIVADHVASYGVNLYQSYGPSGQYTHEFDGDEQFYVDLGRKETVWCLPVLRQFRFDPQFALTNIAVLKHNLNSLIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWGKDEFHHFLMLSCLSSSELPAFYSYIPKLVFHTSWVSFFLIFFF

SEQ ID NO: 15879 - protein, 146 aa, Artificial Sequence [sequence omitted]

SEQ ID NO: 15880 - protein, 254 aa, Artificial Sequence
  Description of Artificial Sequence: Synthetic coding sequence
MILNKALMLGALALTTVMSPCGGEDIVADHVASYGVNLYQSYGPSGQYTHEFDGDEQFYVDLGRKETVWCLPVLRQFRFDPQFALTNIAVLKHNLNSLIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTETVVCALGLSVGLVGIVVGTVFIIRGLRSVGASRHQGPL

SEQ ID NO: 15881 - protein, 165 aa, Artificial Sequence
  Description of Artificial Sequence: Synthetic coding sequence
MTRLCLPRPEAREDPIPVPPRGLGAGEGSGSPVRPPVSTWGPSWAQLLDSVLWLGALGLTIQAVFSTTGPALLLLLVSFLTFDLLHRPAGHTLPQRKLLTRGQSQGAGEGPGQQEALLLQMGTVSGQLSLQDALLLLLMGLGPLLRACGMPLTLLGLAFCLHPWA

SEQ ID NO: 15882 - protein, 170 aa, Artificial Sequence
  Description of Artificial Sequence: Synthetic coding sequence
MVTVLDQMKAGTYKLTFDTEGYWRKRGQESFYPHVEVVLTITSKAQKFHVPLVLHHLPRELERRLAAGGCLPVPARWLHPPSPQQSGLCAHQGALAHHFLGKSRPPGESHWAAVTQVSMKLVPAPAKLSIRWDNSGAKTGSTARHCPNPQVSAGHSEKVPPTVVGGETRE

SEQ ID NO: 15883 - protein, 259 aa, Artificial Sequence
  Description of Artificial Sequence: Synthetic coding sequence
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTDSAEPEMDVRKRTGVAGSQPVSEKQLAAELDLVLQRHQNLQEKLAEEMLGLARSLKTNTLAAQSVIKKDNQTLSHSLKMADQNLEKLKTESERLEQHTQKSVNWLLWAMLIIVCFIFISMILFIRIMPKLK

SEQ ID NO: 15884 - protein, 58 aa, Artificial Sequence
  Description of Artificial Sequence: Synthetic coding sequence
MAGPESDAQYQFTGIKKYFNSYTLTGRMNCVLATYGSIALIVLYFKLRSKKTPAVKAT

SEQ ID NO: 15885 - protein, 58 aa, Artificial Sequence; identical to SEQ ID NO: 15884
  Description of Artificial Sequence: Synthetic coding sequence

SEQ ID NO: 15886 - protein, 58 aa, Artificial Sequence; identical to SEQ ID NO: 15884
  Description of Artificial Sequence: Synthetic coding sequence

SEQ ID NO: 15887 - protein, 58 aa, Artificial Sequence; identical to SEQ ID NO: 15884
  Description of Artificial Sequence: Synthetic coding sequence

SEQ ID NO: 15888 - protein, 58 aa, Artificial Sequence; identical to SEQ ID NO: 15884
  Description of Artificial Sequence: Synthetic coding sequence

SEQ ID NO: 15889 - protein, 263 aa, Artificial Sequence; identical to SEQ ID NO: 12947
  Description of Artificial Sequence: Synthetic coding sequence

SEQ ID NO: 15890 - protein, 389 aa, Artificial Sequence
  Description of Artificial Sequence: Synthetic coding sequence
MALTPESPSSFPGLAATGSSVPEPPGGPNATLNSSWASPTEPSSLEDLVATGTIGTLLSAMGVVGVVGNAYTLVVTCRSLRAVASMYVYVVNLALADLLYLLSIPFIVATYVTKEWHFGDVGCRVLFGLDFLTMHASIFTLTVMSSERYAAVLRPLDTVQRPKGYRKLLALGTWLLALLLTLPVMLAMRLVRRGPKSLCLPAWGPRAHRAYLTLLFATSIAGPGLLIGLLYARLARAYRRSQRASFKRARRPGARALRLVLGIVLLFWACFLPFWLWQLLAQYHQAPLAPRTARIVNYLTTCLTYGNSCANPFLYTLLTRNYRDHLRGRVRGPGSGGGRGPVPSLQPRARFQRCSGRSLSSCSPQPTDSLVLAPAAPARPAPEGPRAPA

SEQ ID NO: 15891 - protein, 525 aa, Artificial Sequence
  Description of Artificial Sequence: Synthetic coding sequence
MMPWLWTAPHQKESQKADEYLREIQELGQLTQAVQQCIEAAGHEHQPDMQKSLLRVGLDGRAGEGGAGRGWDGQQGSSLLSPSGSSQAASFGKCFLDRFPPDSFVHMCQDLRVLNAVRDYHIGIPLTYSQYKQLTIQVLLDRLVLRRLYPLAIQICEYLRLPEVQGVSRILAHWACYKVQQKDVSDEDVARAINQKLGDTPGVSYSDIAARAYGCGRTELAIKLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKRLWWLKLTALADLEDWEELEKFSKSKKSPIGYLPFVEICMKQHNKYEAKKYASRVGPEQKVKALLLVGDVAQAADVAIEHRNEAELSLVLSHCTGATDGATADKIQRARAQAQKK

SEQ ID NO: 15892 - protein, 839 aa, Artificial Sequence
  Description of Artificial Sequence: Synthetic coding sequence
MDCYTANWNPLGDSAFYRKYELYSMDWDLKEELRDCLVAAAPYGGPIALLRNPWRKEKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQFVLDEDSYLVPELDGVRIFSRSTHEFLHEVPAASEEIFKIASMAPGALLLEAQKEYEKESQKADEYLREIQELGQLTQAVQQCIEAAGHEHQPDMQKSLLRAASFGKCFLDRFPPDSFVHMCQDLRVLNAVRDYHIGIPLTYSQYKQLTIQVLLDRLVLRRLYPLAIQICEYLRLPEVQGVSRILAHWACYKVQQKDVSDEDVARAINQKLGDTPGVSYSDIAARAYGCGRTELAIKLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKRLWWLKLTALADLEDWEELEKFSKSKKSPIGYLPFVEICMKQHNKYEAKKYASRVGPEQKVKALLLVGDVAQAADVAIEHRNEAELSLVLSHCTGATDGATADKIQRARAQAQKK

SEQ ID NO: 15893 - protein, 695 aa, Artificial Sequence
  Description of Artificial Sequence: Synthetic coding sequence
MDCYTANWNPLGDSAFYRKYELYSMDWDLKEELRDCLVAAAPYGGPIALLRNPWRKEKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQYKQLTIQVLLDRLVLRRLYPLAIQICEYLRLPEVQGVSRILAHWACYKVQQKDVSDEDVARAINQKLGDTPGVSYSDIAARAYGCGRTELAIKLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKRLWWLKLTALADLEDWEELEKFSKSKKSPIGYLPFVEICMKQHNKYEAKKYASRVGPEQKVKALLLVGDVAQAADVAIEHRNEAELSLVLSHCTGATDGATADKIQRARAQAQKK

SEQ ID NO: 15894 - protein, 227 aa, Artificial Sequence [sequence omitted]

SEQ ID NO: 15895 - protein, 274 aa, Artificial Sequence
  Description of Artificial Sequence: Synthetic coding sequence
MGAPLEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQYKQLTIQVLLDRLVLRRLYPLAIQICEYLRLPEVQGVSRILAHWACYKVQQKDVSDEDVARAINQKLGDTPGVSYSDIAARAYGCGRTELAI

SEQ ID NO: 15896 - protein, 973 aa, Artificial Sequence
  Description of Artificial Sequence: Synthetic coding sequence
MASILDEYENSLSRSAVLQPGCPSVGIPHSGYVNAQLEKEVPIFTKQRIDFTPSERITSLVVSSNQLCMSLGKDTLLRIDLGKANEPNHVELGRKDDAKVHKMFLDHTGSHLLIALSSTEVLYVNRNGQKVRPLARWKGQLVESVGWNKALGTESSTGPILVGTAQGHIFEAELSASEGGLFGPAPDLYFRPLYVLNEEGGPAPVCSLEAERGPDGRSFVIATTRQRLFQFIGRAAEGAEAQGFSGLFAAYTDHPPPFREFPSNLGYSELAFYTPKLRSAPRAFAWMMGDGVLYGALDCGRPDSLLSEERVWEYPEGVGPGASPPLAIVLTQFHFLLLLADRVEAVCTLTGQVVLRDHFLEKFGPLKHMVKDSSTGQLWAYTERAVFRYHVQREARDVWRTYLDMNRFDLAKEYCRERPDCLDTVLAREADFCFRQRRYLESARCYALTQSYFEEIALKFLEARQEEALAEFLQRKLASLKPAERTQATLLTTWLTELYLSRLGALQGDPEALTLYRETKECFRTFLSSPRHKEWLFASRASIHELLASHGDTEHMVYFAVIMQDYERVVAYHCQHEAYEEALAVLARHRDPQLFYKFSPILIRHIPRQLVDAWIEMGSRLDARQLIPALVNYSQGGEVQQVSQAIRYMEFCVNVLGETEQAIHNYLLSLYARGRPDSLLAYLEQAGASPHRVHYDLKYALRLCAEHGHHRACVHVYKVLELYEEAVDLALQVDVDLAKQCADLPEEDEELRKKLWLKIARHVVQEEEDVQTAMACLASCPLLKIEDVLPFFPDFVTIDHFKEAICSSLKAYNHHIQELQREMEEATASAQRIRRDLQELRGRYGTVEPQDKCATCDFPLLNRPFYLFLCGHMFHADCLLQAVRPGLPAYKQARLEELQRKLGAAPPPAKGSARAKEAEGGAATAGPSREQLKADLDELVAAECVYCGELMIRSIDRPFIDPQRYEEEQLSWL

SEQ ID NO: 15897 - protein, 186 aa, Artificial Sequence
  Description of Artificial Sequence: Synthetic coding sequence
MAGHRLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKFEAFEHENKFYINPGSATGAYNALETNIIPSFVLMDIQASTVVTYVYQLIGDDVKVERIEYKKP

SEQ ID NO: 15898 - protein, 87 aa, Artificial Sequence
  Description of Artificial Sequence: Synthetic coding sequence
MASLALLQRQFDVDILISGHTHKFEAFEHENKFYINPGSATGAYNALETNIIPSFVLMDIQASTVVTYVYQLIGDDVKVERIEYKKP

SEQ ID NO: 15899 - protein, 182 aa, Artificial Sequence [sequence omitted]

SEQ ID NO: 15900 - protein, 723 aa, Artificial Sequence
  Description of Artificial Sequence: Synthetic coding sequence
MAAAATMAAAARELVLRAGTSDMEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 15901 - protein, 701 aa, Artificial Sequence
  Description of Artificial Sequence: Synthetic coding sequence
MEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 15902 - protein, 723 aa, Artificial Sequence; identical to SEQ ID NO: 15900
  Description of Artificial Sequence: Synthetic coding sequence

SEQ ID NO: 15903 - protein, 598 aa, Artificial Sequence
  Description of Artificial Sequence: Synthetic coding sequence
MEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 15904 - protein, 723 aa, Artificial Sequence; identical to SEQ ID NO: 15900
  Description of Artificial Sequence: Synthetic coding sequence

SEQ ID NO: 15905 - protein, 723 aa, Artificial Sequence; identical to SEQ ID NO: 15900
  Description of Artificial Sequence: Synthetic coding sequence

SEQ ID NO: 15906 - protein, 723 aa, Artificial Sequence; identical to SEQ ID NO: 15900
  Description of Artificial Sequence: Synthetic coding sequence

SEQ ID NO: 15907 - protein, 723 aa, Artificial Sequence; identical to SEQ ID NO: 15900
  Description of Artificial Sequence: Synthetic coding sequence

SEQ ID NO: 15908 - protein, 701 aa, Artificial Sequence; identical to SEQ ID NO: 15901
  Description of Artificial Sequence: Synthetic coding sequence

SEQ ID NO: 15909 - protein, 701 aa, Artificial Sequence; identical to SEQ ID NO: 15901
  Description of Artificial Sequence: Synthetic coding sequence

SEQ ID NO: 15910 - protein, 598 aa, Artificial Sequence; identical to SEQ ID NO: 15903
  Description of Artificial Sequence: Synthetic coding sequence

SEQ ID NO: 15911 - protein, 598 aa, Artificial Sequence; identical to SEQ ID NO: 15903
  Description of Artificial Sequence: Synthetic coding sequence

SEQ ID NO: 15912 - protein, 480 aa, Artificial Sequence [sequence omitted]

SEQ ID NO: 15913 - protein, 1063 aa, Artificial Sequence
  Description of Artificial Sequence: Synthetic coding sequence
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLQQLMDEPPAPGSPEL

SEQ ID NO: 15914 - protein, 115 aa, Artificial Sequence
  Description of Artificial Sequence: Synthetic coding sequence
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYP

SEQ ID NO: 15915 - protein, 326 aa, Artificial Sequence
  Description of Artificial Sequence: Synthetic coding sequence
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDG

SEQ ID NO: 15916 - protein, 257 aa, Artificial Sequence
  Description of Artificial Sequence: Synthetic coding sequence
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRVFYHGCWLLSGCD

SEQ ID NO: 15917 - protein, 923 aa, Artificial Sequence [sequence omitted]

SEQ ID NO: 15918 - protein, 1093 aa, Artificial Sequence
  Description of Artificial Sequence: Synthetic coding sequence
MGGKAWPRRAVGTAGGPCAEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLQQLMDEPPAPGSPEL

SEQ ID NO: 15919 - protein, 232 aa, Artificial Sequence
  Description of Artificial Sequence: Synthetic coding sequence
MASSAASSEHFEKLHEIFRGLHEDLQGVPERLLGTAGTEEKKKLIRDFDEKQQEANETLAEMEEELRYAPLSFRNPMMSKLRNYRKDLAKLHREVRSTPLTATPGGRGDMKYGIYAVENEHMNRLQSQRAMLLQGTESLNRATQSIERSHRIATETDQIGSEIIEELGEQRDQLERTKSRLVNTSENLSKSRKILRSMSRKVTTNKLLLSIIILLELAILGGLVYYKFFRSH

SEQ ID NO: 15920 - protein, 141 aa, Artificial Sequence
  Description of Artificial Sequence: Synthetic coding sequence
MPPKFKRHLNDDDVTGSVKSERRNLLEDDSDEEEDFFLRGPSGPRFGPRNDKIKHVQNQVDEVIDVMQENITKVIERGERLDELQDKSESLSDNATAFSNRSKQLRRQMWWRGCKIKAIMALVAAILLLVIIILIVMKYRT

SEQ ID NO: 15921 - protein, 140 aa, Artificial Sequence
  Description of Artificial Sequence: Synthetic coding sequence
MPPKFKRHLNDDDVTGSVKSERRNLLEDDSDEEEDFFLGPSGPRFGPRNDKIKHVQNQVDEVIDVMQENITKVIERGERLDELQDKSESLSDNATAFSNRSKQLRRQMWWRGCKIKAIMALVAAILLLVIIILIVMKYRT

SEQ ID NO: 15922 - protein, 140 aa, Artificial Sequence; identical to SEQ ID NO: 15921
  Description of Artificial Sequence: Synthetic coding sequence

SEQ ID NO: 15923 - protein, 141 aa, Artificial Sequence; identical to SEQ ID NO: 15920
  Description of Artificial Sequence: Synthetic coding sequence

SEQ ID NO: 15924 - protein, 172 aa, Artificial Sequence
  Description of Artificial Sequence: Synthetic coding sequence
MRRQPAKVAALLLGLLLECTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 15925 - protein, 169 aa, Artificial Sequence
  Description of Artificial Sequence: Synthetic coding sequence
MLSETLGYLSSVLLQCTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 15926 - protein, 731 aa, Artificial Sequence
  Description of Artificial Sequence: Synthetic coding sequence
MLKEWAIKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHAVLKSLSPVDPVEPISNSEPSMNSDMGKVSKNDTEEESNKSATTDNEISRTEYLCENSLEGKNKDNSSNEVFPQGAEERMCYQCESEDEPQADGSGLTTAPPTPRDSLQPSIKQRLARLQLSPDFTFTAGLAAEVAARSLSFTTMQEQTFGGEEEEQIIEENKNEIEEK

SEQ ID NO: 15927 - protein, 779 aa, Artificial Sequence
  Description of Artificial Sequence: Synthetic coding sequence
MLPDMEDVHLFQNSPLYQYLQDLGHTDFEICSSLSPKTEKCTTEGQQKPPTRVLPKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHAVLKSLSPVDPVEPISNSEPSMNSDMGKVSKNDTEEESNKSATTDNEISRTEYLCENSLEGKNKDNSSNEVFPQGAEERMCYQCESEDEPQADGSGLTTAPPTPRDSLQPSIKQRLARLQLSPDFTFTAGLAAEVAARSLSFTTMQEQTFGGEEEEQIIEENKNEIEEK

SEQ ID NO: 15928 - protein, 779 aa, Artificial Sequence
  Description of Artificial Sequence: Synthetic coding sequence
MTPEFDEEVVFENSPLYQYLQDLGHTDFEICSSLSPKTEKCTTEGQQKPPTRVLPKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHAVLKSLSPVDPVEPISNSEPSMNSDMGKVSKNDTEEESNKSATTDNEISRTEYLCENSLEGKNKDNSSNEVFPQGAEERMCYQCESEDEPQADGSGLTTAPPTPRDSLQPSIKQRLARLQLSPDFTFTAGLAAEVAARSLSFTTMQEQTFGGEEEEQIIEENKNEIEEK

SEQ ID NO: 15929 - protein, 176 aa, Artificial Sequence
  Description of Artificial Sequence: Synthetic coding sequence
MAAPVLLRVSVPRWERVARYAVCAAGILLSIYAYHVEREKERDPEHRALCDLGPWVKCSAALASRWGRGFGLLGSIFGKDGVLNQPNSVFGLIFYILQLLLGMTASAVAALILMTSSIMSVVGSLYLAYILYFVLKEFCIICIVTYVLNFLLLIINYKRLVYLNEAWKRQLQPKQD

SEQ ID NO: 15930 - protein, 101 aa, Artificial Sequence
  Description of Artificial Sequence: Synthetic coding sequence
MERPDKAALNALQPPEFRNESSLASTLKTLLFFTALMITVPIGLYFTTKSYIFEGALGMSNRDSYFYAAIVAVVAVHVVLALFVYVAWNEGSRQWREGKQD

SEQ ID NO: 15931 - protein, 156 aa, Artificial Sequence
  Description of Artificial Sequence: Synthetic coding sequence
MLGSPCGPQLSDRDADEDQCSREFRGRRSRRPPRRTMLRGKSRLNVEWLGYSPGLLLEHRPLLAGRTPRSHRRNESSLASTLKTLLFFTALMITVPIGLYFTTKSYIFEGALGMSNRDSYFYAAIVAVVAVHVVLALFVYVAWNEGSRQWREGKQD

SEQ ID NO: 15932 - protein, 395 aa, Artificial Sequence
  Description of Artificial Sequence: Synthetic coding sequence
MTHTLYPTPFALYPINISAAWHLGPLPVSCFVSNKYQCSLAFGATTGLRVLVVVVPQTQLSFLSSLCLVSLFLHSLVSAHGEKPTKPVGLDPTLFQVVVGILGNFSLLYYYMFLYFRGYKPRSTDLILRHLTVADSLVILSKRIPETMATFGLKHFDNYFGCKFLLYAHRVGRGVSIGSTCLLSVFQVITINPRNSRWAEMKVKAPTYIGLSNILCWAFHMLVNAIFPIYTTGKWSNNNITKKGDLGYCSAPLSDEVTKSVYAALTSFHDVLCLGLMLWASSSIVLVLYRHKQQVQHICRNNLYPNSSPGNRAIQSILALVSTFALCYALSFITYVYLALFDNSSWWLVNTAALIIACFPTISPFVLMCRDPSRSRLCSICCRRNRRFFHDFRKM

SEQ ID NO: 15933 - protein, 387 aa, Artificial Sequence
  Description of Artificial Sequence: Synthetic coding sequence
MVFAFWKVFLILSCLAGQVSVVQVTIPDGFVNVTVGSNVTLICIYTTTVASREQLSIQWSFFHKKEMEPISIYFSQGGQAVAIGQFKDRITGSNDPGNASITISHMQPADSGIYICDVNNPPDFLGQNQGILNVSVLVKPSKPLCSVQGRPETGHTISLSCLSALGTPSPVYYWHKLEGRDIVPVKENFNPTTGILVIGNLTNFEQGYYQCTAINRLGNSSCEIDLTSSHPEVGIIVGALIGSLVGAAIIISVVCFARNKAKAKAKERNSKTIAELEPMTKINPRGESEAMPREDATQLEVTLPSSIHETGPDTIQEPDYEPKPTQEPAPEPAPGSEPMAVPDLDIELELEPETQSELEPEPEPEPESEPGVVVEPLSEDEKGVVKA

SEQ ID NO: 15934 - protein, 423 aa, Artificial Sequence
  Description of Artificial Sequence: Synthetic coding sequence
MVFAFWKVFLILSCLAGQVSVVQVTIPDGFVNVTVGSNVTLICIYTTTVASREQLSIQWSFFHKKEMEPISHSSCLSTEGMEEKAVSQCLKMTHARDARGRCSWTSEIYFSQGGQAVAIGQFKDRITGSNDPGNASITISHMQPADSGIYICDVNNPPDFLGQNQGILNVSVLVKPSKPLCSVQGRPETGHTISLSCLSALGTPSPVYYWHKLEGRDIVPVKENFNPTTGILVIGNLTNFEQGYYQCTAINRLGNSSCEIDLTSSHPEVGIIVGALIGSLVGAAIIISVVCFARNKAKAKAKERNSKTIAELEPMTKINPRGESEAMPREDATQLEVTLPSSIHETGPDTIQEPDYEPKPTQEPAPEPAPGSEPMAVPDLDIELELEPETQSELEPEPEPEPESEPGVVVEPLSEDEKGVVKA

SEQ ID NO: 15935 - protein, 540 aa, Artificial Sequence
  Description of Artificial Sequence: Synthetic coding sequence
MAAGGSAPEPRVLVCLGALLAGWVAVGLEAVVIGEVHENVTLHCGNISGLRGQVTWYRNNSEPVFLLSSNSSLRPAEPRFSLVDATSLHIESLSLGDEGIYTCQEILNVTQWFQVWLQVASGPYQIEVHIVATGTLPNGTLYAARGSQVDFSCNSSSRPPPVVEWWFQALNSSSESFGHNLTVNFFSLLLISPNLQGNYTCLALNQLSKRHRKVTTELLVYYPPPSAPQCWAQMASGSFMLQLTCRWDGGYPDPDFLWIEEPGGVIVGKSKLGVEMLSESQLSDGKKFKCVTSHIVGPESGASCMVQIRGPSLLSEPMKTCFTGGNVTLTCQVSGAYPPAKILWLRNLTQPEVIIQPSSRHLITQDGQNSTLTIHNCSQDLDEGYYICRADSPVGVREMEIWLSVKEPLNIGGIVGTIVSLLLLGLAIISGLLLHYSPVFCWKVGNTSRGQNMDDVMVLVDSEEEEEEEEEEEEDAAVGEQEGAREREELPKEIPKQDHIHRVTALVNGNIEQMGNGFQDLQDDSSEEQSDIVQEEDRPV

SEQ ID NO: 15936 - protein, 867 aa, Artificial Sequence
  Description of Artificial Sequence: Synthetic coding sequence
MDNPQALPLFLLLASLVGILTLRASSGLQQTNFSSAFSSDSKSSSQGLGVEVPSIKPPSWKVPDQFLDSKASAGISDSSWFPEALSSNMSGSFWSNVSAEGQDLSPVSPFSETPGSEVFPDISDPQVPAKDPKPSFTVKTPASNISTQVSHTKLSVEAPDSKFSPDDMDLKLSAQSPESKFSAETHSAASFPQQVGGPLAVLVGTTIRLPLVPIPNPGPPTSLVVWRRGSKVLAAGGLGPGAPLISLDPAHRDHLRFDQARGVLELASAQLDDAGVYTAEVIRAGVSQQTHEFTVGVYEPLPQLSVQPKAPETEEGAAELRLRCLGWGPGRGELSWSRDGRALEAAESEGAETPRMRSEGDQLLIVRPVRSDHARYTCRVRSPFGHREAAADVSVFYGPDPPTITVSSDRDAAPARFVTAGSNVTLRCAAASRPPADITWSLADPAEAAVPAGSRLLLPAVGPGHAGTYACLAANPRTGRRRRSLLNLTVADLPPGAPQCSVEGGPGDRSLRFRCSWPGGAPAASLQFQGLPEGIRAGPVSSVLLAAVPAHPRLSGVPITCLARHLVATRTCTVTPEAPREVLLHPLVAETRLGEAEVALEASGCPPPSRASWAREGRPLAPGGGSRLRLSQDGRKLHIGNFSLDWDLGNYSVLCSGALGAGGDQITLIGPSISSWRLQRARDAAVLTWDVERGALISSFEIQAWPDGPALGRTSTYRDWVSLLILGPQERSAVVPLPPRNPGTWTFRILPILGGQPGTPSQSRVYRAGPTLSHGAIAGIVLGSLLGLALLAVLLLLCICCLCRFRGKTPEKKKHPSTLVPVVTPSEKKMHSVTPVEISWPLDLKVPLEDHSSTRAYQAQTPVQLSL

SEQ ID NO: 15937 - protein, 48 aa, Artificial Sequence
  Description of Artificial Sequence: Synthetic coding sequence
MDNPQALPLFLLLASLVGILTLRASSGLQQTNFSSALHRAFWARTSYF

SEQ ID NO: 15938 - protein, 399 aa, Artificial Sequence
  Description of Artificial Sequence: Synthetic coding sequence
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVPLDYEFLATEGKSVC

SEQ ID NO: 15939 - protein, 305 aa, Artificial Sequence
  Description of Artificial Sequence: Synthetic coding sequence
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKHSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVPLDYEFLATEGKSVC

SEQ ID NO: 15940 - protein, 201 aa, Artificial Sequence
  Description of Artificial Sequence: Synthetic coding sequence
MGILLGLLLLGHLTVDTYGRPILEVPESVTGPWKGDVNLPCTYDPLQGYTQVLVKWLVQRGSDPVTTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGP

SEQ ID NO: 15941 - protein, 274 aa, Artificial Sequence
  Description of Artificial Sequence: Synthetic coding sequence
  MOD_RES (1)..(1): Any amino acid
XDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAASPKCPPTNTGAAGSHWLCPGICQMHLK

SEQ ID NO: 15942 - protein, 321 aa, Artificial Sequence
  Description of Artificial Sequence: Synthetic coding sequence
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAAR

SEQ ID NO: 15943 - protein, 414 aa, Artificial Sequence
  Description of Artificial Sequence: Synthetic coding sequence
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 15944 - protein, 191 aa, Artificial Sequence
  Description of Artificial Sequence: Synthetic coding sequence
MRLLALAAAALLARAPAPEVCAALNVTVSPGPVVDYLEGENATLLCHVSQKRRKDSLLAVRWFFAHSFDSQEALMVKMTKLRVVQYYGNFSRSAKRRRLRLLEEQRGALYRLSVLTLQPSDQGHYVCRVQEISRHRNKWTAWSNGSSATEMRGVSSHPVERGAFLGISLVILPHSLPFTADLTMASFLQSS

SEQ ID NO: 15945 - protein, 320 aa, Artificial Sequence
  Description of Artificial Sequence: Synthetic coding sequence
MRLLALAAAALLARAPAPEVCAALNVTVSPGPVVDYLEGENATLLCHVSQKRRKDSLLAVRWFFAHSFDSQEALMVKMTKLRVVQYYGNFSRSAKRRRLRLLEEQRGALYRLSVLTLQPSDQGHYVCRVQEISRHRNKWTAWSNGSSATEMRVISLKASEESSFEKTKETWAFFEDLYVYAVLVCCVGILSILLFMLVIVWQSVFNKRKSRVRHYLVKCPQNSSGETVTSVTSLAPLQPKKGKRQKEKPDIPPAVPAKAPIAPTFHKPKLLKPQRKVTLPKIAEENLTYAELELIKPHRAAKGAPTSTVYAQILFEENKL

SEQ ID NO: 15946 - protein, 200 aa, Artificial Sequence
  Description of Artificial Sequence: Synthetic coding sequence
MRPLPSGRRKTRGISLGLFALCLAAARCLQSQGVSLYIPQATINATVKEDILLSVEYSCHGVPTIEWTYSSNWGTQKIVEWKPGTQANISQSHKDRVCTFDNGSIQLFSVGVRDSGYYVITVTERLGSSQFGTIVLHVSEILYEDLHFVAVILAFLAAVAAVLISLMWVCNKCAYKFQRKRRHKLKESTTEEIELEDVEC

SEQ ID NO: 15947 - protein, 166 aa, Artificial Sequence
  Description of Artificial Sequence: Synthetic coding sequence
MASLGQILFWSIISIIIILAGAIALIIGFGISAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 15948 - protein, 285 aa, Artificial Sequence
  Description of Artificial Sequence: Synthetic coding sequence
MVLLTSRMKPLTSRIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 15949 - protein, 85 aa, Artificial Sequence
  Description of Artificial Sequence: Synthetic coding sequence
ATLRNKLMWNIISIIIILAGAIALIIGFGISEVSVWLSAMKGCRSSKASLSIDLCFLNCRETLHHSHYCRLSWEHWGGWNPELHF

SEQ ID NO: 15950 - protein, 282 aa, Artificial Sequence
  Description of Artificial Sequence: Synthetic coding sequence
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 15951 - protein, 187 aa, Artificial Sequence
  Description of Artificial Sequence: Synthetic coding sequence
MFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 15952 - protein, 477 aa, Artificial Sequence
  Description of Artificial Sequence: Synthetic coding sequence
MSGVMCLKASDTWASGIRSQPQGCLGKWRSMRCKHTRMHLAHLGNSRQLISLGPPRTREDGSRISQQVEQSRSQVQAIGEKVSLAQAKIEKIKGSKKAIKVFSSAKYPAPERLQEYGSIFTDAQDPGLQRRPRHRIQSKQRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYIADLGPGIAPSAPGTIPELPTFHTEVAEPLKVDLQDGVLTPPPPPPPPPPAPEVLASAPPLPPSTAAPVGQGARQDDSSSSASPSVQGAPREVVDPSGGWATLLESIRQAGGIGKAKLRSMKERKLEKQQQKEQEQVRATSQGGHLMSDLFNKLVMRRKGISGKGPGAGDGPGGAFARVSDSIPPLPPPQQPQAEDEDDWES

SEQ ID NO: 15953 - protein, 169 aa, Artificial Sequence
  Description of Artificial Sequence: Synthetic coding sequence
MSGEMAFHEMQAHKNALGTSGEQQAADITGPTPHQGGWKQVEQSRSQVQAIGEKVSLAQAKIEKIKGSKKAIKVFSSAKYPAPERLQEYGSIFTDAQDPGLQRRPRHRIQSKQRPLDERALQEKLKDFPVCVSTKPEPEDDAEEGLGGLPSNISSVSSLLLFNTTENLY

SEQ ID NO: 15954 - protein, 447 aa, Artificial Sequence
  Description of Artificial Sequence: Synthetic coding sequence
MAFHEMQAHKNALGTSGEQQAADITGPTPHQGGWKQVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPSIANDLMYSADLGPGIAPSAPGTIPELPTFHTEVAEPLKADLQDGVLTPPPPPPPPPPAPEVLASAPPLPPSTAAPVGQGARQDDGSSSASPSVQGAPREVVDPSGGWATLLESIRQAGGIGKAKLRSMKERKLEKKKQKEQEQVRATSQGGHLMSDLFNKLVMRRKGISGKGPGAGEGPGGAFARVSDSIPPVPPPQQPQAEEDEDDWES

SEQ ID NO: 15955 - protein, 478 aa, Artificial Sequence
  Description of Artificial Sequence: Synthetic coding sequence
MSGVMCLKASDTWASGIRSQPQGCLGKWRSMRCKHTRMHLAHLGNSRQLISLGPPRTREDGSRISQQVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPSIANDLMYSADLGPGIAPSAPGTIPELPTFHTEVAEPLKADLQDGVLTPPPPPPPPPPAPEVLASAPPLPPSTAAPVGQGARQDDGSSSASPSVQGAPREVVDPSGGWATLLESIRQAGGIGKAKLRSMKERKLEKKKQKEQEQVRATSQGGHLMSDLFNKLVMRRKGISGKGPGAGEGPGGAFARVSDSIPPVPPPQQPQAEEDEDDWES

SEQ ID NO: 15956 - protein, 3526 aa, Artificial Sequence
  Description of Artificial Sequence: Synthetic coding sequence
MNMVKRIMGRPRQEECSPQDNALGLMHLRRLFTELCHPPRHMTQKEQEEKLYMMLPVFNRVFGNAPPNTMTEKFSDLLQFTTQVSRLMVTEIRRRASNKSTEAASRAIVQFLEINQSEEASRGWMLLTTINLLASSGQKTVDCMTTMSVPSTLVKCLYLFFDLPHVPEAVGGAQNELPLAERRGLLQKVFVQILVKLCSFVSPAEELAQKDDLQLLFSAITSWCPPYNLPWRKSAGEVLMTISRHGLSVNVVKYIHEKECLSTCVQNMQQSDDLSPLEIVEMFAGLSCFLKDSSDVSQTLLDDFRIWQGYNFLCDLLLRLEQAKEAESKDALKDLVNLITSLTTYGVSELKPAGITTGAPFLLPGFAVPQPAGKGHSVRNVQAFAVLQNAFLKAKTSFLAQIILDAITNIYMADNANYFILESQHTLSQFAEKISKLPEVQNKYFEMLEFVVFSLNYIPCKELISVSILLKSSSSYHCSIIAMKTLLKFTRHDYIFKDVFREVGLLEVMVNLLHKYAALLKDPTQALNEQGDSRNNSSVEDQKHLALLVMETLTVLLQGSNTNAGIFREFGGARCAHNIVKYPQCRQHALMTIQQLVLSPNGDDDMGTLLGLMHSAPPTELQLKTDILRALLSVLRESHRSRTVFRKVGGFVYITSLLVAMERSLSCPPKNGWEKVNQNQVFELLHTVFCTLTAAMRYEPANSHFFKTEIQYEKLADAVRFLGCFSDLRKISAMNVFPSNTQPFQRLLEEDVISIESVSPTLRHCSKLFIYLYKVATDSFDSRAEQIPPCLTSESSLPSPWGTPALSRKRHAYHSVSTPPVYPPKNVADLKLHVTTSSLQSSDAVIIHPGAMLAMLDLLASVGSVTQPEHALDLQLAVANILQSLVHTERNQQVMCEAGLHARLLQRCSAALADEDHSLHPPLQRMFERLASQALEPMVLREFLRLASPLNCGAWDKKLLKQYRVHKPSSLSYEPEMRSSMITSLEGLGTDNVFSLHEDNHYRISKSLVKSAEGSTVPLTRVKCLVSMTTPHDIRLHGSSVTPAFVEFDTSLEGFGCLFLPSLAPHNAPTNNTVTTGLIDGAVVSGIGSGERFFPPPSGLSYSSWFCIEHFSSPPNNHPVRLLTVVRRANSSEQHYVCLAIVLSAKDRSLIVSTKEELLQNYVDDFSEESSFYEILPCCARFRCGELIIEGQWHHLVLVMSKGMLKNSTAALYIDGQLVNTVKLHYVHSTPGGSGSANPPVVSTVYAYIGTPPAQRQIASLVWRLGPTHFLEEVLPSSNVTTIYELGPNYVGSFQAVCMPCKDAKSEGVVPSPVSLVPEEKVSFGLYALSVSSLTVARIRKVYNKLDSKAIAKQLGISSHENATPVKLIHNSAGHLNGSARTIGAALIGYLGVRTFVPKPVATTLQYVGGAAAILGLVAMASDVEGLYAAVKALVCVVKSNPLASKEMERIKGYQLLAMLLKKKRSLLNSHILHLTFSLVGTVDSGHETSIIPNSTAFQDLLCDFEVWLHAPYELHLSLFEHFIELLTESSEASKNAKLMREFQLIPKLLLTLRDMSLSQPTIAAISNVLSFLLQGFPSSNDLLRFGQFISSTLPTFAVCEKFVVMEINNEEKLDTGTEEEFGGLVSANLILLRNRLLDILLKLIYTSKEKTSINLQACEELVKTLGFDWIMMFMEEHLHSTTVTAAMRILVVLLSNQSILIKFKEGLSGGGWLEQTDSVLTNKIGTVLGFNVGRSAGGRSTVREINRDACHFPGFPVLQSFLPKHTNVPALYFLLMALFLQQPVSELPENLQVSVPVISCRSKQGCQFDLDSIWTFIFGVPASSGTVVSSIHNVCTEAVFLLLGMLRSMLTSPWQSEEEGSWLREYPVTLMQFFRYLYHNVPDLASMWMSPDFLCALAATVFPFNIRPYSEMVTDLDDEVGSPAEEFKAFAADTGMNRSQSEYCNVGTKTYLTNHPAKKFVFDFMRVLIIDNLCLTPASKQTPLIDLLLEASPERSTRTQQKEFQTYILDSVMDHLLAADVLLGEDASLPITSGGSYQVLVNNVFYFTQRVVDKLWQGMFNKESKLLIDFIIQLIAQSKRRSQGLSLDAVYHCLNRTILYQFSRAHKTVPQQVALLDSLRVLTVNRNLILGPGNHDQEFISCLAHCLINLHVGSNVDGFGLEAEARMTTWHIMIPSDIEPDGSYSQDISEGRQLLIKAVNRVWTELIHSKKQVLEELFKVTLPVNERGHVDIATARPLIEEAALKCWQNHLAHEKKCISRGEALAPTTQSKLSRVSSGFGLSKLTGSRRNRKESGLNKHSLSTQEISQWMFTHIAVVRDLVDTQYKEYQERQQNALKYVTEEWCQIECELLRERGLWGPPIGSHLDKWMLEMTEGPCRMRKKMVRNDMFYNHYPYVPETEQETNVASEIPSKQPETPDDIPQKKPARYRRAVSYDSKEYYMRLASGNPAIVQDAIVESSEGEAAQQEPEHGEDTIAKVKGLVKPPLKRSRSAPDGGDEENQEQLQDQIAEGSSIEEEEKTDNATLLRLLEEGEKIQHMYRCARVQGLDTSEGLLLFGKEHFYVIDGFTMTATREIRDIETLPPNMHEPIIPRGARQGPSQLKRTCSIFAYEDIKEVHKRRYLLQPIAVEVFSGDGRNYLLAFQKGIRNKVYQRFLAVVPSLTDSSESVSGQRPNTSVEQGSGLLSTLVGEKSVTQRWERGEISNFQYLMHLNTLAGRSYNDLMQYPVFPWILADYDSEEVDLTNPKTFRNLAKPMGAQTDERLAQYKKRYKDWEDPNGETPAYHYGTHYSSAMIVASYLVRMEPFTQIFLRLQGGHFDLADRMFHSVREAWYSASKHNMADVKELIPEFFYLPEFLFNSNNFDLGCKQNGTKLGDVILPPWAKGDPREFIRVHREALECDYVSAHLHEWIDLIFGYKQQGPAAVEAVNVFHHLFYEGQVDIYNINDPLKETATIGFINNFGQIPKQLFKKPHPPKRVRSRLNGDNAGISVLPGSTSDKIFFHHLDNLRPSLTPVKELKEPVGQIVCTDKGILAVEQNKVLIPPTWNKTFAWGYADLSCRLGTYESDKAMTVYECLSEWGQILCAICPNPKLVITGGTSTVVCVWEMGTSKEKAKTVTLKQALLGHTDTVTCATASLAYHIIVSGSRDRTCIIWDLNKLSFLTQLRGHRAPVSALCINELTGDIVSCAGTYIHVWSINGNPIVSVNTFTGRSQQIICCCMSEMNEWDTQNVIVTGHSDGVVRFWRMEFLQVPETPAPEPAEVLEMQEDCPEAQIGQEAQDEDSSDSEADEQSISQDPKDTPSQPSSTSHRPRAASCRATAAWCTDSGSDDSRRWSDQLSLDEKDGFIFVNYSEGQTRAHLQGPLSHPHPNPIEVRNYSRLKPGYRWERQLVFRSKLTMHTAFDRKDNAHPAEVTALGISKDHSRILVGDSRGRVFSWSVSDQPGRSAADHWVKDEGGDSCSGCSVRFSLTERRHHCRNCGQLFCQKCSRFQSEIKRLKISSPVRVCQNCYYNLQHERGSEDGPRNC

SEQ ID NO: 15957 - protein, 3509 aa, Artificial Sequence
  Description of Artificial Sequence: Synthetic coding sequence
MNMVKRIMGRPRQEECSPQDNALGLMHLRRLFTELCHPPRHMTQKEQEEKLYMMLPVFNRVFGNAPPNTMTEKFSDLLQFTTQVSRLMVTEIRRRASNKSTEAASRAIVQFLEINQSEEASRGWMLLTTINLLASSGQKTVDCMTTMSVPSTLVKCLYLFFDLPHVPEAVGGAQNELPLAERRGLLQKVFVQILVKLCSFVSPAEELAQKDDLQLLFSAITSWCPPYNLPWRKSAGEVLMTISRHGLSVNVVKYIHEKECLSTCVQNMQQSDDLSPLEIVEMFAGLSCFLKDSSDVSQTLLDDFRIWQGYNFLCDLLLRLEQAKEAESKDALKDLVNLITSLTTYGVSELKPAGITTGAPFLLPGFAVPQPAGKGHSVRNVQAFAVLQNAFLKAKTSFLAQIILDAITNIYMADNANYFILESQHTLSQFAEKISKLPEVQNKYFEMLEFVVFSLNYIPCKELISVSILLKSSSSYHCSIIAMKTLLKFTRHDYIFKDVFREVGLLEVMVNLLHKYAALLKDPTQALNEQGDSRNNSSVEDQKHLALLVMETLTVLLQGSNTNAGIFREFGGARCAHNIVKYPQCRQHALMTIQQLVLSPNGDDDMGTLLGLMHSAPPTELQLKTDILRALLSVLRESHRSRTVFRKVGGFVYITSLLVAMERSLSCPPKNGWEKVNQNQVFELLHTVFCTLTAAMRYEPANSHFFKTEIQYEKLADAVRFLGCFSDLRKISAMNVFPSNTQPFQRLLEEDVISIESVSPTLRHCSKLFIYLYKVATDSFDSRAEQIPPCLTSESSLPSPWGTPALSRKRHAYHSVSTPPVYPPKNVADLKLHVTTSSLQSSDAVIIHPGAMLAMLDLLASVGSVTQPEHALDLQLAVANILQSLVHTERNQQVMCEAGLHARLLQRCSAALADEDHSLHPPLQRMFERLASQALEPMVLREFLRLASPLNCGAWDKKLLKQYRVHKPSSLSYEPEMRSSMITSLEGLGTDNVFSLHEDNHYRISKSLVKSAEGSTVPLTRVKCLVSMTTPHDIRLHGSSVTPAFVEFDTSLEGFGCLFLPSLAPHNAPTNNTVTTGLIDGAVVSGIGSGERFFPPPSGLSYSSWFCIEHFSSPPNNHPVRLLTVVRRANSSEQHYVCLAIVLSAKDRSLIVSTKEELLQNYVDDFSEESSFYEILPCCARFRCGELIIEGQWHHLVLVMSKGMLKNSTAALYIDGQLVNTVKLHYVHSTPGGSGSANPPVVSTVYAYIGTPPAQRQIASLVWRLGPTHFLEEVLPSSNVTTIYELGPNYVGSFQAVCMPCKDAKSEGVVPSPVSLVPEEKVSFGLYALSVSSLTVARIRKVYNKLDSKAIAKQLGISSHENATPVKLIHNSAGHLNGSARTIGAALIGYLGVRTFVPKPVATTLQYVGGAAAILGLVAMASDVEGLYAAVKALVCVVKSNPLASKEMERIKGYQLLAMLLKKKRSLLNSHILHLTFSLVGTVDSGHETSIIPNSTAFQDLLCDFEVWLHAPYELHLSLFEHFIELLTESSEASKNAKLMREFQLIPKLLLTLRDMSLSQPTIAAISNVLSFLLQGFPSSNDLLRFGQFISSTLPTFAVCEKFVVMEINNEEKLDTGTEEEFGGLVSANLILLRNRLLDILLKLIYTSKEKTSINLQACEELVKTLGFDWIMMFMEEHLHSTTVTAAMRILVVLLSNQSILIKFKEGLSGGGWLEQTDSVLTNKIGTVLGFNVGRSAGGRSTVREINRDACHFPGFPVLQSFLPKHTNVPALYFLLMALFLQQPVSELPENLQVSVPVISCRSKQGCQFDLDSIWTFIFGVPASSGTVVSSIHNVCTEAVFLLLGMLRSMLTSPWQSEEEGSWLREYPVTLMQFFRYLYHNVPDLASMWMSPDFLCALAATVFPFNIRPYSEMVTDLDDEVGSPAEEFKAFAADTGMNRSQSEYCNVGTKTYLTNHPAKKFVFDFMRVLIIDNLCLTPASKQTPLIDLLLEASPERSTRTQQKEFQTYILDSVMDHLLAADVLLGEDASLPITSGGSYQVLVNNVFYFTQRVVDKLWQGMFNKESKLLIDFIIQLIAQSKRRSQGLSLDAVYHCLNRTILYQFSRAHKTVPQQVALLDSLRVLTVNRNLILGPGNHDQEFISCLAHCLINLHVGSNVDGFGLEAEARMTTWHIMIPSDIEPDGSYSQDISEGRQLLIKAVNRVWTELIHSKKQVLEELFKVTLPVNERGHVDIATARPLIEEAALKCWQNHLAHEKKCISRGEALAPTTQSKLSRVSSGFGLSKLTGSRRNRKESGLNKHSLSTQEISQWMFTHIAVVRDLVDTQYKEYQERQQNALKYVTEEWCQIECELLRERGLWGPPIGSHLDKWMLEMTEGPCRMRKKMVRNDMFYNHYPYVPETEQETNVAKPARYRRAVSYDSKEYYMRLASGNPAIVQDAIVESSEGEAAQQEPEHGEDTIAKVKGLVKPPLKRSRSAPDGGDEENQEQLQDQIAEGSSIEEEEKTDNATLLRLLEEGEKIQHMYRCARVQGLDTSEGLLLFGKEHFYVIDGFTMTATREIRDIETLPPNMHEPIIPRGARQGPSQLKRTCSIFAYEDIKEVHKRRYLLQPIAVEVFSGDGRNYLLAFQKGIRNKVYQRFLAVVPSLTDSSESVSGQRPNTSVEQGSGLLSTLVGEKSVTQRWERGEISNFQYLMHLNTLAGRSYNDLMQYPVFPWILADYDSEEVDLTNPKTFRNLAKPMGAQTDERLAQYKKRYKDWEDPNGETPAYHYGTHYSSAMIVASYLVRMEPFTQIFLRLQGGHFDLADRMFHSVREAWYSASKHNMADVKELIPEFFYLPEFLFNSNNFDLGCKQNGTKLGDVILPPWAKGDPREFIRVHREALECDYVSAHLHEWIDLIFGYKQQGPAAVEAVNVFHHLFYEGQVDIYNINDPLKETATIGFINNFGQIPKQLFKKPHPPKRVRSRLNGDNAGISVLPGSTSDKIFFHHLDNLRPSLTPVKELKEPVGQIVCTDKGILAVEQNKVLIPPTWNKTFAWGYADLSCRLGTYESDKAMTVYECLSEWGQILCAICPNPKLVITGGTSTVVCVWEMGTSKEKAKTVTLKQALLGHTDTVTCATASLAYHIIVSGSRDRTCIIWDLNKLSFLTQLRGHRAPVSALCINELTGDIVSCAGTYIHVWSINGNPIVSVNTFTGRSQQIICCCMSEMNEWDTQNVIVTGHSDGVVRFWRMEFLQVPETPAPEPAEVLEMQEDCPEAQIGQEAQDEDSSDSEADEQSISQDPKDTPSQPSSTSHRPRAASCRATAAWCTDSGSDDSRRWSDQLSLDEKDGFIFVNYSEGQTRAHLQGPLSHPHPNPIEVRNYSRLKPGYRWERQLVFRSKLTMHTAFDRKDNAHPAEVTALGISKDHSRILVGDSRGRVFSWSVSDQPGRSAADHWVKDEGGDSCSGCSVRFSLTERRHHCRNCGQLFCQKCSRFQSEIKRLKISSPVRVCQNCYYNLQHERGSEDGPRNC

SEQ ID NO: 15958 - protein, 9 aa, Artificial Sequence
  Description of Artificial Sequence: Synthetic coding sequence
MNMVKRIMG

SEQ ID NO: 15959 - protein, 60 aa, Artificial Sequence
  Description of Artificial Sequence: Synthetic coding sequence
MNMVKRIMGRPRQEECSPQDNALGLMHLRRLFTELCHPPRHMTQKEQEEKLYMMLPVFNR

SEQ ID NO: 15960 - protein, 746 aa, Artificial Sequence
  Description of Artificial Sequence: Synthetic coding sequence
MRREFCWDAYSKAAGSRASSPLPRQDRDSFCHQMSFCLTELHLWSLKNTLHIADRDIGIYQYYDKKDPPATEHGNLEKKQKLAESRDYPWTLKNRRPEKLRDSLKELEELMQNSRCVLSKWKNKYVCQLLFGSGVLVSLSLSGPQLEKVVIDRSLVGKLISDTISDALLTDSFIILSFLAQNKLCFIQFTKKMESSDVNKRLEKLSALDYKIFYYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGCEDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLRYQRFEKAFLLAVDVGARDLFMDIHYLALDKGELALAEVARKRASDIDAESITSGVELLGPLDRGDMLNEAFIGLSLAPQGEDSFPDNLPPSCPTHRHILQQRILNGSSNRQIIDRRNELEKDICSGFLMTNTCNAEDGELREDGREQEIRDGGSLKMIHFGLV

SEQ ID NO: 15961 - protein, 913 aa, Artificial Sequence
  Description of Artificial Sequence: Synthetic coding sequence
MASESDTEEFYDAPEDVHLGGGYPVGSPGKVGLSTFKETENTAYKVGNESPVQELKQDVSKKIIESIIEESQKVLQLEDDSLDSKGKELSDQATASPIVARTDLSNIPGLLAIDQVLPEESQKAESQNTFEETELELKKCFPSDETCEKPVDETTKLTQTSSTEQLNVLETETEVLNKEAVEVKGGGDVLEPVSSDSLSTKDFAAVEEVAPAKPPRHLTPEPDIVASTKKPVPARPPPPTNFPPPRPPPPSRPAPPPRKRKSELEFETLKTPDIDVPKENITSDSLLTASMASESTVKDSQPSLDLASATSGDKIVTAQENGKAPDGQTVAGEVMGPQRPRSNSGRELTDEEILASVMIKNLDTGEEIPLSLAEEKLPTGINPLTLHIMRRTKEYVSNDAAQSDDEEKLQSQPTDTDGGRLKQKTTQLKKFLGKSVKRAKHLAEEYGERAINKVKSVRDEVFHTDQDDPSSSDDEGMPYTRPVKFKAAHGFKGPYDFDQIKVVQDLSGEHMGAVWTMKFSHCGRLLASAGQDNVVRIWALKNAFDYFNNMRMKYNTEGRVSPSPSQESLSSSKSDTDTGVCSGTDEDPDDKNAPFRQRPFCKYKGHTADLLDLSWSKNYFLLSSSMDKTVRLWHISRRECLCCFQHIDFVTAIAFHPRDDRYFLSGSLDGKLRLWNIPDKKVALWNEVDGQTKLITAANFCQNGKYAVIGTYDGRCIFYDTEHLKYHTQIHVRSTRGRNKVGRKITGIEPLPGENKILVTSNDSRIRLYDLRDLSLSMKYKGYVNSSSQIKASFSHDFTYLVSGSEDKYVYIWSTYHDLSKFTSVRRDRNDFWEGIKAHNAVVTSAIFAPNPSLMLSLDVQSEKSEGNEKSEDAEVLDATPSGIMKTDNTEVLLSADFTGAIKVFVNKRKNVS

SEQ ID NO: 15962 - protein, 288 aa, Artificial Sequence
  Description of Artificial Sequence: Synthetic coding sequence
WGKNYFLLSSSMDKTVRLWHISRRECLCCFQHIDFVTAIAFHPRDDRYFLSGSLDGKLRLWNIPDKKVALWNEVDGQTKLITAANFCQNGKYAVIGTYDGRCIFYDTEHLKYHTQIHVRSTRGRNKVGRKITGIEPLPGENKILVTSNDSRIRLYDLRDLSLSMKYKGYVNSSSQIKASFSHDFTYLVSGSEDKYVYIWSTYHDLSKFTSVRRDRNDFWEGIKAHNAVVTSAIFAPNPSLMLSLDVQSEKSEGNEKSEDAEVLDATPSGAVAHACNPSTLGGRGRRIT

SEQ ID NO: 15963 - protein, 824 aa, Artificial Sequence
  Description of Artificial Sequence: Synthetic coding sequence
MASESDTEEFYDAPEDVHLGGGYPVGSPGKVGLSTFKIIESIIEESQKVLQLEDDSLDSKGKELSDQATASPIVARTDLSNIPGLLAIDQVLPEESQKAESQNTFEETELELKKCFPSDETCEKPVDETTKLTQTSSTEQLNVLETETEVLNKEAVEVKGGGDVLEPVSSDSLSTKDFAAVEEVAPAKPPRHLTPEPDIVASTKKPVPARPPPPTNFPPPRPPPPSRPAPPPRKRKSELEFETLKTPDIDVPKENITSDSLLTASMASESTVKDSQPSLDLASATSGDKIVTAQENGKAPDGQTVAGEVMGPQRPRSNSGRELTDEEILASVMIKNLDTGEEIPLSLAEEKLPTGINPLTLHIMRRTKEYVSNDAAQSDDEEKLQSQPTDTDGGRLKQKTTQLKKFLGKSVKRAKHLAEEYGERAINKVKSVRDEVFHTDQDDPSSSDDEGMPYTRPVKFKAAHGFKGPYDFDQIKVVQDLSGEHMGAVWTMKFSHCGRLLASAGQDNVVRIWALKNAFDYFNNMRMKYNTEGRVSPSPSQESLSSSKSDTDTGVCSGTDEDPDDKNAPFRQRPFCKYKGHTADLLDLSWSKNYFLLSSSMDKTVRLWHISRRECLCCFQHIDFVTAIAFHPRHLKYHTQIHVRSTRGRNKVGRKITGIEPLPGENKILVTSNDSRIRLYDLRDLSLSMKYKGYVNSSSQIKASFSHDFTYLVSGSEDKYVYIWSTYHDLSKFTSVRRDRNDFWEGIKAHNAVVTSAIFAPNPSLMLSLDVQSEKSEGNEKSEDAEVLDATPSGIMKTDNTEVLLSADFTGAIKVFVNKRKNVS

SEQ ID NO: 15964 - protein, 905 aa, Artificial Sequence
  Description of Artificial Sequence: Synthetic coding sequence
MASESDTEEFYDAPEDVHLGGGYPVGSPGKVGLSTFKETENTAYKVGNESPVQELKQDVSKKIIESIIEESQKVLQLEDDSLDSKGKELSDQATASPIVARTDLSNIPGLLAIDQVLPEESQKAESQNTFEETELELKKCFPSDETCEKPVDETTKLTQTSSTEQLNVLETETEVLNKEAVEVKGGGDVLEPVSSDSLSTKDFAAVEEVAPAKPPRHLTPEPDIVASTKKPVPARPPPPTNFPPPRPPPPSRPAPPPRKRKSELEFETLKTPDIDVPKENITSDSLLTASMASESTVKDSQPSLDLASATSGDKIVTAQENGKAPDGQTVAGEVMGPQRPRSNSGRELTDEEILASVMIKNLDTGEEIPLSLAEEKLPTGINPLTLHIMRRTKEYVSNDAAQSDDEEKLQSQPTDTDGGRLKQKTTQLKKFLGKSVKRAKHLAEEYGERAINKVKSVRDEVFHTDQDDPSSSDDEGMPYTRPVKFKAAHGFKGPYDFDQIKVVQDLSGEHMGAVWTMKFSHCGRLLASAGQDNVVRIWALKNAFDYFNNMRMKYNTEGRVSPSPSQESLSSSKSDTDTGVCSGTDEDPDDKNAPFRQRPFCKYKGHTADLLDLSWSKNYFLLSSSMDKTVRLWHISRRECLCCFQHIDFVTAIAFHPRDDRYFLSGSLDGKLRLWNIPDKKVALWNEVDGQTKLITAANFCQNGKYAVIGTYDGRCIFYDTEHLKYHTQIHVRSTRGRNKVGRKITGIEPLPGENKILVTSNDSRIRLYDLRDLSLSMKYKGYVNSSSQIKASFSGSEDKYVYIWSTYHDLSKFTSVRRDRNDFWEGIKAHNAVVTSAIFAPNPSLMLSLDVQSEKSEGNEKSEDAEVLDATPSGIMKTDNTEVLLSADFTGAIKVFVNKRKNVS

SEQ ID NO: 15965 - protein, 806 aa, Artificial Sequence
  Description of Artificial Sequence: Synthetic coding sequence
  MOD_RES (1)..(1): Any amino acid
XTDLSNIPGLLAIDQVLPEESQKAESQNTFEETELELKKCFPSDETCEKPVDETTKLTQTSSTEQLNVLETETEVLNKEAVEVKGGGDVLEPVSSDSLSTKDFAAVEEVAPAKPPRHLTPEPDIVASTKKPVPARPPPPTNFPPPRPPPPSRPAPPPRKRKSELEFETLKTPDIDVPKENITSDSLLTASMASESTVKDSQPSLDLASATSGDKIVTAQENGKAPDGQTVAGEVMGPQRPRSNSGRELTDEEILASVMIKNLDTGEEIPLSLAEEKLPTGINPLTLHIMRRTKEYVSNDAAQSDDEEKLQSQPTDTDGGRLKQKTTQLKKFLGKSVKRAKHLAEEYGERAINKVKSVRDEVFHTDQDDPSSSDDEGMPYTRPVKFKAAHGFKGPYDFDQIKVVQDLSGEHMGAVWTMKFSHCGRLLASAGQDNVVRIWALKNAFDYFNNMRMKYNTEGRVSPSPSQESLSSSKSDTDTGVCSGTDEDPDDKNAPFRQRPFCKYKGHTADLLDLSWSKNYFLLSSSMDKTVRLWHISRRECLCCFQHIDFVTAIAFHPRDDRYFLSGSLDGKLRLWNIPDKKVALWNEVDGQTKLITAANFCQNGKYAVIGTYDGRCIFYDTEHLKYHTQIHVRSTRGRNKVGRKITGIEPLPGENKILVTSNDSRIRLYDLRDLSLSMKYKGYVNSSSQIKASFSHDFTYLVSGSEDKYVYIWSTYHDLSKFTSVRRDRNDFWEGIKAHNAVVTSAIFAPNPSLMLSLDVQSEKSEGNEKSEDAEVLDATPSAMSSRYVAQAGLELLASKRYYEDR

SEQ ID NO: 15966 - protein, 371 aa, Artificial Sequence
  Description of Artificial Sequence: Synthetic coding sequence
MTQQPLRGVTSLRFNQDQSCFCCAMETGVRIYNVEPLMEKGHLDHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKAAHPTPHLHTLGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 15967 - protein, 361 aa, Artificial Sequence
  Description of Artificial Sequence: Synthetic coding sequence
MTQQPLRGVTSLRFNQDQSCFCCAMETGVRIYNVEPLMEKGHLDHEQVGSMGLVEMLHRSNLLALVGGGSSPKFSEISAVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 15968 - protein, 361 aa, Artificial Sequence; identical to SEQ ID NO: 15967
  Description of Artificial Sequence: Synthetic coding sequence

SEQ ID NO: 15969 - protein, 360 aa, Artificial Sequence
  Description of Artificial Sequence: Synthetic coding sequence
MTQQPLRGVTSLRFNQDQSCFCCAMETGVRIYNVEPLMEKGHLDHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 15970 - protein, 55 aa, Artificial Sequence
  Description of Artificial Sequence: Synthetic coding sequence
MTQQPLRGVTSLRFNQDQSCFCCAMETGVRIYNVEPLMEKGHLDHEQVGSMGLVE

SEQ ID NO: 15971 - protein, 158 aa, Artificial Sequence
  Description of Artificial Sequence: Synthetic coding sequence
MTQQPLRGVTSLRFNQDQSCFCCAMETGVRIYNVEPLMEKGHLDHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKAAHPTPHLHTLGL

SEQ ID NO: 15972 - protein, 292 aa, Artificial Sequence
  Description of Artificial Sequence: Synthetic coding sequence
MTQQPLRGVTSLRFNQDQSCFCCAMETGVRIYNVEPLMEKGHLGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSAYVRPLHTLLSALVVAVALGVLVWAAETRAAVRRCRRSHPAACLAAVLAVGLLVLWVAGGACTFLFSIAGPVLLILVHASLRLRNLKNKIENKIESIGLKRTPMGLLLEALGQEQEAGS

SEQ ID NO: 15973 - protein, 106 aa, Artificial Sequence
  Description of Artificial Sequence: Synthetic coding sequence
MSTNNMSDPRRPNKVLRYKPPPSECNPALDDPTPDYMNLLGMIFSMCGLMLKLKWCAWVAVYCSFISFANSRSSEDTKQMMSSFMLSISAVVMSYLQNPQPMTPPW

SEQ ID NO: 15974 - protein, 106 aa, Artificial Sequence; identical to SEQ ID NO: 15973
  Description of Artificial Sequence: Synthetic coding sequence

SEQ ID NO: 15975 - protein, 686 aa, Artificial Sequence
  Description of Artificial Sequence: Synthetic coding sequence
MSFPRGSQTQKIKHPIGTRKGPLEVPPPTEKDWPKDDEQDHVLVDPDEELDSLPQPYRMINKLVNLLFDQSWEIIEERNALREAESSQIQPTVYPPLGEIQLNKMPNCMAVSQDYVFIGGAKGFSIYNLYSAKQIYAWEKLKVDVTSIWATDLGNEILIAPVDEMGIIRLFYFYKEGLYLVKAINEVDDTSKQTTCIKMEISQGGDFAAFLLQGAGDIWLDVYKLPKETWLKKLEHPQLTSNPKKKVRQPQLNSLGPISADPLEMDANVSFKGDIKLSLPVYIMKIKPPKPVTGTTFKSPLEVFAKIKDCYGLGSGQNHFIKDSQWEQQAEIFNASYKKYLDREWEEEPLSTATFYFLLPSCLFAMPPEVKGPSGMACVLGIHWTRSHNFFLYSLNRTLKDKADPEGVWPCAAPIAVSQLSCSSSYLVLACEDGVLTLWDLAKGFPLGVAALPQGCFCQSIHFLKYFSVHKGQNMYPEGQVKSQMKCVVLCTDASLHLVEASGTQGPTISVLVERPVKHLDKTICAVAPVPALPGMVLIFSKNGSVCLMDVAKREIICAFAPPGAFPLEVPWKPVFAVSPDHPCFLLRGDYSHETASTDDAGIQYSVFYFNFEACPLLENISKNCTIPQRDLDNMAFPQALPLEKRCERFLQKSYRKLEKNPEKEEEHWARLQRYSLSLQRENFKK

SEQ ID NO: 15976 - protein, 658 aa, Artificial Sequence
  Description of Artificial Sequence: Synthetic coding sequence
MSFPRGSQTQKIKHPIGTRKGPLEVPPPTEKDWPKDDEQDHVLVDPDEELDSLPQPYRMINKLVNLLFDQSWEIIEERNALREAESSQIQPTVYPPLGEIQLNKMPNCMAVSQDYVFIGGAKGFSIYNLYSAKQIYAWEKLKVDVTSIWATDLGNEILIAPVDEMGIIRLFYFYKEGLYLVKAINEVDDTSKQTTCIKMEISQGGDFAAFLLQGAGDIWLDVYKLPKETWLKKLEHPQLTSNPKKKVRQPQLNSLGPISADPLEMDANVSFKGDIKLSLPVYIMKIKPPKPVTGTTFKSPLEVFAKIKDCYGLGSGQNHFIKDSQWEQQAEIFNASYKKYLDREWEEEPLSTATFYFLLPSCLFAMPPEVKGPSGMACVLGIHWTRSHNFFLYSLNRTLKDKADPEGVWPCAAPIAVSQLSCSSSYLVLACEDGVLTLWDLAKGQNMYPEGQVKSQMKCVVLCTDASLHLVEASGTQGPTISVLVERPVKHLDKTICAVAPVPALPGMVLIFSKNGSVCLMDVAKREIICAFAPPGAFPLEVPWKPVFAVSPDHPCFLLRGDYSHETASTDDAGIQYSVFYFNFEACPLLENISKNCTIPQRDLDNMAFPQALPLEKRCERFLQKSYRKLEKNPEKEEEHWARLQRYSLSLQRENFKK

SEQ ID NO: 15977 - protein, 446 aa, Artificial Sequence
  Description of Artificial Sequence: Synthetic coding sequence
MEAEAADAPPGGVESALSCFSFNQDCTSLATGTKAGYKLFSLSSVEQLDQVHGSNEIPDVYIVERLFSSSLVVVVSHTKPRQMNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 15978 - protein, 364 aa, Artificial Sequence
  Description of Artificial Sequence: Synthetic coding sequence
MNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 15979 - protein, 454 aa, Artificial Sequence
  Description of Artificial Sequence: Synthetic coding sequence
MNLASQSGEAGAGQLLFANFNQDNTEVKGASRAAGLGRRAVVWSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKGTYVPSSPTRLAYTDDLGAVGGACLEDEASALRLDEDSEHPPMILRTD

SEQ ID NO: 15980 - protein, 437 aa, Artificial Sequence
  Description of Artificial Sequence: Synthetic coding sequence
MLLRLQRIKTLRPPGCPHPMTTCSAGTLSAVPCVSPRQVFVFERRFCLWSHVEMFTHVLPFVISADTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKAYTDDLGAVGGACLEDEASALRLDEDSEHPPMILRTD

SEQ ID NO: 15981 - protein, 425 aa, Artificial Sequence
  Description of Artificial Sequence: Synthetic coding sequence
MNLASQSGEAGAGQLLFANFNQDNTSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKAYTDDLGAVGGACLEDEASALRLDEDSEHPPMILRTD

SEQ ID NO: 15982 - protein, 436 aa, Artificial Sequence
  Description of Artificial Sequence: Synthetic coding sequence
MNLASQSGEAGAGQLLFANFNQDNTSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKGTYVPSSPTRLAYTDDLGAVGGACLEDEASALRLDEDSEHPPMILRTD

SEQ ID NO: 15983 - protein, 443 aa, Artificial Sequence
  Description of Artificial Sequence: Synthetic coding sequence
MNLASQSGEAGAGQLLFANFNQDNTEVKGASRAAGLGRRAVVWSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKAYTDDLGAVGGACLEDEASALRLDEDSEHPPMILRTD

SEQ ID NO: 15984 - protein, 384 aa, Artificial Sequence
  Description of Artificial Sequence: Synthetic coding sequence
MFTHVLPFVISADTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKAYTDDLGAVGGACLEDEASALRLDEDSEHPPMILRTD

SEQ ID NO: 15985 - protein, 344 aa, Artificial Sequence
  Description of Artificial Sequence: Synthetic coding sequence
MNLLPCNPHGNGLLYAGFNQDHGCFACGMENGFRVYNTDPLKEKEKQEFLEGGVGHVEMLFRCNYLALVGGGKKPKYPPNKVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGTLIRIFDTSSGHLIQELRRGSQAANIYCINFNQDASLICVSSDHGTVHIFAAEDPKRNKQSSLASASFLPKYFSSKWSFSKFQVPSGSPCICAFGTEPNAVIAICADGSYYKFLFNPKGECIRDVYAQFLEMTDDKL

SEQ ID NO: 15986 - protein, 316 aa, Artificial Sequence
  Description of Artificial Sequence: Synthetic coding sequence
MENGFRVYNTDPLKEKEKQEFLEGGVGHVEMLFRCNYLALVGGGKKPKYPPNKVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGTLIRIFDTSSGHLIQELRRGSQAANIYCINFNQDASLICVSSDHGTVHIFAAEDPKRNKQSSLASASFLPKYFSSKWSFSKFQVPSGSPCICAFGTEPNAVIAICADGSYYKFLFNPKGECIRDVYAQFLEMTDDKL

SEQ ID NO: 15987 - protein, 464 aa, Artificial Sequence
  Description of Artificial Sequence: Synthetic coding sequence
MALVALVAGARLGRRLSGPGLGRGHWTAARRSRSRREAAEAEAEVPVVQYVGERAARADRVFVWGFSFSGALGVPSFVVPSSGPGPRAGARPRRRIQPVPYRLELDQKISSAACGYGFTLLSSKTADVTKVWGMGLNKDSQLGFHRSRKDKTRGYEYVLEPSPVSLPLDRPQETRVLQVSCGRAHSLVLTDREGVFSMGNNSYGQCGRKVVENEIYSESHRVHRMQDFDGQVVQVACGQDHSLFLTDKGEVYSCGWGADGQTGLGHYNITSSPTKLGGDLAGVNVIQVATYGDCCLAVSADGGLFGWGNSEYLQLASVTDSTQVNVPRCLHFSGVGKVRQAACGGTGCAVLNGEGHVFVWGYGILGKGPNLVESAVPEMIPPTLFGLTEFNPEIQVSRIRCGLSHFAALTNKGELFVWGKNIRGCLGIGRLEDQYFPWRVTMPGEPVDVACGVDHMVTLAKSFI

SEQ ID NO: 15988 - protein, 454 aa, Artificial Sequence [sequence omitted]

SEQ ID NO: 15989 - protein, 358 aa, Artificial Sequence [sequence omitted]

SEQ ID NO: 15990 - protein, 598 aa, Artificial Sequence
  Description of Artificial Sequence: Synthetic coding sequence
MASLRRVKVLLVLNLIAVAGFVLFLAKCRPIAVRSGDAFHEIRPRAEVANLSAHSASPIQDAVLKRLSLLEDIVYRQLNGLSKSLGLIEGYGGRGKGGLPATLSPAEEEKAKGPHEKYGYNSYLSEKISLDRSIPDYRPTKCKELKYSKDLPQISIIFIFVNEALSVILRSVHSAVNHTPTHLLKEIILVDDNSDEEELKVPLEEYVHKRYPGLVKVVRNQKREGLIRARIEGWKVATGQVTGFFDAHVEFTAGWAEPVLSRIQENRKRVILPSIDNIKQDNFEVQRYENSAHGYSWELWCMYISPPKDWWDAGDPSLPIRTPAMIGCSFVVNRKFFGEIGLLDPGMDVYGGENIELGIKVWLCGGSMEVLPCSRVAHIERKKKPYNSNIGFYTKRNALRVAEVWMDDYKSHVYIAWNLPLENPGIDIGDVSERRALRKSLKCKNFQWYLDHVYPEMRRYNNTVAYGELRNNKAKDVCLDQGPLENHTAILYPCHGWGPQLARYTKEGFLHLGALGTTTLLPDTRCLVDNSKSRLPQLLDCDKVKSSLYKRWNFIQNGAIMNKGTGRCLEVENRGLAGIDLILRSCTGQRWTIKNSIK

SEQ ID NO: 15991 - protein, 575 aa, Artificial Sequence
  Description of Artificial Sequence: Synthetic coding sequence
MAKPFFRLQKFLRRTQFLLFFLTAAYLMTGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGTYIGCFSDDGHERTLKGAVFYDLRKMTVSHCQDACAERSYVYAGLEAGAECYCGNRLPAVSVGLEECNHECKGEKGSVCGAVDRLSVYRVDELQPGSRKRRTATYRGCFRLPENITHAFPSSLIQANVTVGTCSGFCSQKEFPLAILRGWECYCAYPTPRFNLRDAMDSSVCGQDPEAQRLAEYCEVYQTPVQDTRCTDRRFLPNKSKVFVALSSFPGAGNTWARHLIEHATGFYTGSYYFDGTLYNKGFKGEKDHWRSRRTICVKTHESGRREIEMFDSAILLIRNPYRSLVAEFNRKCAGHLGYAADRNWKSKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 15992 - protein, 575 aa, Artificial Sequence; identical to SEQ ID NO: 15991
  Description of Artificial Sequence: Synthetic coding sequence

SEQ ID NO: 15993 - protein, 585 aa, Artificial Sequence
  Description of Artificial Sequence: Synthetic coding sequence
MAKLWFKFQRYFRRKPVRFFTFLALYLTAGSLVFLHSGFVGQPAVSGNQANPAAAGGPAEGAELSFLGDMHLGRGFRDTGEASSIARRYGPWFKGKDGNERAKLGDYGGAWSRALKGRVVREKEEERAKYIGCYLDDTQSRALRGVSFFDYKKMTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAGTACHCGFPTTRFPLHDREDEQLCAQKCSAEEFESCGTPSYFIVYQTQVQDNRCMDRRFLPGKSKQLIALASFPGAGNTWARHLIELATGFYTGSYYFDGSLYNKGFKGERDHWRSGRTICIKTHESGQKEIEAFDAAILLIRNPYKALMAEFNRKYGGHIGFAAHAHWKGKGAVPGSLQILFRSICTASVGEWPEFVRNYAPWWATHTLDWLKFGKKVLVVHFEDLKQDLFVQLGRMVSLLGVAVREDRLLCVESQKDGNFKRSGLRKLEYDPYTADMQKTISAYIKMVDAALKGRNLTGVPDDYYPR

SEQ ID NO: 15994 - protein, 565 aa, Artificial Sequence
  Description of Artificial Sequence: Synthetic coding sequence
MAKLWFKFQRYFRRKPVRFFTFLALYLTAGSLVFLHSGFVGQPAVSGNQANPAAAGGPAEGAELSFLGDMHLGRGFRDTGEASSIARRYGPWFKGKDGNERAKLGDYGGAWSRALKGRVVREKEEERAKYIGCYLDDTQSRALRGVSFFDYKKMTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAGTACHCGFPTTRFPLHDREDEQLCAQKCSAEEFESCGTPSYFIVYQTQVQDNRCMDRRFLPGKSKQLIALASFPGAGNTWARHLIELATGFYTGSYYFDGSLYNKGFKGERDHWRSGRTICIKTHESGQKEIEAFDAAILLIRNPYKALMAEFNRKYGGHIGFAAHAHWKGKEWPEFVRNYAPWWATHTLDWLKFGKKVLVVHFEDLKQDLFVQLGRMVSLLGVAVREDRLLCVESQKDGNFKRSGLRKLEYDPYTADMQKTISAYIKMVDAALKGRNLTGVPDDYYPR

SEQ ID NO: 15995 - protein, 565 aa, Artificial Sequence; identical to SEQ ID NO: 15994
  Description of Artificial Sequence: Synthetic coding sequence

SEQ ID NO: 15996 - protein, 585 aa, Artificial Sequence; identical to SEQ ID NO: 15993
  Description of Artificial Sequence: Synthetic coding sequence

SEQ ID NO: 15997 - protein, 1843 aa, Artificial Sequence
  Description of Artificial Sequence: Synthetic coding sequence
MADTQTQVAPTPTMRMATAEDLPLPPPPALEDLPLPPPKESFSKFHQQRQASELRRLYRHIHPELRKNLAEAVAEDLAEVLGSEEPTEGDVQCMRWIFENWRLDAIGEHERPAAKEPVLCGDVQATSRKFEEGSFANSTDQEPTRPQPGGGDVRAARWLFETKPLDELTGQAKELEATVREPAASGDVQGTRMLFETRPLDRLGSRPSLQEQSPLELRSEIQELKGDVKKTVKLFQTEPLCAIQDAEGAIHEVKAACREEIQSNAVRSARWLFETRPLDAINQDPSQVRVIRGISLEEGARPDVSATRWIFETQPLDAIREILVDEKDFQPSPDLIPPGPDVQQQQHLFETRALDTLKGDEEAGAEAPPKEEVVPGDVRSTLWLFETKPLDAFRDKVQVGHLQRVDPQDGEGHLSSDSSSALPFSQSAPQRDELKGDVKTFKNLFETLPLDSIGQGEVLAHGSPSREEGTDSAGQAQGIGSPVYAMQDSKGRLHALTSVSREQIVGGDVQGYRWMFETQPLDQLGRSPSTIDVVRGITRQEVVAGDVGTARWLFETQPLEMIHQREQQERQKEEGKSQGDPQPEAPPKGDVQTIRWLFETCPMSELAEKQGSEVTDPTAKAEAQSCTWMFKPQPVDRPVGSREQHLQVSQVPAGERQTDRHVFETEPLQASGRPCGRRPVRYCSRVEIPSGQVSRQKEVFQALEAGKKEEQEPRVIAGSIPAGSVHKFTWLFENCPMGSLAAESIQGGNLLEEQPMSPSGNRMQESQETAAEGTLRTLHATPGILHHGGILMEARGPGELCLAKYVLSGTGQGHPYIRKEELVSGELPRIICQVLRRPDVDQQGLLVQEDPTGQLQLKPLRLPTPGSSGNIEDMDPELQQLLACGLGTSVARTGLVMQETEQGLVALTAYSLQPRLTSKASERSSVQLLASCIDKGDLSGLHSLRWEPPADPSPVPASEGAQSLHPTESIIHVPPLDPSMGMGHLRASGATPCPPQAIGKAVPLAGEAAAPAQLQNTEKQEDSHSGQKGMAVLGKSEGATTTPPGPGAPDLLAAMQSLRMATAEAQSLHQQVLNKHKQGPTPTATSNPIQDGLRKAGATQSNIRPGGGSDPRIPAAPRKVSREEQALPRGLPGGWVTIQDGIYTAHPVRTFDPPGGVQLSQREPQSRHRETALSVQAPRPLQGGPGQSTGPGREEPGGCTQMAWGPPGKAMAEVCPGGLQAAETTLKTAPLGRHILASGPQAAGASPHPHNAFVPPPPTLPAAVTGPDFPAGAHRAEDSIQQASEPLKDPLLHSHSSPAGQRTPGGSQTKTPKLDPTMPPKKKPQLPPKPAHLTQSHPPQRLPKPLPLSPSFSSEVGQREHQRGERDTAIPQPAKVPTTVDQGHIPLARCPSGHSQPSLQHGLSTTAPRPTKNQATGSNAQSSEPPKLNALNHDPTSPQWGPGPSGEQPMEGSHQGAPESPDSLQRNQKELQGLLNQVQALEKEAASSVDVQALRRLFEAVPQLGGAAPQAPAAHQKPEASVEQAFGELTRVSTEVAQLKEQTLARLLDIEEAVHKALSSMSSLQPEASARGHFQGPPKDHSAHKISVTVSSSARPSGSGQEVGGQTAVKNQAKVECHTEAQSQVKIRNHTEARGHTASTAPSTRRQETSREYLCPPRVLPSSRDSPSSPTFISIQSATRKPLETPSFKGNPDVSVKSTQLAQDIGQALLHQKGVQDKTGKKDITQCSVQPEPAPPSASPLPRGWQKSVLELQTGPGSSQHYGAMRTVTEQYEEVDQFGNTVLMSSTTVTEQAEPPRNPGSHLGLHASPLLRQFLHSPAGFSSDLTEAETVQVSCSYSQPAAQ

SEQ ID NO: 15998 - protein, 1121 aa, Artificial Sequence
  Description of Artificial Sequence: Synthetic coding sequence
MADTQTQVAPTPTMRMATAEDLPLPPPPALEDLPLPPPKESFSKFHQQRQASELRRLYRHIHPELRKNLAEAVAEDLAEVLGSEEPTEGDVQCMRWIFENWRLDAIGEHERPAAKEPVLCGDVQATSRKFEEGSFANSTDQEPTRPQPGGGDVRAARWLFETKPLDELTGQAKELEATVREPAASGDVQGTRMLFETRPLDRLGSRPSLQEQSPLELRSEIQELKGDVKKTVKLFQTEPLCAIQDAEGAIHEVKAACREEIQSNAVRSARWLFETRPLDAINQDPSQVRVIRGISLEEGARPDVSATRWIFETQPLDAIREILVDEKDFQPSPDLIPPGPDVQQQQHLFETRALDTLKGDEEAGAEAPPKEEVVPGDVRSTLWLFETKPLDAFRDKVQVGHLQRVDPQDGEGHLSSDSSSALPFSQSAPQRDELKGDVKTFKNLFETLPLDSIGQGEVLAHGSPSREEGTDSAGQAQGIGSPVYAMQDSKGRLHALTSVSREQIVGGDVQGYRWMFETQPLDQLGRSPSTIDVVRGITRQEVVAGDVGTARWLFETQPLEMIHQREQQERQKEEGKSQGDPQPEAPPKGDVQTIRWLFETCPMSELAEKQGSEVTDPTAKAEAQSCTWMFKPQPVDRPVGSREQHLQVSQVPAGERQTDRHVFETEPLQASGRPCGRRPVRYCSRVEIPSGQVSRQKEVFQALEAGKKEEQEPRVIAGSIPAGSVHKFTWLFENCPMGSLAAESIQGGNLLEEQPMSPSGNRMQESQETAAEGTLRTLHATPGILHHGGILMEARGPGELCLAKYVLSGTGQGHPYIRKEELVSGELPRIICQVLRRPDVDQQGLLVQEDPTGQLQLKPLRLPTPGSSGNIEDMDPELQQLLACGLGTSVARTGLVMQETEQGLVALTAYSLQPRLTSKASERSSVQLLASCIDKGDLSGLHSLRWEPPADPSPVPASEGAQSLHPTESIIHVPPLDPSMGMGHLRASGATPCPPQAIGKAVPLAGEAAAPAQLQNTEKQEDSHSGQKGMAVLGKSEGATTTPPGPGAPDLLAAMQSLRMATAEAQSLHQQVLNKHKQGPTPTATSNPIQDGLRKAGATQSNIRPGGGSDPRIPAAPRKLL

SEQ ID NO: 15999 - protein, 526 aa, Artificial Sequence
  Description of Artificial Sequence: Synthetic coding sequence
MPPKKKPQLPPKPAHLTQSHPPQRLPKPLPLSPSFSSEVGQREHQRGERDTAIPQPAKVPTTVDQGHIPLARCPSGHSQPSLQHGLSTTAPRPTKNQATGSNAQSSEPPKLNALNHDPTSPQWGPGPSGEQPMEGSHQGAPESPDSLQRNQKELQGLLNQVQALEKEAASSVDVQALRRLFEAVPQLGGAAPQAPAAHQKPEASVEQAFGELTRVSTEVAQLKEQTLARLLDIEEAVHKALSSMSSLQPEASARGHFQGPPKDHSAHKISVTVSSSARPSGSGQEVGGQTAVKNQAKVECHTEAQSQVKIRNHTEARGHTASTAPSTRRQETSREYLCPPRVLPSSRDSPSSPTFISIQSATRKPLETPSFKGNPDVSVKSTQLAQDIGQALLHQKGVQDKTGKKDITQCSVQPEPAPPSASPLPRGWQKSVLELQTGPGSSQHYGAMRTVTEQYEEVDQFGNTVLMSSTTVTEQAEPPRNPGSHLGLHASPLLRQFLHSPAGFSSDLTEAETVQVSCSYSQPAAQ

SEQ ID NO: 16000 - protein, 650 aa, Artificial Sequence
  Description of Artificial Sequence: Synthetic coding sequence
MAAKSDGRLKMKKSSDVAFTPLQNSDHSGSVQGLAPGLPSGSGAEDEEAAGGGCCPDGGGCSRCCCCCAGSGGSAGSGGSGGVAGPGGGGAGSAALCLRLGREQRRYSLWDCLWILAAVAVYFADVGTDVWLAVDYYLRGQRWWFGLTLFFVVLGSLSVQVFSFRWFVHDFSTEDSATAAAASSCPQPGADCKTVVGGGSAAGEGEARPSTPQRQASNASKSNIAAANSGSNSSGATRASGKHRSASCSFCIWLLQSLIHILQLGQIWRYFHTIYLGIRSRQSGENDRWRFYWKMVYEYADVSMLHLLATFLESAPQLVLQLCIIVQTHSLQALQGFTAAASLVSLAWALASYQKALRDSRDDKKPISYMAVIIQFCWHFFTIAARVITFALFASVFQLYFGIFIVLHWCIMTFWIVHCETEFCITKWEEIVFDMVVGIIYIFSWFNVKEGRTRCRLFIYYFVILLENTALSALWYLYKAPQIADAFAIPALCVVFSSFLTGVVFMLMYYAFFHPNGPRFGQSPSCACEDPAAAFTLPPDVATSTLRSISNNRSVVSDRDQKFAERDGCVPVFQVRPTAPSTPSSRPPRIEESVIKIDLFRNRYPAWERHVLDRSLRKAILAFECSPSPPRLQYKDDALIQERLEYETTL

SEQ ID NO: 16001 - protein, 650 aa, Artificial Sequence; identical to SEQ ID NO: 16000
  Description of Artificial Sequence: Synthetic coding sequence

SEQ ID NO: 16002 - protein, 362 aa, Artificial Sequence
  Description of Artificial Sequence: Synthetic coding sequence
MMYEYADVNMLRLLETFLESAPQLVLQLYIMLQKNSAETLPCVSSVTSLMSLAWVLASYHKLLRDSRDDKKSMSYRGAIIQVFWRLFTISSRVISFALFASIFQLYFGIFVVVHWCAMAFWIIHGGTDFCMSKWEEILFNMVVGIVYIFCWFNVKEGRTRYRMFAYYTIVLTENAALTFLWYFYRDPETTDSYAVPALCCVFISFVAGIAMMLLYYGVLHPTGPRAKILASSCCAELLWGIPLPPDVEPMAPEIPGYRGTQVTPTRAVTEQQEDLTADTCLPVFQVRPMGPPTPLGRPYLPEGPLIKIDMPRKRYPAWDAHFVDRRLRRTINILQYVTPTAVGIRYRDGPLLYELLQYESSL

SEQ ID NO: 16003 - protein, 641 aa, Artificial Sequence
  Description of Artificial Sequence: Synthetic coding sequence
MAAKSDGGGVGVGFAQLHNLDEAVGSGGEEDGEPGGGGCGGGGDGSEPGESSSMHICHCCNTSSCYWGCRSACLRSLLGRKPRRSAAADGGDQPLQPPAAPGAGRQPPTPSAARPEPPPPQVERPWLDCLWIVLALLVFFGDVGTDLWLALDYYRKGDYVYFGLTLFFVLVPSLLVQSLSFRWFVQDYTGGGLGAVEGLTSRGPPMMGAGYVHGAARGGPGVRVSPTPGAQRLCRLSVWIWQSVIHLLQMGQVWRYIRTMYLGIQSQRRKEHQRRFYWAMMYEYADVNMLRLLETFLESAPQLVLQLYIMLQKNSAETLPCVSSVTSLMSLAWVLASYHKLLRDSRDDKKSMSYRGAIIQVFWRLFTISSRVISFALFASIFQLYFGIFVVVHWCAMAFWIIHGGTDFCMSKWEEILFNMVVGIVYIFCWFNVKEGRTRYRMFAYYTIVLTENAALTFLWYFYRDPETTDSYAVPALCCVFISFVAGIAMMLLYYGVLHPTGPRAKILASSCCAELLWGIPLPPDVEPMAPEIPGYRGTQVTPTRAVTEQQEDLTADTCLPVFQVRPMGPPTPLGRPYLPEGPLIKIDMPRKRYPAWDAHFVDRRLRRTINILQYVTPTAVGIRYRDGPLLYELLQYESSL

SEQ ID NO: 16004 - protein, 579 aa, Artificial Sequence
  Description of Artificial Sequence: Synthetic coding sequence
MAAKSDGAAASASPDPEGAAGGARGSAGGRGEAAAAAGPPGVVGAGGPGPRYELRDCCWVLCALLVFFSDGATDLWLAASYYLQNQHTYFSLTLLFVLLPSLVVQLLSFRWFVYDYSEPAGSPGPAVSTKDSVAGGAAISTKDSAGAFRTKEGSPEPGPQPAPSSASAYRRRCCRLCIWLLQTLVHLLQLGQVWRYLRALYLGLQSRWRGERLRRHFYWQMLFESADVSMLRLLETFLRSAPQLVLQLSLLVHRGGAPDLLPALSTSASLVSLAWTLASYQKVLRDSRDDKRPLSYKGAVAQVLWHLFSIAARGLAFALFASVYKLYFGIFIVAHWCVMTFWVIQGETDFCMSKWEEIIYNMVVGIIYIFCWFNVKEGRSRRRMTLYHCIVLLENAALTGFWYSSRNFSTDFYSLIMVCVVASSFALGIFFMCVYYCLLHPNGPMLGPQAPGCIFRKASEPCGPPADAITSPPRSLPRTTGAERDGASAGERAGTPTPPVFQVRPGLPPTPVARTLRTEGPVIRIDLPRKKYPAWDAHFIDRRLRKTILALEYSSPATPRLQYRSVGTSQELLEYETTV

SEQ ID NO: 16005 - protein, 395 aa, Artificial Sequence
  Description of Artificial Sequence: Synthetic coding sequence
MPWSSRGALLRDLVLGVLGTAAFLLDLGTDLWAAVQYALGGRYLWAALVLALLGLASVALQLFSWLWLRADPAGLHGSQPPRRCLALLHLLQLGYLYRCVQELRQGLLVWQQEEPSEFDLAYADFLALDISMLRLFETFLETAPQLTLVLAIMLQSGRAEYYQWVGICTSFLGISWALLDYHRALRTCLPSKPLLGLGSSVIYFLWNLLLLWPRVLAVALFSALFPSYVALHFLGLWLVLLLWVWLQGTDFMPDPSSEWLYRVTVATILYFSWFNVAEGRTRGRAIIHFAFLLSDSILLVATWVTHSSWLPSGIPLQLWLPVGCGCFFLGLALRLVYYHWLHPSCCWKPDPDQVDGARSLLSPEGYQLPQNRRMTHLAQKFFPKAKDEAASPVKG

SEQ ID NO: 16006 - protein, 373 aa, Artificial Sequence
  Description of Artificial Sequence: Synthetic coding sequence
MKYTKQNFMMSVLGIIIYVTDLIVDIWVSVRFFHEGQYVFSALALSFMLFGTLVAQCFSYSWFKADLKKAGQESQHCFLLLHCLQGGVFTRYWFALKRGYHAAFKYDSNTSNFVEEQIDLHKEVIDRVTDLSMLRLFETYLEGCPQLILQLYILLEHGQANFSQYAAIMVSCCAISWSTVDYQVALRKSLPDKKLLNGLCPKITYLFYKLFTLLSWMLSVVLLLFLNVKIALFLLLFLWLLGIIWAFKNNTQFCTCISMEFLYRIVVGFILIFTFFNIKGQNTKCPMSCYYIVRVLGTLGILTVFWVCPLTIFNPDYFIPISITIVLTLLLGILFLIVYYGSFHPNRSAETKCDEIDGKPVLRECRMRYFLME

SEQ ID NO: 16007 - protein, 373 aa, Artificial Sequence; identical to SEQ ID NO: 16006
  Description of Artificial Sequence: Synthetic coding sequence

SEQ ID NO: 16008 - protein, 393 aa, Artificial Sequence
  Description of Artificial Sequence: Synthetic coding sequence
MGLLRGGLPCARAMARLGAVRSHYCALLLAAALAVCAFYYLGSGRETFSSATKRLKEARAGAPAAPSPPALELARGSVAPAPGAKAKSLEGGGAGPVDYHLLMMFTKAEHNAALQAKARVALRSLLRLAKFEAHEVLNLHFVSEEASREVAKGLLRELLPPAAGFKCKVIFHDVAVLTDKLFPIVEAMQKHFSAGLGTYYSDSIFFLSVAMHQIMPKEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 16009 - protein, 190 aa, Artificial Sequence
  Description of Artificial Sequence: Synthetic coding sequence
MWPPRCKDPGRQSAEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 16010 - protein, 187 aa, Artificial Sequence
  Description of Artificial Sequence: Synthetic coding sequence
MNGMSVLMKETLKSSVTPSPYEETGERQPSVNWAVSPHQTQNQWARWSWTSQPLELHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 16011 - protein, 190 aa, Artificial Sequence; identical to SEQ ID NO: 16009
  Description of Artificial Sequence: Synthetic coding sequence

SEQ ID NO: 16012 - protein, 189 aa, Artificial Sequence
  Description of Artificial Sequence: Synthetic coding sequence
MVRCVPSAVIVCFLRPPQPGRTVIFHDVAVLTDKLFPIVEAMQKHFSAGLGTYYSDSIFFLSVAMHQIMPKEILQIIQLDLDLKFKTNIRELFEEFDSFLPGAIIGIAREMQQLADKYHFRGHLGDQDFFTMIGMEHPKLFHVLDCTWNRQLCTWWRDHGYSDVFEAYFRCEGHVKIYHGNCNTPIPED

SEQ ID NO: 16013 - protein, 167 aa, Artificial Sequence
  Description of Artificial Sequence: Synthetic coding sequence
MSLVIRNLQRVIPIRRAPLRSKIEIVRRILGVQKFDLGIICVDNKNIQHINRIYRDRNVPTDVLSFPFHEHLKAGEFPQPDFPDDYNLGDIFLGVEYIFHQCKENEDYNDVLTVTATHGLCHLLGFTHGTEAEWQQMFQKEKAVLDELGRRTGTRLQPLTRGLFGGS

SEQ ID NO: 16014 - protein, 124 aa, Artificial Sequence
  Description of Artificial Sequence: Synthetic coding sequence
MSLVIRNLQRVIPIRRAPLRSKIEIVRRILGVQKFDLGIICVDNKNIQHINRIYRDRNVPTDVLSFPFHEVTATHGLCHLLGFTHGTEAEWQQMFQKEKAVLDELGRRTGTRLQPLTRGLFGGS

SEQ ID NO: 16015 - protein, 167 aa, Artificial Sequence; identical to SEQ ID NO: 16013
  Description of Artificial Sequence: Synthetic coding sequence

SEQ ID NO: 16016 - protein, 79 aa, Artificial Sequence
  Description of Artificial Sequence: Synthetic coding sequence
MSLVIRNLQRVIPIRRAPLRSKIEIVTATHGLCHLLGFTHGTEAEWQQMFQKEKAVLDELGRRTGTRLQPLTRGLFGGS

SEQ ID NO: 16017 - protein, 122 aa, Artificial Sequence
  Description of Artificial Sequence: Synthetic coding sequence
MSLVIRNLQRVIPIRRAPLRSKIEIHLKAGEFPQPDFPDDYNLGDIFLGVEYIFHQCKENEDYNDVLTVTATHGLCHLLGFTHGTEAEWQQMFQKEKAVLDELGRRTGTRLQPLTRGLFGGS

SEQ ID NO: 16018 - protein, 167 aa, Artificial Sequence; identical to SEQ ID NO: 16013
  Description of Artificial Sequence: Synthetic coding sequence

SEQ ID NO: 16019 - protein, 306 aa, Artificial Sequence
  Description of Artificial Sequence: Synthetic coding sequence
MAAVDDLQFEEFGNAATSLTANPDATTVNIEDPGETPKHQPGSPRGSGREEDDELLGNDDSDKTELLAGQKKSSPFWTFEYYQTFFDVDTYQVFDRIKGSLLPIPGKNFVRLYIRSNPDLYGPFWICATLVFAIAISGNLSNFLIHLGEKTYHYVPEFRKVSIAATIIYAYAWLVPLALWGFLMWRNSKVMNIVSYSFLEIVCVYGYSLFIYIPTAILWIIPQKAVRWILVMIALGISGSLLAMTFWPAVREDNRRVALATIVTIVLLHMLLSVGCLAYFFDAPEMDHLPTTTATPNQTVAAAKSS

SEQ ID NO: 16020 - protein, 123 aa, Artificial Sequence
  Description of Artificial Sequence: Synthetic coding sequence
MWRNSKVMNIVSYSFLEIVCVYGYSLFIYIPTAILWIIPQKAVRWILVMIALGISGSLLAMTFWPAVREDNRRVALATIVTIVLLHMLLSVGCLAYFFDAPEMDHLPTTTATPNQTVAAAKSS

SEQ ID NO: 16021 - protein, 217 aa, Artificial Sequence
  Description of Artificial Sequence: Synthetic coding sequence
MAAVDDLQFEEFGNAATSLTANPDATTVNIEDPGETPKHQPGSPRGSGREEDDELLGNDDSDKTELLAGQKKSSPFWTFEYYQTFFDVDTYQVFDRIKGSLLPIPGKNFVRLYIRSNPDLYGPFWICATLVFAIAISGNLSNFLIHLGEKTYHYVPEFRKVSIAATIIYAYAWLVPLALWGFLMWRNSKVMNIVSYSFLEIVCVYGYSLFIYIPTAV

SEQ ID NO: 16022 - protein, 306 aa, Artificial Sequence; identical to SEQ ID NO: 16019
  Description of Artificial Sequence: Synthetic coding sequence

SEQ ID NO: 16023 - protein, 331 aa, Artificial Sequence [sequence omitted]

SEQ ID NO: 16024 - protein, 316 aa, Artificial Sequence
  Description of Artificial Sequence: Synthetic coding sequence
MASADELTFHEFEEATNLLADTPDAATTSRSDQLTPQGHVAVAVGSGGSYGAEDEVEEESDKAALLQEQQQQQQPGFWTFSYYQSFFDVDTSQVLDRIKGSLLPRPGHNFVRHHLRNRPDLYGPFWICATLAFVLAVTGNLTLVLAQRRDPSIHYSPQFHKVTVAGISIYCYAWLVPLALWGFLRWRKGVQERMGPYTFLETVCIYGYSLFVFIPMVVLWLIPVPWLQWLFGALALGLSAAGLVFTLWPVVREDTRLVATVLLSVVVLLHALLAMGCKLYFFQSLPPENVAPPPQITSLPSNIALSPTLPQSLAPS

SEQ ID NO: 16025 - protein, 244 aa, Artificial Sequence
  Description of Artificial Sequence: Synthetic coding sequence
MQPPGPPPAYAPTNGDFTFVSSADAEDLSGSIASPDVKLNLGGDFIKESTATTFLRQRGYGWLLEVEDDDPEDNKPLLEELDIDLKDIYYKIRCVLMPMPSLGFNRQVVRDNPDFWGPLAVVLFFSMISLYGQFRVVSWIITIWIFGSLTIFLLARVLGGEVAYGQVLGVIGYSLLPLIVIAPVLLVVGSFEVVSTLIKLFGVFWAAYSAASLLVGEEFKTKKPLLIYPIFLLYIYFLSLYTGV

SEQ ID NO: 16026 - protein, 193 aa, Artificial Sequence
  Description of Artificial Sequence: Synthetic coding sequence
MAEAEESPGDPGTASPRPLMRDLKAVGKKFMHVLYPRKSNTLLRDWDLWGPLILCVTLALMLQRDSADSEKDGGPQFAEVFVIVWFGAVTITLNSKLLGGNISFFQSLCVLGYCILPLTVAMLICRLVLLADPGPVNFMVRLFVVIVMFAWSIVASTAFLADSQPPNRRALAVYPVFLFYFVISWMILTFTPQ

SEQ ID NO: 16027 - protein, 188 aa, Artificial Sequence
  Description of Artificial Sequence: Synthetic coding sequence
MAEAEESPGDPGTASPRPLMRDLKAVGKKFMHVLYPRKSNTLLRDWDLWGPLILCVTLALMLQRDSADSEKDGGPQFAEVFVIVWFGAVTITLNSKLLGGNISFFQSLCVLGYCILPLTVAMLICRLVLLADPGPVNFMVRLFVVIVMFAWSIVASTAFLADSQPPNRRALAVYPVFLFYFVISWMIL

SEQ ID NO: 16028 - protein, 236 aa, Artificial Sequence
  Description of Artificial Sequence: Synthetic coding sequence
MAEAEESPGDPGTASPRPLFAGLSDISISQDIPVEGEITIPMRSRIREFDSSTLNESVRNTIMRDLKAVGKKFMHVLYPRKSNTLLRDWDLWGPLILCVTLALMLQRDSADSEKDGGPQFAEVFVIVWFGAVTITLNSKLLGGNISFFQSLCVLGYCILPLTVAMLICRLVLLADPGPVNFMVRLFVVIVMFAWSIVASTAFLADSQPPNRRALAVYPVFLFYFVISWMILTFTPQ

SEQ ID NO: 16029 - protein, 280 aa, Artificial Sequence
  Description of Artificial Sequence: Synthetic coding sequence
MDLLKISHTKLHLLEDLSIKNKQRMSNLAQFDSDFYQSNFTIDNQEQSGNDSNAYGNLYGSRKQQAGEQPQPASFVPSEMLMSSGYAGQFFQPASNSDYYSQSPYIDSFDEEPPLLEELGIHFDHIWQKTLTVLNPMKPVDGSIMNETDLTGPILFCVALGATLLLAGKVQFGYVYGMSAIGCLVIHALLNLMSSSGVSYGCVASVLGYCLLPMVILSGCAMFFSLQGIFGIMSSLVIIGWCSLSASKIFIAALHMEGQQLLVAYPCAILYGLFALLTIF

SEQ ID NO: 16030 - protein, 257 aa, Artificial Sequence
  Description of Artificial Sequence: Synthetic coding sequence
  MOD_RES (1)..(1): Any amino acid
XMSNLAQFDSDFYQSNFTIDNQEQSGNDSNAYGNLYGSRKQQAGEQPQPASFVPSEMLMSSGYAGQFFQPASNSDYYSQSPYIDSFDEEPPLLEELGIHFDHIWQKTLTVLNPMKPVDGSIMNETDLTGPILFCVALGATLLLAGKVQFGYVYGMSAIGCLVIHALLNLMSSSGVSYGCVASVLGYCLLPMVILSGCAMFFSLQGIFGIMSSLVIIGWCSLSASKIFIAALHMEGQQLLVAYPCAILYGLFALLTIF

SEQ ID NO: 16031 - protein, 299 aa, Artificial Sequence
  Description of Artificial Sequence: Synthetic coding sequence
MPGSASKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 16032 - protein, 291 aa, Artificial Sequence
  Description of Artificial Sequence: Synthetic coding sequence
MHPAGLAAAAAGTPRLPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMFPLLPGAVAHACNPSTLGGRGGRITRSGRCG

SEQ ID NO: 16033 - protein, 314 aa, Artificial Sequence
  Description of Artificial Sequence: Synthetic coding sequence
MHPAGLAAAAAGTPRLRKWPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 16034 - protein, 283 aa, Artificial Sequence
  Description of Artificial Sequence: Synthetic coding sequence
MADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 16035 - protein, 198 aa, Artificial Sequence
  Description of Artificial Sequence: Synthetic coding sequence
MKLYSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVLDEFSKQVDRIDWPVGSPATIHYPALDGHLSRYQNPREADPMTKVQAELDETKIILHNTMESLLERGEKLDDLVSKSEVLGTQSKAFYKTARKQNSCCAIM

SEQ ID NO: 16036 - protein, 164 aa, Artificial Sequence
  Description of Artificial Sequence: Synthetic coding sequence
MKLYSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVLDEFSKQVDRIDWPVGSPATIHYPALDGHLSRYQNPREADPMTKVQAELDETKIILARKQNSCCAIM

SEQ ID NO: 16037 - protein, 372 aa, Artificial Sequence
  Description of Artificial Sequence: Synthetic coding sequence
MASNEDFSITQDLEIPADIVELHDINVEPLPMEDIPTESVQYEDVDGNWIYGGHNHPPLMVLQPLFTNTGYGDHDQEMLMLQTQEEVVGYCDSDNQLGNDLEDQLALPDSIEDEHFQMTLASLSASAASTSTSTQSRSKKPSKKPSGKSATSTEANPAGSSSSLGTRKWEQKQMQVKTLEGEFSVTMWSPNDNNDQGAVGEGQAENPPDYSEYLKGKKLPPGGLPGIDLSDPKQLAEFTKVKPKRSKGEPPKTVPCSYSGCEKMFRDYAAMRKHLHIHGPRVHVCAECGKAFLESSKLRRHQLVHTGEKPFQCTFEGCGKRFSLDFNLRTHLRIHTGDKPFVCPFDVCNRKFAQSTNLKTHILTHVKTKNNP

SEQ ID NO: 16038 - protein, 766 aa, Artificial Sequence
  Description of Artificial Sequence: Synthetic coding sequence
MASDTPESLMALCTDFCLRNLDGTLGYLLDKETLRLHPDIFLPSEICDRLVNEYVELVNAACNFEPHESFFSLFSDPRSTRLTRIHLREDLVQDQDLEAIRKQDLVELYLTNCEKLSAKSLQTLRSFSHTLVSLSLFGCTNIFYEEENPGGCEDEYLVNPTCQVLVKDFTFEGFSRLRFLNLGRMIDWVPVESLLRPLNSLAALDLSGIQTSDAAFLTQWKDSLVSLVLYNMDLSDDHIRVIVQLHKLRHLDISRDRLSSYYKFKLTREVLSLFVQKLGNLMSLDISGHMILENCSISKMEEEAGQTSIEPSKSSIIPFRALKRPLQFLGLFENSLCRLTHIPAYKVSGDKNEEQVLNAIEAYTEHRPEITSRAINLLFDIARIERCNQLLRALKLVITALKCHKYDRNIQVTGSAALFYLTNSEYRSEQSVKLRRQVIQVVLNGMESYQEVTVQRNCCLTLCNFSIPEELEFQYRRVNELLLSILNPTRQDESIQRIAVHLCNALVCQVDNDHKEAVGKMGFVVTMLKLIQKKLLDKTCDQVMEFSWSALWNITDETPDNCEMFLNFNGMKLFLDCLKEFPEKQELHRNMLGLLGNVAEVKELRPQLMTSQFISVFSNLLESKADGIEVSYNACGVLSHIMFDGPEAWGVCEPQREEVEERMWAAIQSWDINSRRNINYRSFEPILRLLPQGISPVSQHWATWALYNLVSVYPDKYCPLLIKEGGMPLLRDIIKMATARQETKEMARKVIEHCSNFKEENMDTSR

SEQ ID NO: 16039 - protein, 165 aa, Artificial Sequence
  Description of Artificial Sequence: Synthetic coding sequence
MASDTPESLMALCTDFCLRNLDGTLGYLLDKETLRLHPDIFLPSEICDRLVNEYVELVNAACNFEPHESFFSLFSDPRSTRLTRIHLREDLVQDQDLEAIRKQDLVELYLTNCEKLSAKSLQTLRSFSHTLVSLSLFGCTNIFYEEENPGGCEDEYLVNPTCQVL

SEQ ID NO: 16040 - protein, 101 aa, Artificial Sequence
  Description of Artificial Sequence: Synthetic coding sequence
MASDTPESLMALCTDFCLRNLDGTLGYLLDKETLRLHPDIFLPSEICDRLVNEYVELVNAACNFEPHESFFSLFSDPRSTRLTRIHLREDLVQDQDLEAIR

SEQ ID NO: 16041 - protein, 412 aa, Artificial Sequence
  Description of Artificial Sequence: Synthetic coding sequence
MMALWSLLHLTFLGFSITLLLVHGQGFQGTAAIWPSLFNVNLSKKVQESIQIPNNGSAPLLVDVRVFVSNVFNVDILRYTMSSMLLLRLSWLDTRLAWNTSAHPRHAITLPWESLWTPRLTILEALWVDWRDQSPQARVDQDGHVKLNLALATETNCNFELLHFPRDHSNCSLSFYALSNTAMELEFQAHVVNEIVSVKREYVVYDLKTQVPPQQLVPCFQVTLRLKNTALKSIIALLVPAEALLLADVCGGLLPLRAIERIGYKVTLLLSYLVLHSSLVQALPSSSSCNPLLIYYFTILLLLLFLSTIETVLLAGLLARGNLGAKSGPSPAPRGEQREHGNPGPHPAEEPSRGVKGSQRSWPETADRIFFLVYVVGVLCTQFVFAGIWMWAACKSDAAPGEAAPHGRRPRL

SEQ ID NO: 16042 - protein, 126 aa, Artificial Sequence
  Description of Artificial Sequence: Synthetic coding sequence
MMALWSLLHLTFLGFSITLLLVHGQGFQGTAAIWPSLFNVNLSKKVQESIQIPNNGSAPLLVDVRVFVSNVFNVSSVLPRATALHSHGDCSGSAPCSKARGSGCHGLTPGNHLKVQPPCINPSGDI

SEQ ID NO: 16043 - protein, 1130 aa, Artificial Sequence
  Description of Artificial Sequence: Synthetic coding sequence
MCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 16044 - protein, 1043 aa, Artificial Sequence
  Description of Artificial Sequence: Synthetic coding sequence
MAMALELQAQASPQPEPEELLIVKLEEDSWGSESKLWEKDRGSVSGPEASRQRFRQFQYRDAAGPHEAFSQLWALCCRWLRPEIRLKEQILELLVLEQFLTILPREVQTWVQARHPESGEEAVALVEDWHRETRTAGQSGLELHTEETRPLKTGEEAQSFQLQPVDPWPEGQSQKKGVKNTCPDLPNHLNAEVAPQPLKESAVLTPRVPTLPKMGSVGDWEVTAESQEALGPGKHAEKELCKDPPGDDCGNSVCLGVPVSKPSNTSEKEQGPEFWGLSLINSGKRSTADYSLDNEPAQALTWRDSRAWEEQYQWDVEDMKVSGVHWGYEETKTFLAILSESPFSEKLRTCHQNRQVYRAIAEQLRARGFLRTLEQCRYRVKNLLRNYRKAKSSHPPGTCPFYEELEALVRARTAIRATDGPGEAVALPRLGYSDAEMDEQEEGGWDPEEMAEDCNGAGLVNVESTQGPRIAGAPALFQSRIAGVHWGYEETKAFLAILSESPFSEKLRTCHQNSQVYRAIAERLCALGFLRTLEQCRYRFKNLLRSYRKAKSSHPPGTCPFYEELDSLMRARAAVRAMGTVREAAGLPRCGQSSAETDAQEAWGEVANEDAVKPSTLCPKAPDMGFEMRHEDEDQISEQDIFEGLPGALSKCPTEAVCQPLDWGEDSENENEDEGQWGNPSQEQWQESSSEEDLEKLIDHQGLYLAEKPYKCDTCMKSFSRSSHFIAHQRIHTGEKPYKCLECGKNFSDRSNLNTHQRIHTGEKPYKCLECGKSFSDHSNLITHQRIHTGEKPYKCGECWKSFNQSSNLLKHQRIHLGGNPDQCSEPGGNFAQSPSFSAHWRNSTEETAPEQPQSISKDLNSPGPHSTNSGEKLYECSECGRSFSKSSALISHQRIHTGEKPYECAECGKSFSKSSTLANHQRTHTGEKPYKCVDCGKCFSERSKLITHQRVHTGEKPYKCLECGKFFRDRSNLITHQRIHTGEKPYKCRECGKCFNQSSSLIIHQRIHTGEKPYKCTECGKDFNNSSHFSAHRRTHAGGKAS

SEQ ID NO: 16045 - protein, 977 aa, Artificial Sequence
  Description of Artificial Sequence: Synthetic coding sequence
MAMALELQAQASPQPEPEELLIVKLELLVLEQFLTILPREVQTWVQARHPESGEEAVALVEDWHRETRTAGQSGLELHTEETRPLKTGEEAQSFQLQPVDPWPEGQSQKKGVKNTCPDLPNHLNAEVAPQPLKESAVLTPRVPTLPKMGSVGDWEVTAESQEALGPGKHAEKELCKDPPGDDCGNSVCLGVPVSKPSNTSEKEQGPEFWGLSLINSGKRSTADYSLDNEPAQALTWRDSRAWEEQYQWDVEDMKVSGVHWGYEETKTFLAILSESPFSEKLRTCHQNRQVYRAIAEQLRARGFLRTLEQCRYRVKNLLRNYRKAKSSHPPGTCPFYEELEALVRARTAIRATDGPGEAVALPRLGYSDAEMDEQEEGGWDPEEMAEDCNGAGLVNVESTQGPRIAGAPALFQSRIAGVHWGYEETKAFLAILSESPFSEKLRTCHQNSQVYRAIAERLCALGFLRTLEQCRYRFKNLLRSYRKAKSSHPPGTCPFYEELDSLMRARAAVRAMGTVREAAGLPRCGQSSAETDAQEAWGEVANEDAVKPSTLCPKAPDMGFEMRHEDEDQISEQDIFEGLPGALSKCPTEAVCQPLDWGEDSENENEDEGQWGNPSQEQWQESSSEEDLEKLIDHQGLYLAEKPYKCDTCMKSFSRSSHFIAHQRIHTGEKPYKCLECGKNFSDRSNLNTHQRIHTGEKPYKCLECGKSFSDHSNLITHQRIHTGEKPYKCGECWKSFNQSSNLLKHQRIHLGGNPDQCSEPGGNFAQSPSFSAHWRNSTEETAPEQPQSISKDLNSPGPHSTNSGEKLYECSECGRSFSKSSALISHQRIHTGEKPYECAECGKSFSKSSTLANHQRTHTGEKPYKCVDCGKCFSERSKLITHQRVHTGEKPYKCLECGKFFRDRSNLITHQRIHTGEKPYKCRECGKCFNQSSSLIIHQRIHTGEKPYKCTECGKDFNNSSHFSAHRRTHAGGKAS

SEQ ID NO: 16046 - protein, 427 aa, Artificial Sequence
  Description of Artificial Sequence: Synthetic coding sequence
MAMALELQAQASPQPEPEELLIVKLEEDSWGSESKLWEKDRGSVSGPEASRQRFRQFQYRDAAGPHEAFSQLWALCCRWLRPEIRLKEQILELLVLEQFLTILPREVQTWVQARHPESGEEAVALVEDWHRETRTAGQSGLELHTEETRPLKTGEEAQSFQLQPVDPWPEGQSQKKGVKNTCPDLPNHLNAEVAPQPLKESGVPVSKPSNTSEKEQGPEFWGLSLINSGKRSTADYSLDNEPAQALTWRDSRAWEEQYQWDVEDMKVSGVHWGYEETKTFLAILSESPFSEKLRTCHQNRQVYRAIAEQLRARGFLRTLEQCRYRVKNLLRNYRKAKSSHPPGTCPFYEELEALVRARTAIRATDGPGEAVALPRLGYSDAEMDEQEEGGWDPEEMAEDCNGAGLVNVESTQGPRIAGAPALFQSRI

SEQ ID NO: 16047 - protein, 433 aa, Artificial Sequence
  Description of Artificial Sequence: Synthetic coding sequence
MAMALELQAQASPQPEPEELLIVKLEEDSWGSESKLWEKDRGSVSGPEASRQRFRQFQYRDAAGPHEAFSQLWALCCRWLRPEIRLKEQILELLVLEQFLTILPREVQTWVQARHPESGEEAVALVEDWHRETRTAGQSGLELHTEETRPLKTGEEAQSFQLQPVDPWPEGQSQKKGVKNTCPDLPNHLNAEVAPQPLKESGVPVSKPSNTSEKEQGPEFWGLSLINSGKRSTADYSLDNEPAQALTWRDSRAWEEQYQWDVEDMKVSGVHWGYEETKTFLAILSESPFSEKLRTCHQNRQVYRAIAEQLRARGFLRTLEQCRYRVKNLLRNYRKAKSSHPPGTCPFYEELEALVRARTAIRATDGPGEAVALPRLGYSDAEMDEQEEGGWDPEEMAEDCNGAGLVNVESTQGPRIAGAPALFQSRIGKNMGV

SEQ ID NO: 16048 - protein, 977 aa, Artificial Sequence; identical to SEQ ID NO: 16045
  Description of Artificial Sequence: Synthetic coding sequence

SEQ ID NO: 16049 - protein, 599 aa, Artificial Sequence
  Description of Artificial Sequence: Synthetic coding sequence
MSGPCGEKPVLEASPTMSLWEFEDSHSRQGTPRPGQELAAEEASALELQMKVDFFRKLGYSSTEIHSVLQKLGVQADTNTVLGELVKHGTATERERQTSPDPCPQLPLVPRGGGTPKAPNLEPPLPEEEKEGSDLRPVVIDGSNVAMSHGNKEVFSCRGILLAVNWFLERGHTDITVFVPSWRKEQPRPDVPITDQHILRELEKKKILVFTPSRRVGGKRVVCYDDRFIVKLAYESDGIVVSNDTYRDLQGERQEWKRFIEERLLMYSFVNDKFMPPDDPLGRHGPSLDNFLRKKPLTLEHRKQPCPYGRKCTYGIKCRFFHPERPSCPQRSVADELRANALLSPPRAPSKDKNGRRPSPSSQSSSLLTESEQCSLDGKKLGAQASPGSRQEGLTQTYAPSGRSLAPSGGSGSSFGPTDWLPQTLDSLPYVSQDCLDSGIGSLESQMSELWGVRGGGPGEPGPPRAPYTGYSPYGSELPATAAFSAFGRAMGAGHFSVPADYPPAPPAFPPREYWSEPYPLPPPTSVLQEPPVQSPGAGRSPWGRAGSLAKEQASVYTKLCGVFPPHLVEAVMGRFPQLLDPQQLAAEILSYKSQHPSE

SEQ ID NO: 16050 - protein, 599 aa, Artificial Sequence; identical to SEQ ID NO: 16049
  Description of Artificial Sequence: Synthetic coding sequence

SEQ ID NO: 16051 - protein, 426 aa, Artificial Sequence
  Description of Artificial Sequence: Synthetic coding sequence
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDENKLSEASGGRAENGERSDLEEDNEREGTENGAIDAVPVDENLFTGEDLDELEEELNTLDLEE

SEQ ID NO: 16052 - protein, 392 aa, Artificial Sequence
  Description of Artificial Sequence: Synthetic coding sequence
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDENKLSEASGGRAENGERSDLEEDNERHVL

SEQ ID NO: 16053 - protein, 162 aa, Artificial Sequence
  Description of Artificial Sequence: Synthetic coding sequence
MYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVRGSFVPHLLMLIERNNRKYHNMVKSHQHQSHSAWVQILTPTMGN

SEQ ID NO: 16054 - protein, 422 aa, Artificial Sequence
  Description of Artificial Sequence: Synthetic coding sequence
MFQTAWRQEPVTFEDVAVYFTQNEWASLDSVQRALYREVMLENYANVASLAFPFTTPVLVSQLEQGELPWGLDPWEPMGREALRGICPGDEARTEKEGLTPKDHVSKETESFRLMVGGLPGNVSQHLDFGSSLEQPQGHWIIKTKSKRRHFTDTSARHHEAYEVKNGEKFEKLGKNISVSTQLTTNQTNPSGQISYECGQCGRYFIQMADFHRHEKCHTGEKSFECKECGKYFRYNSLLIRHQIIHTGKKPFKCKECGKGLSSDTALIQHQRIHTGEKPYECKECGKAFSSSSVFLQHQRFHTGEKLYECNECWKTFSCSSSFTVHQRMHTGEKPYECKECGKRLSSNTALTQHQRIHTGEKPFECKECGKAFNQKITLIQHQRVHTGEKPYECKVCGKTFSWCGRFILHQKLHTQKTPVQA

SEQ ID NO: 16055 - protein, 117 aa, Artificial Sequence
  Description of Artificial Sequence: Synthetic coding sequence
MFQTAWRQEPVTFEDVAVYFTQNEWASLDSVQRALYREVMLENYANVASLAFPFTTPVLVSQLEQGELPWGLDPWEPMGREALRGICPGDEARTEKEGLTPKDHVSKETESFRLMVG

SEQ ID NO: 16056 - protein, 310 aa, Artificial Sequence
  Description of Artificial Sequence: Synthetic coding sequence
MGLCKCPKRKVTNLFCFEHRVNVCEHCLVANHAKCIVQSYLQWLQDSDYNPNCRLCNIPLASRETTRLVCYDLFHWACLNERAAQLPRNTAPAGYQCPSCNGPIFPPTNLAGPVASALREKLATVNWARAGLGLPLIDEVVSPEPEPLNTSDFSDWSSFNASSTPGPEEVDSASAAPAFYSQAPRPPASPGRPEQHTVIHMGNPEPLTHAPRKVYDTRDDDRTPGLHGDCDDDKYRRRPALGWLARLLRSRAGSRKRPLTLLQRAGLLLLLGLLGFLALLALMSRLGRAAADSDPNLDPLMNPHIRVGPS

SEQ ID NO: 16057 - protein, 188 aa, Artificial Sequence
  Description of Artificial Sequence: Synthetic coding sequence
MGLCKCPKRKVTNLFCFEHRVNVCEHCLVANHAKCIVQSYLQWLQDSDYNPNCRLCNIPLASRETTRLVCYDLFHWACLNERAAQLPRNTAPAGYQCPSCNGPIFPPTNLAGPVASALREKLATVNWARAGLGLPLIDEVVSPEPEPLNTSDFSDWSSFNASSTPGPEEVDSASAAPAFYSQAPRPPA

SEQ ID NO: 16058 - protein, 207 aa, Artificial Sequence
  Description of Artificial Sequence: Synthetic coding sequence
MGLCKCPKRKVTNLFCFEHRVNVCEHCLVANHAKCIVQSYLQWLQDSDYNPNCRLCNIPLASRETTRLVCYDLFHWACLNERAAQLPRNTAPAGYQCPSCNGPIFPPTNLAGPVASALREKLATVNWARAGLGLPLIDEVVSPEPEPLNTSDFSDWSSFNASSTPGPEEVDSASAAPAFYSQAPRPPASPGRPEQHTVIHMGNPEPL

SEQ ID NO: 16059 - protein, 485 aa, Artificial Sequence
  Description of Artificial Sequence: Synthetic coding sequence
MYKMNICNKPSNKTAPEKSVWTAPAQPSGPSPELQGQRSRRNGWSWPPHPLQIVAWLLYLFFAVIGFGILVPLLPHHWVPAGYACMGAIFAGHLVVHLTAVSIDPADANVRDKSYAGPLPIFNRSQHAHVIEDLHCNLCNVDVSARSKHCSACNKCVCGFDHHCKWLNNCVGERNYRLFLHSVASALLGVLLLVLVATYVFVEFFVNPMRLRTNRHFEVLKNHTDVWFVFLPAAPVETQAPAILALAALLILLGLLSTALLGHLLCFHIYLMWHKLTTYEYIVQHRPPQEAKGVHRELESCPPKMRPIQEMEFYMRTFRHMRPEPPGQAGPAAVNAKHSRPASPDPTPGRRDCAGPPVQVEWDRKKPLPWRSPLLLLAMWGPQAPPCLCRKRGRGACIKCERLRPRIRRRGLGPPAAAPARRRIPRTPALCTPLALPAPTTRRRQSPWTRFQWRRRAWAAPLWPPRGAGADSPRWRGRRVRPPFS

SEQ ID NO: 16060 - protein, 412 aa, Artificial Sequence
  Description of Artificial Sequence: Synthetic coding sequence
MDTRSGSQCSVTPEAILNNEKLVLPPRISRVNGWSLPLHYFQVVTWAVFVGLSSATFGIFIPFLPHAWKYIAYVVTGGIFSFHLVVHLIASCIDPADSNVRLMKNYSQPMPLFDRSKHAHVIQNQFCHLCKVTVNKKTKHCISCNKCVSGFDHHCKWINNCVGSRNYWFFFSTVASATAGMLCLIAILLYVLVQYLVNPGVLRTDPRYEDVKNMNTWLLFLPLFPVQVQTLIVVIIGMLVLLLDFLGLVHLGQLLIFHIYLKAKKMTTFEYLINNRKEESSKHQAVRKDPYVQMDKGVLQQGAGALGSSAQGVKAKSSLLIHKHLCHFCTSVNQDGDSTAREGDEDPCPSALGAKARNSRLICRRLCQFSTRVHPDGGSMAQEADDAPSISTLGLQQETTEPMKTDSAESED

SEQ ID NO: 16061 - protein, 412 aa, Artificial Sequence; identical to SEQ ID NO: 16060
  Description of Artificial Sequence: Synthetic coding sequence

SEQ ID NO: 16062 - protein, 267 aa, Artificial Sequence
  Description of Artificial Sequence: Synthetic coding sequence
MAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLAWSGLRFFQPWGQWLRSSGLLFATFLLLSLFSLVASLLLVSHLYLVASNTTTWEFISSHRIAYLRQRPSNPFDRGLTRNLAHFFCGWPSGSWETLWAEEEEEGSSPAV

SEQ ID NO: 16063 - protein, 215 aa, Artificial Sequence
  Description of Artificial Sequence: Synthetic coding sequence
MAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLAWSGLRFFQPWGQWLRSSGLLFATFLLLSHFFCGWPSGSWETLWAEEEEEGSSPAV

SEQ ID NO: 16064 - protein, 281 aa, Artificial Sequence
  Description of Artificial Sequence: Synthetic coding sequence
MAPWALLSPGVLVRTGHTVLTWGITLVLFLHDTGEPDPERPRTHPIPQLRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLAWSGLRFFQPWGQWLRSSGLLFATFLLLSLFSLVASLLLVSHLYLVASNTTTWEFISSHRIAYLRQRPSNPFDRGLTRNLAHFFCGWPSGSWETLWAEEEEEGSSPAV

SEQ ID NO: 16065 - protein, 215 aa, Artificial Sequence; identical to SEQ ID NO: 16063
  Description of Artificial Sequence: Synthetic coding sequence

SEQ ID NO: 16066 - protein, 210 aa, Artificial Sequence
  Description of Artificial Sequence: Synthetic coding sequence
MAPWALLSPGVLVRTGHTVLTWGITLVLFLHDTDKSADELLATHSHSWNQHLQAFAQPGTHFPTSNCTPTPPTPVLPGPASLCSPASPELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLW

SEQ ID NO: 16067 - protein, 205 aa, Artificial Sequence
  Description of Artificial Sequence: Synthetic coding sequence
MAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLACTRPLSPAPQVRPPVLPALGSVVAVQRAPVRHLPAAVPLLVGGQP

SEQ ID NO: 16068 - protein, 488 aa, Artificial Sequence
  Description of Artificial Sequence: Synthetic coding sequence
MPPGGGGPMKDCEYSQISTHSSSPMESPHKKKKIAARRKWEVFPGRNKFFCNGRIMMARQTGVFYLTLVLILVTSGLFFAFDCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMCDQDQCIQSTKFVLQAAATPLLQSEPSLTSDELHLPGKPGLGTPCASLTLGPPTPPASMPNLAEATLADVMPRKDEHMGHQFLTPDEAPSPPRLLAAGSPLAHSRTMHVLGLASQDSLHEDSVRGLVKLSSV

SEQ ID NO: 16069 - protein, 473 aa, Artificial Sequence
  Description of Artificial Sequence: Synthetic coding sequence
MPPGGGGPMKDCEYSQISTHSSSPMESPHKKKKIAARRKWEVFPGRNKFFCNGRIMMARQTGVFYLTLVLILVTSGLFFAFDCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMAAATPLLQSEPSLTSDELHLPGKPGLGTPCASLTLGPPTPPASMPNLAEATLADVMPRKDEHMGHQFLTPDEAPSPPRLLAAGSPLAHSRTMHVLGLASQDSLHEDSVRGLVKLSSV

SEQ ID NO: 16070 - protein, 492 aa, Artificial Sequence
  Description of Artificial Sequence: Synthetic coding sequence
EVAPEEAGGGGPMKDCEYSQISTHSSSPMESPHKKKKIAARRKWEVFPGRNKFFCNGRIMMARQTGVFYLTLVLILVTSGLFFAFDCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMCDQDQCIQSTKFVLQAAATPLLQSEPSLTSDELHLPGKPGLGTPCASLTLGPPTPPASMPNLAEATLADVMPRKDEHMGHQFLTPDEAPSPPRLLAAGSPLAHSRTMHVLGLASQDSLHEDSVRGLVKLSSV

SEQ ID NO: 16071 - protein, 296 aa, Artificial Sequence
  Description of Artificial Sequence: Synthetic coding sequence
MRGQRSLLLGPARLCLRLLLLLGYRRRCPPLLRGLVQRWRYGKVCLRSLLYNSFGGSDTAVDAAFEPVYWLVDNVIRWFGVGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 16072 - protein, 361 aa, Artificial Sequence
  Description of Artificial Sequence: Synthetic coding sequence
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 16073 - protein, 338 aa, Artificial Sequence
  Description of Artificial Sequence: Synthetic coding sequence
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNSYGSWDLFREAYAAIEKMKQLDKNKLQAVANQTYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 16074 - protein, 361 aa, Artificial Sequence; identical to SEQ ID NO: 16072
  Description of Artificial Sequence: Synthetic coding sequence

SEQ ID NO: 16075 - protein, 307 aa, Artificial Sequence
  Description of Artificial Sequence: Synthetic coding sequence
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCHILPPALSKLPTSLRPSFLSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 16076 - protein, 377 aa, Artificial Sequence
  Description of Artificial Sequence: Synthetic coding sequence
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIEKMKQLDKNKLQAVANQTYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 16077 - protein, 377 aa, Artificial Sequence; identical to SEQ ID NO: 16076
  Description of Artificial Sequence: Synthetic coding sequence

SEQ ID NO: 16078 - protein, 213 aa, Artificial Sequence
  Description of Artificial Sequence: Synthetic coding sequence
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVY

SEQ ID NO: 16079 - protein, 301 aa, Artificial Sequence
  Description of Artificial Sequence: Synthetic coding sequence
  MOD_RES (1)..(1): Any amino acid
XAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIEKMKQLDKNKLQAVANQTYHQTPPPTFSFRERMTHKSLVYLWFLCSRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 16080 - protein, 319 aa, Artificial Sequence
  Description of Artificial Sequence: Synthetic coding sequence
  MOD_RES (1)..(1): Any amino acid
XRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIETYHQTPPPTFSFRERMTHKSLVYLWFLCSRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 16081 - protein, 242 aa, Artificial Sequence
  Description of Artificial Sequence: Synthetic coding sequence
MRGQRSLLLGPARLCLRLLLLLGYRRRCPPLLRGLVQRWRYGKVCLRSLLYNSFGGSDTAVDAAFEPVYWLVDNVIRWFGVGRNDIATVSICKKCIYPKPARTHHCSICNRCVLKMDHHCPWLNNCVGHYNHRYFFSFCFFMTLGCVYCSYGSWDLFREAYAAIEKMKQLDKNKLQAVANQTYHQTPPPTFSFRERMTHKSLVYLWFLCSSVALALGALTVWHAVLISRGETSIERHINKKE

SEQ ID NO: 16082 - protein, 388 aa, Artificial Sequence
  Description of Artificial Sequence: Synthetic coding sequence
MKDCEYQQISPGAAPLPASPGARRPGPAASPTPGPGPAPPAAPAPPRWSSSGSGSGSGSGSLGRRPRRKWEVFPGRNRFYCGGRLMLAGHGGVFALTLLLILTTTGLFFVFDCPYLARKLTLAIPIIAAILFFFVMSCLLQTSFTDPGILPRATVCEAAALEKQIDNTGSSTYRPPPRTREVLINGQMVKLKYCFTCKMFRPPRTSHCSVCDNCVERFDHHCPWVGNCVGRRNYRFFYAFILSLSFLTAFIFACVVTHLTLRAQGSNFLSTLKETPASVLELVICFFSIWSILGLSGFHTYLVASNLTTNEDIKGSWSSKRGGEASVNPYSHKSIITNCCAVLCGPLPPSLIDRRGFVQSDTVLPSPIRSDEPACRAKPDASMVGGHP

SEQ ID NO: 16083 - protein, 309 aa, Artificial Sequence
  Description of Artificial Sequence: Synthetic coding sequence
MTLLTDATPLVKEPHPLPLVPRPWFLPSLFAAFNVVLLVFFSGLFFAFPCRWLAQNGEWAFPVITGSLFVLTFFSLVSLNFSDPGILHQGSAEQGPLTVHVVWVNHGAFRLQWCPKCCFHRPPRTYHCPWCNICVEDFDHHCKWVNNCIGHRNFRFFMLLVLSLCLYSGAMLVTCLIFLVRTTHLPFSTDKAIAIVVAVSAAGLLVPLSLLLLIQALSVSSADRTYKGKCRHLQGYNPFDQGCASNWYLTICAPLGPKYMAEAVQLQRVVGPDWTSMPNLHPPMSPSALNPPAPTSGSLQSREGTPGAW

SEQ ID NO: 16084 - protein, 367 aa, Artificial Sequence
  Description of Artificial Sequence: Synthetic coding sequence
MAPSGPGSSARRRCRRVLYWIPVVFITLLLGWSYYAYAIQLCIVSMENTGEQVVCLMAYHLLFAMFVWSYWKTIFTLPMNPSKEFHLSYAEKDLLEREPRGEAHQEVLRRAAKDLPIYTRTMSGAIRYCDRCQLIKPDRCHHCSVCDKCILKMDHHCPWVNNCVGFSNYKFFLLFLAYSLLYCLFIAATDLQYFIKFWTNGLPDTQAKFHIMFLFFAAAMFSVSLSSLFGYHCWLVSKNKSTLEAFRSPVFRHGTDKNGFSLGFSKNMRQVFGDEKKYWLLPIFSSLGDGCSFPTCLVNQDPEQASTPAGLNSTAKNLENHQFPAKPLRESQSHLLTDSQSWTESSINPGKCKAGMSNPALTMENET

SEQ ID NO: 16085 - protein, 320 aa, Artificial Sequence
  Description of Artificial Sequence: Synthetic coding sequence
MAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPDGNGFSLGCSKNWRQVFGDEKKYWLLPIFSSLGDGCSFPTRLVGMDPEQASVTNQNEYARRSKLQR

SEQ ID NO: 16086 - protein, 354 aa, Artificial Sequence
  Description of Artificial Sequence: Synthetic coding sequence
MAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPDGNGFSLGCSKNWRQVFGDEKKYWLLPIFSSLGDGCSFPTRLVGMDPEQASVTNQNEYARSGSNQPFPIKPLSESKNRLLDSESQWLENGAEEGIVKSGV

SEQ ID NO: 16087 - protein, 365 aa, Artificial Sequence
  Description of Artificial Sequence: Synthetic coding sequence
MAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPDGNGFSLGCSKNWRQVFGDEKKYWLLPIFSSLGDGCSFPTRLVGMDPEQASVTNQNEYARSSGSNQPFPIKPLSESKNRLLDSESQWLENGAEEGIVKSGTNNHVTVAIEN

SEQ ID NO: 16088 - protein, 365 aa, Artificial Sequence; identical to SEQ ID NO: 16087
  Description of Artificial Sequence: Synthetic coding sequence

SEQ ID NO: 16089 - protein, 130 aa, Artificial Sequence
  Description of Artificial Sequence: Synthetic coding sequence
MAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKSLMQSTK

SEQ ID NO: 16090 - protein, 292 aa, Artificial Sequence
  Description of Artificial Sequence: Synthetic coding sequence
MFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPDGNGFSLGCSKNWRQVFGDEKKYWLLPIFSSLGDGCSFPTRLVGMDPEQASVTNQNEYARSSGSNQPFPIKPLSESKNRLLDSESQWLENGAEEGIVKSGV

SEQ ID NO: 16091 - protein, 265 aa, Artificial Sequence
  Description of Artificial Sequence: Synthetic coding sequence
MGLRIHFVVDPHGWCCMGLIVFVWLYNIVLIPKIVLFPHYEEGHIPGILIIIFYGISIFCLVALVRASITDPGRLPENPKIPHGEREFWELCNKCNLMRPKRSHHCSRCGHCVRRMDHHCPWINNCVGEDNHWLFLQLCFYTELLTCYALMFSFCHYYYFLPLKKRNLDLFVFRHELAIMRLAAFMGITMLVGITGLFYTQLIGIITDTTSIEKMSNCCEDISRPRKPWQQTFSEVFGTRWKILWFIPFRQRQPLRVPYHFANHV

SEQ ID NO: 16092 - protein, 263 aa, Artificial Sequence
  Description of Artificial Sequence: Synthetic coding sequence
MLALRLLNVVAPAYFLCISLVTFVLQLFLFLPSMREDPAAARLFSPALLHGALFLFLSANALGNYVLVIQNSPDDLGACQGASARKTPCPSPSTHFCRVCARVTLRHDHHCFFTGNCIGSRNMRNFVLFCLYTSLACLYSMVAGVAYISAVLSISFAHPLAFLTLLPTSISQFFSGAVLGSEMFVILMLYLWFAIGLACAGFCCHQLLLILRGQTRHQVRKGVAVRARPWRKNLQEVFGKRWLLGLLVPMFNVGSESSKQQDK

SEQ ID NO: 16093 - protein, 41 aa, Artificial Sequence
  Description of Artificial Sequence: Synthetic coding sequence
MLALRLLNVVAPAYFLCISLVTFVLQLFLFLPSMREDPAAA

SEQ ID NO: 16094 - protein, 109 aa, Artificial Sequence
  Description of Artificial Sequence: Synthetic coding sequence
MLALRLLNVVAPAYFLCISLVTFVLQLFLFLPSMREDPAAARLFSPALLHGALFLFLSANALGNYVLVIQNSPDDLGACQGASARKTPCPSPSTHFCRVCARVTLRHDH

SEQ ID NO: 16095 - protein, 409 aa, Artificial Sequence
  Description of Artificial Sequence: Synthetic coding sequence
MTQKGSMKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFSLGYMYYVFLQEVVPKGRVGPVQLAVLTCGLFLILLALHRAKKNPGYLSNPASGDRSLSSSQLECLSRKGQEKTKGFPGADMSGSLNNRTTKDDPKGSSKMPAGSPTKAKEDWCAKCQLVRPARAWHCRICGICVRRMDHHCVWINSCVGESNHQAFILALLIFLLTSVYGITLTLDTICRDRSVFTALFYCPGVYANYSSALSFTCVWYSVIITAGMAYIFLIQLINISYNVTEREVQQALRQKTGRRLLCGLIVDTGLLG

SEQ ID NO: 16096 - protein, 148 aa, Artificial Sequence
  Description of Artificial Sequence: Synthetic coding sequence
MTQKGSMKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFS

SEQ ID NO: 16097 - protein, 284 aa, Artificial Sequence
  Description of Artificial Sequence: Synthetic coding sequence
MGQPWAAGSTDGAPAQLPLVLTALWAAAVGLELAYVLVLGPGPPPLGPLARALQLALAAFQLLNLLGNVGLFLRSDPSIRGVMLAGRGLGQGWAYCYQCQSQVPPRSGHCSACRVCILRRDHHCRLLGRCVGFGNYRPFLCLLLHAAGVLLHVSVLLGPALSALLRAHTPLHMAALLLLPWLMLLTGRVSLAQFALAFVTDTCVAGALLCGAGLLFHGMLLLRGQTTWEWARGQHSYDLGPCHNLQAALGPRWALVWLWPFLASPLPGDGITFQTTADVGHTAS

SEQ ID NO: 16098 - protein, 327 aa, Artificial Sequence
  Description of Artificial Sequence: Synthetic coding sequence
MMLIPTHHFRNIERKPEYLQPEKCVPPPYPGPVGTMWFIRDGCGIACAIVTWFLVLYAEFVVLFVMLIPSRDYVYSIINGIVFNLLAFLALASHCRAMLTDPGAVPKGNATKEFIESLQLKPGQVVYKCPKCCSIKPDRAHHCSVCKRCIRKMDHHCPWVNNCVGENNQKYFVLFTMYIALISLHALIMVGFHFLHCFEEDWTTYGLNREEMAETGISLHEKMQPLNFSSTECSSFSPPTTVILLILLCFEGLLFLIFTSVMFGTQVHSICTDETGIEQLKKEERRWAKKTKWMNMKAVFGHPFSLGWASPFATPDQGKADPYQYVV

SEQ ID NO: 16099 - protein, 195 aa, Artificial Sequence
  Description of Artificial Sequence: Synthetic coding sequence
IKPDRAHHCSVCKRCIRKMDHHCPWVNNCVGENNQKYFVLFTMYIALISLHALIMVGFHFLHCFEEDWTKCSSFSPPTTVILLILLCFEGLLFLIFTSVMFGTQVHSICTDETGIERLKRKNQPREHMGSWQSVKETFGGDFSLNWFNPFSRPCQPEIPSDKDMVRQVTSLSDTETMEDPSEETKDEDSVEVTDE

SEQ ID NO: 16100 - protein, 299 aa, Artificial Sequence
  Description of Artificial Sequence: Synthetic coding sequence
MMLIPTHHFRNIERKPEYLQPEKCVPPPYPGPVGTMWFIRDGCGIACAIVTWFLVLYAEFVVLFVMLIPSRDYVYSIINGIVFNLLAFLALASHCRAMLTDPGAVPKGNATKEFIESLQLKPGQVVYKCPKCCSIKPDRAHHCSVCKRCIRKMDHHCPWVNNCVGENNQKYFVLFTMYIALISLHALIMVGFHFLHCFEEDWTKCSSFSPPTTVILLILLCFEGLLFLIFTSVMFGTQVHSICTDETGIEQLKKEERRWAKKTKWMNMKAVFGHPFSLGWASPFATPDQGKADPYQYVV

SEQ ID NO: 16101 - protein, 344 aa, Artificial Sequence
  Description of Artificial Sequence: Synthetic coding sequence
MDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHCSVCNWCVHRFDHHCVWVNNCIGAWNIRYFLIYVLTLTASAATVAIVSTTFLVHLVVMSDLYQETYIDDLGHLHVMDTVFLIQYLFLTFPRIVFMLGFVVVLSFLLGGYLLFVLYLAATNQTTNEWYRGDWAWCQRCPLVAWPPSAEPQVHRNIHSHGLRSNLQEIFLPAFPCHERKKQE

SEQ ID NO: 16102 - protein, 344 aa, Artificial Sequence; identical to SEQ ID NO: 16101
  Description of Artificial Sequence: Synthetic coding sequence

SEQ ID NO: 16103 - protein, 344 aa, Artificial Sequence; identical to SEQ ID NO: 16101
  Description of Artificial Sequence: Synthetic coding sequence

SEQ ID NO: 16104 - protein, 344 aa, Artificial Sequence; identical to SEQ ID NO: 16101
  Description of Artificial Sequence: Synthetic coding sequence

SEQ ID NO: 16105 - protein, 344 aa, Artificial Sequence; identical to SEQ ID NO: 16101
  Description of Artificial Sequence: Synthetic coding sequence

SEQ ID NO: 16106 - protein, 344 aa, Artificial Sequence; identical to SEQ ID NO: 16101
  Description of Artificial Sequence: Synthetic coding sequence

SEQ ID NO: 16107 - protein, 165 aa, Artificial Sequence
  Description of Artificial Sequence: Synthetic coding sequence
MDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHC

SEQ ID NO: 16108 - protein, 715 aa, Artificial Sequence
  Description of Artificial Sequence: Synthetic coding sequence
MPAESGKRFKPSKYVPVSAAAIFLVGATTLFFAFTCPGLSLYVSPAVPIYNAIMFLFVLANFSMATFMDPGIFPRAEEDEDKEDDFRAPLYKTVEIKGIQVRMKWCATCRFYRPPRCSHCSVCDNCVEEFDHHCPWVNNCIGRRNYRYFFLFLLSLTAHIMGVFGFGLLYVLYHIEELSGVRTAVTMAVMCVAGLFFIPVAGLTGFHVVLVARGRTTNEQVTGKFRGGVNPFTNGCCNNVSRVLCSSPAPRYLGRPKKEKTIVIRPPFLRPEVSDGQITVKIMDNGIQGELRRTKSKGSLEITESQSADAEPPPPPKPDLSRYTGLRTHLGLATNEDSSLLAKDSPPTPTMYKYRPGYSSSSTSAAMPHSSSAKLSRGDSLKEPTSIAESSRHPSYRSEPSLEPESFRSPTFGKSFHFDPLSSGSRSSSLKSAQGTGFELGQLQSIRSEGTTSTSYKSLANQTRNGSLSYDSLLTPSDSPDFESVQAGPEPDPPLGYTSPFLSARLAQQREAERHPRLVPTGPTHREPSPVRYDNLSRHIVASLQEREKLLRQSPPLPGREEEPGLGDSGIQSTPGSGHAPRTSSSSDDSKRSPLGKTPLGRPAVPRFGKPDGLRGRGVGSPEPGPTAPYLGRSMSYSSQKAQPGVSETEEVALQPLLTPKDEVQLKTTYSKSNGQPKSLGSASPGPGQPPLSSPTRGGVKKVSGVGGTTYEISV

SEQ ID NO: 16109 - protein, 662 aa, Artificial Sequence
  Description of Artificial Sequence: Synthetic coding sequence
MFLFVLANFSMATFMDPGIFPRAEEDEDKEDDFRAPLYKTVEIKGIQVRMKWCATCRFYRPPRCSHCSVCDNCVEEFDHHCPWVNNCIGRRNYRYFFLFLLSLTAHIMGVFGFGLLYVLYHIEELSGVRTAVTMAVMCVAGLFFIPVAGLTGFHVVLVARGRTTNEQVTGKFRGGVNPFTNGCCNNVSRVLCSSPAPRYLGRPKKEKTIVIRPPFLRPEVSDGQITVKIMDNGIQGELRRTKSKGSLEITESQSADAEPPPPPKPDLSRYTGLRTHLGLATNEDSSLLAKDSPPTPTMYKYRPGYSSSSTSAAMPHSSSAKLSRGDSLKEPTSIAESSRHPSYRSEPSLEPESFRSPTFGKSFHFDPLSSGSRSSSLKSAQGTGFELGQLQSIRSEGTTSTSYKSLANQTRNGSLSYDSLLTPSDSPDFESVQAGPEPDPPLGYTSPFLSARLAQQREAERHPRLVPTGPTHREPSPVRYDNLSRHIVASLQEREKLLRQSPPLPGREEEPGLGDSGIQSTPGSGHAPRTSSSSDDSKRSPLGKTPLGRPAVPRFGKPDGLRGRGVGSPEPGPTAPYLGRSMSYSSQKAQPGVSETEEVALQPLLTPKDEVQLKTTYSKSNGQPKSLGSASPGPGQPPLSSPTRGGVKKVSGVGGTTYEISV

SEQ ID NO: 16110 - protein, 409 aa, Artificial Sequence
  Description of Artificial Sequence: Synthetic coding sequence
MGTFCSVIKFENLQELKRLCHWGPIIALGVIAICSTMAMIDSVLWYWPLHTTGGSVNFIMLINWTVMILYNYFNAMFVGPGFVPLGWKPDTMYLQYCKVCQAYKAPRSHHCRKCNRCVMKMDHHCPWINNCCGYQNHASFTLFLLLAPLGCIHAAFIFVMTMYTQLYHRLSFGWNTVKIDMSAARRDPLPIVPFGLAAFATTLFALGLALGTTIAVGMLFFIQMKIILRNKTSIESWIEEKAKDRIQYYQLDEVFVFPYDMGSRWRNFKQVFTWSGVPEGDGLEWPVREGCHQYSLTIEQLKQKADKRVRSVRYKVIEDYSGACCPLNKGIKTFFTSPCTEEPRIQLQKGEFILATRGLRYWLYGDKILDDSFIEGVSRIRGWFPRKCVEKCPCDAETDQAPEGEKKNR

SEQ ID NO: 16111 - protein, 413 aa, Artificial Sequence
  Description of Artificial Sequence: Synthetic coding sequence
MGTFCSVIKFENLQELKRLCHWGPIIALGVIAICSTMAMIDSVLWYWPLHTTGGSVNFIMLINWTVMILYNYFNAMFVGPGFVPLGWKPEISQDTMYLQYCKVCQAYKAPRSHHCRKCNRCVMKMDHHCPWINNCCGYQNHASFTLFLLLAPLGCIHAAFIFVMTMYTQLYHRLSFGWNTVKIDMSAARRDPLPIVPFGLAAFATTLFALGLALGTTIAVGMLFFIQMKIILRNKTSIESWIEEKAKDRIQYYQLDEVFVFPYDMGSRWRNFKQVFTWSGVPEGDGLEWPVREGCHQYSLTIEQLKQKADKRVRSVRYKVIEDYSGACCPLNKGIKTFFTSPCTEEPRIQLQKGEFILATRGLRYWLYGDKILDDSFIEGVSRIRGWFPRKCVEKCPCDAETDQAPEGEKKNR

SEQ ID NO: 16112 - protein, 308 aa, Artificial Sequence
  Description of Artificial Sequence: Synthetic coding sequence
MQPSGHRLRDVEHHPLLAENDNYDSSSSSSSEADVADRVWFIRDGCGMICAVMTWLLVAYADFVVTFVMLLPSKDFWYSVVNGVIFNCLAVLALSSHLRTMLTDPGAVPKGNATKEYMESLQLKPGEVIYKCPKCCCIKPERAHHCSICKRCIRKMDHHCPWVNNCVGEKNQRFFVLFTMYIALSSVHALILCGFQFISCVRGQWTECSDFSPPITVILLIFLCLEGLLFFTFTAVMFGTQIHSICNDETEIERLKSEKPTWERRLRWEGMKSVFGGPPSLLWMNPFVGFRFRRLPTRPRKGGPEFSV

SEQ ID NO: 16113 - protein, 345 aa, Artificial Sequence
  Description of Artificial Sequence: Synthetic coding sequence
MQPSGHRLRDVEHHPLLAENDNYDSSSSSSSEADVADRVWFIRDGCGMICAVMTWLLVAYADFVVTFVMLLPSKDFWYSVVNGVIFNCLAVLALSSHLRTMLTDPEKSSDCRPSACTVKTGLDPTLVGICGEGTESVQSLLLGAVPKGNATKEYMESLQLKPGEVIYKCPKCCCIKPERAHHCSICKRCIRKMDHHCPWVNNCVGEKNQRFFVLFTMYIALSSVHALILCGFQFISCVRGQWTECSDFSPPITVILLIFLCLEGLLFFTFTAVMFGTQIHSICNDETEIERLKSEKPTWERRLRWEGMKSVFGGPPSLLWMNPFVGFRFRRLPTRPRKGGPEFSV

SEQ ID NO: 16114 - protein, 1539 aa, Artificial Sequence
  Description of Artificial Sequence: Synthetic coding sequence
MDSYFKAAVSDLDKLLDDFEQNPDEQDYLQDVQNAYDSNHCSVSSELASSQRTSLLPKDQECVNSCASSETSYGTNESSLNEKTLKGLTSIQNEKNVTGLDLLSSVDGGTSDEIQPLYMGRCSKPICDLISDMGNLVHATNSEEDIKKLLPDDFKSNADSLIGLDLSSVSDTPCVSSTDHDSDTVREQQNDISSELQNREIGGIKELGIKVDTTLSDSYNYSGTENLKDKKIFNQLESIVDFNMSSALTRQSSKMFHAKDKLQHKSQPCGLLKDVGLVKEEVDVAVITAAECLKEEGKTSALTCSLPKNEDLCLNDSNSRDENFKLPDFSFQEDKTVIKQSAQEDSKSLDLKDNDVIQDSSSALHVSSKDVPSSLSCLPASGSMCGSLIESKARGDFLPQHEHKDNIQDAVTIHEEIQNSVVLGGEPFKENDLLKQEKCKSILLQSLIEGMEDRKIDPDQTVIRAESLDGGDTSSTVVESQEGLSGTHVPESSDCCEGFINTFSSNDMDGQDLDYFNIDEGAKSGPLISDAELDAFLTEQYLQTTNIKSFEENVNDSKSQMNQIDMKGLDDGNINNIYFNAEAGAIGESHGINIICEIVDKQNTIENGLSLGEKSTIPVQQGLPTSKSEITNQLSVSDINSQSVGGARPKQLFSLPSRTRSSKDLNKPDVPDTIESEPSTADTVVPITCAIDSTADPQVSFNSNYIDIESNSEGGSSFVTANEDSVPENTCKEGLVLGQKQPTWVPDSEAPNCMNCQVKFTFTKRRHHCRACGKVFCGVCCNRKCKLQYLEKEARVCVVCYETISKAQAFERMMSPTGSNLKSNHSDECTTVQPPQENQTSSIPSPATLPVSALKQPGVEGLCSKEQKRVWFADGILPNGEVADTTKLSSGSKRCSEDFSPLSPDVPMTVNTVDHSHSTTVEKPNNETGDITRNEIIQSPISQVPSVEKLSMNTGNEGLPTSGSFTLDDDVFAETEEPSSPTGVLVNSNLPIASISDYRLLCDINKYVCNKISLLPNDEDSLPPLLVASGEKGSVPVVEEHPSHEQIILLLEGESFHPVTFVLNANLLVNVKFIFYSSDKYWYFSTNGLHGLGQAEIIILLLCLPNEDTIPKDIFRLFITIYKDALKGKYIENLDNITFTESFLSSKDHGGFLFITPTFQKLDDLSLPSNPFLCGILIQKLEIPWAKVFPMRLMLRLGAEYKAYPAPLTSIRGRKPLFGEIGHTIMNLLVDLRNYQYTLHNIDQLLIHMEMGKSCIKIPRKKYSDVMKVLNSSNEHVISIGASFSTEADSHLVCIQNDGIYETQANSATGHPRKVTGASFVVFNGALKTSSGFLAKSSIVEDGLMVQITPETMNGLRLALREQKDFKITCGKVDAVDLREYVDICWVDAEEKGNKGVISSVDGISLQGFPSEKIKLEADFETDEKIVKCTEVFYFLKDQDLSILSTSYQFAKEIAMACSAALCPHLKTLKSNGMNKIGLRVSIDTDMVEFQAGSEGQLLPQHYLNDLDSALIPVIHGGTSNSSLPLEIELVFFIIEHLF

SEQ ID NO: 16115 - protein, 1539 aa, Artificial Sequence; identical to SEQ ID NO: 16114
  Description of Artificial Sequence: Synthetic coding sequence

SEQ ID NO: 16116 - protein, 1539 aa, Artificial Sequence; identical to SEQ ID NO: 16114
  Description of Artificial Sequence: Synthetic coding sequence

SEQ ID NO: 16117 - protein, 784 aa, Artificial Sequence
  Description of Artificial Sequence: Synthetic coding sequence
MASLDDPGEVREGFLCPLCLKDLQSFYQLHSHYEEEHSGEDRDVKGQIKSLVQKAKKAKDRLLKREGDDRAESGTQGYESFSYGGVDPYMWEPQELGAVRSHLSDFKKHRAARIDHYVVEVNKLIIRLEKLTAFDRTNTESAKIRAIEKSVVPWVNDQDVPFCPDCGNKFSIRNRRHHCRLCGSIMCKKCMELISLPLANKLTSASKESLSTHTSPSQSPNSVHGSRRGSISSMSSVSSVLDEKDDDRIRCCTHCKDTLLKREQQIDEKEHTPDIVKLYEKLRLCMEKVDQKAPEYIRMAASLNAGETTYSLEHASDLRVEVQKVYELIDALSKKILTLGLNQDPPPHPSNLRLQRMIRYSATLFVQEKLLGLMSLPTKEQFEELKKKRKEEMERKRAVERQAALESQRRLEERQSGLASRAANGEVASLRRGPAPLRKAEGWLPLSGGQGQSEDSDPLLQQIHNITSFIRQAKAAGRMDEVRTLQENLRQLQDEYDQQQTEKAIELSRRQAEEEDLQREQLQMLRERELEREREQFRVASLHTRTRSLDFREIGPFQLEPSREPRTHLAYALDLGSSPVPSSTAPKTPSLSSTQPTRVWSGPPAVGQERLPQSSMPQQHEGPSLNPFDEEDLSSPMEEATTGPPAAGVSLDPSARILKEYNPFEEEDEEEEAVAGNPFIQPDSPAPNPFSEEDEHPQQRLSSPLVPGNPFEEPTCINPFEMDSDSGPEAEEPIEEELLLQQIDNIKAYIFDAKQCGRLDEVEVLTENLRELKHTLAKQKGGTD

SEQ ID NO: 16118 - protein, 145 aa, Artificial Sequence
  Description of Artificial Sequence: Synthetic coding sequence
MAASLNAGETTYSLEHASDLRVEVQKVYELIDALSKKILTLGLNQDPPPHPSNLRLQRMIRYSATLFVQEKLLGLMSLPTKEQFEELKKKRKEEMERKRAVERQAALESQRRLEERQRASHPPCLCFGSRLFPSSKQHSSQDPFT

SEQ ID NO: 16119 - protein, 208 aa, Artificial Sequence
  Description of Artificial Sequence: Synthetic coding sequence
MASLDDPGEVREGFLCPLCLKDLQSFYQLHSHYEEEHSGEDRDVKGQIKSLVQKAKKAKDRLLKREGDDRAESGTQGYESFSYGGVDPYMWEPQELGAVRSHLSDFKKHRAARIDHYVVEVNKLIIRLEKLTAFDRTNTESAKIRAIEKSVVPWVNDQDVPFCPDCGNKFSIRNRRHHCRLCGSIMCKKCMELISLPLAKITTLHGES

SEQ ID NO: 16120 - protein, 784 aa, Artificial Sequence; identical to SEQ ID NO: 16117
  Description of Artificial Sequence: Synthetic coding sequence

SEQ ID NO: 16121 - protein, 41 aa, Artificial Sequence
  Description of Artificial Sequence: Synthetic coding sequence
MASLDDPGEVREGFLCPLCLKDLQSFYQLHSHYEEEHSGED

SEQ ID NO: 16122 - protein, 1425 aa, Artificial Sequence
  Description of Artificial Sequence: Synthetic coding sequence
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNAQAWENMMSASSQSPNPNNPAEYCSTIPPLQQAQASGALSSPPPTVMVPVGVLKHPGAEVAQPREQRRVWFADGILPNGEVADAAKLTMNGTSSAGTLAVSHDPVKPVTTSPLPAETDICLFSGSITQVGSPVGSAMNLIPEDGLPPILISTGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFLYVTSTYQSLQDLVLPTPPYLFGILIQKWETPWAKVFPIRLMLRLGAEYRLYPCPLFSVRFRKPLFGETGHTIMNLLADFRNYQYTLPVVQGLVVDMEVRKTSIKIPSNRYNEMMKAMNKSNEHVLAGGACFNEKADSHLVCVQNDDGNYQTQAISIHNQPRKVTGASFFVFSGALKSSSGYLAKSSIVEDGVMVQITAENMDSLRQALREMKDFTITCGKADAEEPQEHIHIQWVDDDKNVSKGVVSPIDGKSMETITNVKIFHGSEYKANGKVIRWTEVFFLENDDQHNCLSDPADHSRLTEHVAKAFCLALCPHLKLLKEDGMTKLGLRVTLDSDQVGYQAGSNGQPLPSQYMNDLDSALVPVIHGGACQLSEGPVVMELIFYILENIV

SEQ ID NO: 16123 - protein, 1366 aa, Artificial Sequence
  Description of Artificial Sequence: Synthetic coding sequence
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNVAQPREQRRVWFADGILPNGEVADAAKLTMNGTSSAGTLAVSHDPVKPVTTSPLPAETDICLFSGSITQVGSPVGSAMNLIPEDGLPPILISTGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFLYVTSTYQSLQDLVLPTPPYLFGILIQKWETPWAKVFPIRLMLRLGAEYRLYPCPLFSVRFRKPLFGETGHTIMNLLADFRNYQYTLPVVQGLVVDMEVRKTSIKIPSNRYNEMMKAMNKSNEHVLAGGACFNEKADSHLVCVQNDDGNYQTQAISIHNQPRKVTGASFFVFSGALKSSSGYLAKSSIVEDGVMVQITAENMDSLRQALREMKDFTITCGKADAEEPQEHIHIQWVDDDKNVSKGVVSPIDGKSMETITNVKIFHGSEYKANGKVIRWTEVFFLENDDQHNCLSDPADHSRLTEHVAKAFCLALCPHLKLLKEDGMTKLGLRVTLDSDQVGYQAGSNGQPLPSQYMNDLDSALVPVIHGGACQLSEGPVVMELIFYILENIV

SEQ ID NO: 16124 - protein, 762 aa, Artificial Sequence
  Description of Artificial Sequence: Synthetic coding sequence
MENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNGKY

SEQ ID NO: 16125 - protein, 1425 aa, Artificial Sequence; identical to SEQ ID NO: 16122
  Description of Artificial Sequence: Synthetic coding sequence

SEQ ID NO: 16126 - protein, 837 aa, Artificial Sequence
  Description of Artificial Sequence: Synthetic coding sequence
MASKRKSTTPCMVRTSQVVEQDVPEEVDRAKEKGIGTPQPDVAKDSWAAELENSSKENEVIEVKSMGESQSKKLQGGYECKYCPYSTQNLNEFTEHVDMQHPNVILNPLYVCAECNFTTKKYDSLSDHNSKFHPGEANFKLKLIKRNNQTVLEQSIETTNHVVSITTSGPGTGDSDSGISVSKTPIMKPGKPKADAKKVPKKPEEITPENHVEGTARLVTDTAEILSRLGGVELLQDTLGHVMPSVQLPPNINLVPKVPVPLNTTKYNSALDTNATMINSFNKFPYPTQAELSWLTAASKHPEEHIRIWFATQRLKHGISWSPEEVEEARKKMFNGTIQSVPPTITVLPAQLAPTKVTQPILQTALPCQILGQTSLVLTQVTSGSTTVSCSPITLAVAGVTNHGQKRPLVTPQAAPEPKRPHIAQVPEPPPKVANPPLTPASDRKKTKEQIAHLKASFLQSQFPDDAEVYRLIEVTGLARSEIKKWFSDHRYRCQRGIVHITSESLAKDQLAIAASRHGRTYHAYPDFAPQKFKEKTQGQVKILEDSFLKSSFPTQAELDRLRVETKLSRREIDSWFSERRKLRDSMEQAVLDSMGSGKKGQDVGAPNGALSRLDQLSGAQLTSSLPSPSPAIAKSQEQVHLLRSTFARTQWPTPQEYDQLAAKTGLVRTEIVRWFKENRCLLKTGTVKWMEQYQHQPMADDHGYDAVARKATKPMAESPKNGGDVVPQYYKDPKKLCEEDLEKLVTRVKVGSEPAKDCLPAKPSEATSDRSEGSSRDGQGSDENEESSVVDYVEVTVGEEDAISDRSDSWSQAAAEGVSELAESDSDCVPAEAGQA

SEQ ID NO: 16127 - protein, 166 aa, Artificial Sequence
  Description of Artificial Sequence: Synthetic coding sequence
MASKRKSTTPCMVRTSQVVEQDVPEEVDRAKEKGIGTPQPDVAKDSWAAELENSSKENEVIEVKSMGESQSKKLQGGYECKYCPYSTQNLNEFTEHVDMQHPNVILNPLYVCAECNFTTKKYDSLSDHNSKFHPGEANFKLKLIKRNNQTVLEQSIETTNHVVSIT

SEQ ID NO: 16128 - protein, 154 aa, Artificial Sequence
  Description of Artificial Sequence: Synthetic coding sequence
MALLLSVLRVLLGGFFALVGLAKLSEEISAPVSERMNALFVQFAEVFPLKVFGYQPDPLNYQIAVGFLELLAGLLLVMGPPMLQEISNLFLILLMMGAIFTLAALKESLSTCIPAIVCLGFLLLLNVGQLLAQTKKVVRPTRKKTLSTFKESWK

SEQ ID NO: 16129 - protein, 431 aa, Artificial Sequence
  Description of Artificial Sequence: Synthetic coding sequence
MMLRFSMCRGNDEGFAMEQIWLLLLLTIRVLPGSAQFNGYNCDANLHSRFPAERDISVYCGVQAITMKINFCTVLFSGYSETDLALNGRHGDSHCRGFINNNTFPAVVIFIINLSTLEGCGNNLVVSTIPGVSAYGNATSVQVGNISGYIDTPDPPTIISYLPGLLYKFSCSYPLEYLVNNTQLASSSAAISVRENNGTFVSTLNLLLYNDSTYNQQLIIPSIGLPLKTKVFAAVQATNLDGRWNVLMDYCYTTPSGNPNDDIRYDLFLSCDKDPQTTVIENGRSQRGRFSFEVFRFVKHKNQKMSTVFLHCVTKLCRADDCPFLMPICSHRERRDAGRRTTWSPQSSSGSAVLSAGPIITRSDETPTNNSQLGSPSMPPFQLNAITSALISGMVILGVTSFSLLLCSLALLHRKGPTSLVLNGIRNPVFD

SEQ ID NO: 16130 - protein, 415 aa, Artificial Sequence
  Description of Artificial Sequence: Synthetic coding sequence
MEQIWLLLLLTIRVLPGSAQFNGYNCDANLHSRFPAERDISVYCGVQAITMKINFCTVLFSGYSETDLALNGRHGDSHCRGFINNNTFPAVVIFIINLSTLEGCGNNLVVSTIPGVSAYGNATSVQVGNISGYIDTPDPPTIISYLPGLLYKFSCSYPLEYLVNNTQLASSSAAISVRENNGTFVSTLNLLLYNDSTYNQQLIIPSIGLPLKTKVFAAVQATNLDGRWNVLMDYCYTTPSGNPNDDIRYDLFLSCDKDPQTTVIENGRSQRGRFSFEVFRFVKHKNQKMSTVFLHCVTKLCRADDCPFLMPICSHRERRDAGRRTTWSPQSSSGSAVLSAGPIITRSDETPTNNSQLGSPSMPPFQLNAITSALISGMVILGVTSFSLLLCSLALLHRKGPTSLVLNGIRNPVFD

SEQ ID NO: 16131 - protein, 415 aa, Artificial Sequence; identical to SEQ ID NO: 16130
  Description of Artificial Sequence: Synthetic coding sequence

SEQ ID NO: 16132 - DNA, 1131 bp, Artificial Sequence
  Description of Artificial Sequence: Synthetic coding sequence
atgggcctgctggccttcctgaagacccagttcgtgctgcacctgctggtgggcttcgtgttcgtggtgagcggcctggtgatcaacttcgtgcagctgtgcaccctggccctgtggcccgtgagcaagcagctgtacagaagactgaactgcagactggcctacagcctgtggagccagctggtgatgctgctggagtggtggagctgcaccgagtgcaccctgttcaccgaccaggccaccgtggagagattcggcaaggagcacgccgtgatcatcctgaaccacaacttcgagatcgacttcctgtgcggctggaccatgtgcgagagattcggcgtgctgggcagcagcaaggtgctggccaagaaggagctgctgtacgtgcccctgatcggctggacctggtacttcctggagatcgtgttctgcaagagaaagtgggaggaggacagagacaccgtggtggagggcctgagaagactgagcgactaccccgagtacatgtggttcctgctgtactgcgagggcaccagattcaccgagaccaagcacagagtgagcatggaggtggccgccgccaagggcctgcccgtgctgaagtaccacctgctgcccagaaccaagggcttcaccaccgccgtgaagtgcctgagaggcaccgtggccgccgtgtacgacgtgaccctgaacttcagaggcaacaagaaccccagcctgctgggcatcctgtacggcaagaagtacgaggccgacatgtgcgtgagaagattccccctggaggacatccccctggacgagaaggaggccgcccagtggctgcacaagctgtaccaggagaaggacgccctgcaggagatctacaaccagaagggcatgttccccggcgagcagttcaagcccgccagaagaccctggaccctgctgaacttcctgagctgggccaccatcctgctgagccccctgttcagcttcgtgctgggcgtgttcgccagcggcagccccctgctgatcctgaccttcctgggcttcgtgggcgccgccagcttcggcgtgagaagactgatcggcgtgaccgagatcgagaagggcagcagctacggcaaccaggagttcaagaagaaggagtag

SEQ ID NO: 16133 - DNA, 1131 bp, Artificial Sequence; identical to SEQ ID NO: 16132
  Description of Artificial Sequence: Synthetic coding sequence

SEQ ID NO: 16134 - DNA, 1131 bp, Artificial Sequence; identical to SEQ ID NO: 16132
  Description of Artificial Sequence: Synthetic coding sequence

SEQ ID NO: 16135 - DNA, 1131 bp, Artificial Sequence; identical to SEQ ID NO: 16132
  Description of Artificial Sequence: Synthetic coding sequence

SEQ ID NO: 16136 - DNA, 1131 bp, Artificial Sequence; identical to SEQ ID NO: 16132
  Description of Artificial Sequence: Synthetic coding sequence

SEQ ID NO: 16137 - DNA, 768 bp, Artificial Sequence
  Description of Artificial Sequence: Synthetic coding sequence
atgggcctgctggccttcctgaagacccagttcgtgctgcacctgctggtgggcttcgtgttcgtggtgagcggcctggtgatcaacttcgtgcagctgtgcaccctggccctgtggcccgtgagcaagcagctgtacagaagactgaactgcagactggcctacagcctgtggagccagctggtgatgctgctggagtggtggagctgcaccgagtgcaccctgttcaccgaccaggccaccgtggagagattcggcaaggagcacgccgtgatcatcctgaaccacaacttcgagatcgacttcctgtgcggctggaccatgtgcgagagattcggcgtgctgggcagcagcaaggtgctggccaagaaggagctgctgtacgtgcccctgatcggctggacctggtacttcctggagatcgtgttctgcaagagaaagtgggaggaggacagagacaccgtggtggagggcctgagaagactgagcgactaccccgagtacatgtggttcctgctgtactgcgagggcaccagattcaccgagaccaagcacagagtgagcatggaggtggccgccgccaagggcctgcccgtgctgaagtaccacctgctgcccagaaccaagggcttcaccaccgccgtgaagtgcctgagaggcaccgtggccgccgtgtacgacgtgaccctgaacttcagaggcaacaagaaccccagcctgctgggcatcctgtacggcaagaagtacgaggccgacatgtgcgtgtag

SEQ ID NO: 16138 - DNA, 1113 bp, Artificial Sequence
  Description of Artificial Sequence: Synthetic coding sequence
atgggcctgctggccttcctgaagacccagttcgtgctgcacctgctggtgggcttcgtgttcgtggtgagcggcctggtgatcaacttcgtgcagctgtgcaccctggccctgtggcccgtgagcaagcagctgtacagaagactgaactgcagactggcctacagcctgtggagccagctggtgatgctgctggagtggtggagctgcaccgagtgcaccctgttcaccgaccaggccaccgtggagagattcggcaaggagcacgccgtgatcatcctgaaccacaacttcgagatcgacttcctgtgcggctggaccatgtgcgagagattcggcgtgctgggcagcagcaaggtgctggccaagaaggagctgctgtacgtgcccctgatcggctggacctggtacttcctggagatcgtgttctgcaagagaaagtgggaggaggacagagacaccgtggtggagggcctgagaagactgagcgactaccccgagtacatgtggttcctgctgtactgcgagggcaccagattcaccgagaccaagcacagagtgagcatggaggtggccgccgccaagggcctgcccgtgctgaagtaccacctgctgcccagaaccaagggcttcaccaccgccgtgaagtgcctgagaggcaccgtggccgccgtgtacgacgtgaccctgaacttcagaggcaacaagaaccccagcctgctgggcatcctgtacggcaagaagtacgaggccgacatgtgcgtgagaagattccccctggaggacatccccctggacgagaaggagggccactgctggcccgtggcccccgtgacccaccccgagcccggcgccaccctggaggcccccagaagagagggccccggcccccccaccggcgtgtggcccgtgaagctgcccgcctgggccgtggtgagctggggcagaagatggccccccagcctgggccccggcgccagatgccacggcgtgagctgccccagcagccagggctgccactgctgcctgcacagactgcccccctgcgagaccctggtggtgtggtacagcgccaccgtgtaccagaccagaaccctgtgcgaggtgctgtag

SEQ ID NO: 16139 - DNA, 387 bp, Artificial Sequence
  Description of Artificial Sequence: Synthetic coding sequence
atgggcctgctggccttcctgaagacccagttcgtgctgcacctgctggtgggcttcgtgttcgtggtgagcggcctggtgatcaacttcgtgcagctgtgcaccctggccctgtggcccgtgagcaagcagctgtacagaagactgaactgcagactggcctacagcctgtggagccagctggtgatgctgctggagtggtggagctgcaccgagtgcaccctgttcaccgaccaggccaccgtggagagattcggcaaggagcacgccgtgatcatcctgaaccacaacttcgagatcgacttcctgtgcggctggaccatgtgcgagagattcggcgtgctgggcagcagcaaggtgctggccaagaaggagctgctgtactag

SEQ ID NO: 16140 - DNA, 240 bp, Artificial Sequence
  Description of Artificial Sequence: Synthetic coding sequence
atgggcctgctggccttcctgaagacccagttcgtgctgcacctgctggtgggcttcgtgttcgtggtgagcggcctggtgatcaacttcgtgcagctgtgcaccctggccctgtggcccgtgagcaagcagctgtacagaagactgaactgcagactggcctacagcctgtggagccagctggtgatgctgctggagtggtggagctgcaccgagtgcaccctgttcaccgaccagtag

SEQ ID NO: 16141 - DNA, 117 bp, Artificial Sequence
  Description of Artificial Sequence: Synthetic coding sequence
atgggcctgctggccttcctgaagacccagttcgtgctgcacctgctggtgggcttcgtgttcgtggtgagcggcctggtgatcaacttcgtgcagctgtgcaccctggccctgtag

SEQ ID NO: 16142 - DNA, 768 bp, Artificial Sequence; identical to SEQ ID NO: 16137
  Description of Artificial Sequence: Synthetic coding sequence

SEQ ID NO: 16143 - DNA, 1131 bp, Artificial Sequence; identical to SEQ ID NO: 16132
  Description of Artificial Sequence: Synthetic coding sequence

SEQ ID NO: 16144 - DNA, 1137 bp, Artificial Sequence
  Description of Artificial Sequence: Synthetic coding sequence
atggacctggccggcctgctgaagagccagttcctgtgccacctggtgttctgctacgtgttcatcgccagcggcctgatcatcaacaccatccagctgttcaccctgctgctgtggcccatcaacaagcagctgttcagaaagatcaactgcagactgagctactgcatcagcagccagctggtgatgctgctggagtggtggagcggcaccgagtgcaccatcttcaccgaccccagagcctacctgaagtacggcaaggagaacgccatcgtggtgctgaaccacaagttcgagatcgacttcctgtgcggctggagcctgagcgagagattcggcctgctgggcggcagcaaggtgctggccaagaaggagctggcctacgtgcccatcatcggctggatgtggtacttcaccgagatggtgttctgcagcagaaagtgggagcaggacagaaagaccgtggccaccagcctgcagcacctgagagactaccccgagaagtacttcttcctgatccactgcgagggcaccagattcaccgagaagaagcacgagatcagcatgcaggtggccagagccaagggcctgcccagactgaagcaccacctgctgcccagaaccaagggcttcgccatcaccgtgagaagcctgagaaacgtggtgagcgccgtgtacgactgcaccctgaacttcagaaacaacgagaaccccaccctgctgggcgtgctgaacggcaagaagtaccacgccgacctgtacgtgagaagaatccccctggaggacatccccgaggacgacgacgagtgcagcgcctggctgcacaagctgtaccaggagaaggacgccttccaggaggagtactacagaaccggcaccttccccgagacccccatggtgccccccagaagaccctggaccctggtgaactggctgttctgggccagcctggtgctgtaccccttcttccagttcctggtgagcatgatcagaagcggcagcagcctgaccctggccagcttcatcctggtgttcttcgtggccagcgtgggcgtgagatggatgatcggcgtgaccgagatcgacaagggcagcgcctacggcaacagcgacagcaagcagaagctgaacgactag

SEQ ID NO: 16145 - DNA, 480 bp, Artificial Sequence
  Description of Artificial Sequence: Synthetic coding sequence
atggacctggccggcctgctgaagagccagttcctgtgccacctggtgttctgctacgtgttcatcgccagcggcctgatcatcaacaccatccagctgttcaccctgctgctgtggcccatcaacaagcagctgttcagaaagatcaactgcagactgagctactgcatcagcagccagctggtgatgctgctggagtggtggagcggcaccgagtgcaccatcttcaccgaccccagagcctacctgaagtacggcaaggagaacgccatcgtggtgctgaaccacaagttcgagatcgacttcctgtgcggctggagcctgagcgagagattcggcctgctgggcgtgagccagaagtgcatccccccctgcctgacccacttcagcggcagcgccccccccctggtgttcctgctgctggtgatccagaacctgcagaagaaccagcagagcttctacctgatgaagtggagctag

SEQ ID NO: 16146 - DNA, 375 bp, Artificial Sequence
  Description of Artificial Sequence: Synthetic coding sequence
atgctgctggagtggtggagcggcaccgagtgcaccatcttcaccgaccccagagcctacctgaagtacggcaaggagaacgccatcgtggtgctgaaccacaagttcgagatcgacttcctgtgcggctggagcctgagcgagagattcggcctgctgggcggcagcaaggtgctggccaagaaggagctggcctacgtgcccatcatcggctggatgtggtacttcaccgagatggtgttctgcagcagaaagtgggagcaggacagaaagaccgtggccaccagcctgcagcacctgagagactaccccgagaagtacttcgtgtgcagacaccagagcagctgcgtgcccagagcccccgccggcctgtag

SEQ ID NO: 16147 - DNA, 402 bp, Artificial Sequence
  Description of Artificial Sequence: Synthetic coding sequence
atggacctggccggcctgctgaagagccagttcctgtgccacctggtgttctgctacgtgttcatcgccagcggcctgatcatcaacaccatccagctgttcaccctgctgctgtggcccatcaacaagcagctgttcagaaagatcaactgcagactgagctactgcatcagcagccagctggtgatgctgctggagtggtggagcggcaccgagtgcaccatcttcaccgaccccagagcctacctgaagtacggcaaggagaacgccatcgtggtgctgaaccacaagttcgagatcgacttcctgtgcggctggagcctgagcgagagattcggcctgctgggcttcgacctgctgcacgtggcctgcatgcccctggagctgggcctgttcagctag

SEQ ID NO: 16148 - DNA, 357 bp, Artificial Sequence
  Description of Artificial Sequence: Synthetic coding sequence
atggacctggccggcctgctgaagagccagttcctgtgccacctggtgttctgctacgtgttcatcgccagcggcctgatcatcaacaccatccagctgttcaccctgctgctgtggcccatcaacaagcagctgttcagaaagatcaactgcagactgagctactgcatcagcagcagactgcagggccccggccaggagagagccggcctgtgccccaactacagactggacgtggtgctgcacagagacggcctgctgttcgcccaggtgggcgccggcagccaggacggctgccaccagttcgccgccccccccggcctgcccagagaggtgttcttccccgacagcctgtag

SEQ ID NO: 16149 - DNA, 318 bp, Artificial Sequence
  Description of Artificial Sequence: Synthetic coding sequence
tgaagcgccgtgtacgactgcaccctgaacttcagaaacaacgagaaccccaccctgctgggcgtgctgaacggcaagaagtaccacgccgacctgtacgtgagaagaatccccctggaggacatccccgaggacgacgacgagtgcagcgcctggctgcacaagctgtaccaggagaagggctggggcgacaccgagttcagcaagcagtacgtgagcgtgagcagacccggcagactggccctgtgccccagcgagaagatcgccgagcagcaggtggaggtggtgcacggcttcagcaagcagagcggcgagtag

SEQ ID NO: 16150 - DNA, 651 bp, Artificial Sequence
  Description of Artificial Sequence: Synthetic coding sequence
atggacctggccggcctgctgaagagccagttcctgtgccacctggtgttctgctacgtgttcatcgccagcggcctgatcatcaacaccatccagctgttcaccctgctgctgtggcccatcaacaagcagctgttcagaaagatcaactgcagactgagctactgcatcagcagcctgagcgccgtgtacgactgcaccctgaacttcagaaacaacgagaaccccaccctgctgggcgtgctgaacggcaagaagtaccacgccgacctgtacgtgagaagaatccccctggaggacatccccgaggacgacgacgagtgcagcgcctggctgcacaagctgtaccaggagaaggacgccttccaggaggagtactacagaaccggcaccttccccgagacccccatggtgccccccagaagaccctggaccctggtgaactggctgttctgggccagcctggtgctgtaccccttcttccagttcctggtgagcatgatcagaagcggcagcagcctgaccctggccagcttcatcctggtgttcttcgtggccagcgtgggcgtgagatggatgatcggcgtgaccgagatcgacaagggcagcgcctacggcaacagcgacagcaagcagaagctgaacgactag

SEQ ID NO: 16151 - DNA, 1095 bp, Artificial Sequence
  Description of Artificial Sequence: Synthetic coding sequence
atgctgctgagcctggtgctgcacacctacagcatgagatacctgctgcccagcgtggtgctgctgggcaccgcccccacctacgtgctggcctggggcgtgtggagactgctgagcgccttcctgcccgccagattctaccaggccctggacgacagactgtactgcgtgtaccagagcatggtgctgttcttcttcgagaactacaccggcgtgcagatcctgctgtacggcgacctgcccaagaacaaggagaacatcatctacctggccaaccaccagagcaccgtggactggatcgtggccgacatcctggccatcagacagaacgccctgggccacgtgagatacgtgctgaaggagggcctgaagtggctgcccctgtacggctgctacttcgcccagcacggcggcatctacgtgaagagaagcgccaagttcaacgagaaggagatgagaaacaagctgcagagctacgtggacgccggcacccccatgtacctggtgatcttccccgagggcaccagatacaaccccgagcagaccaaggtgctgagcgccagccaggccttcgccgcccagagaggcctggccgtgctgaagcacgtgctgacccccagaatcaaggccacccacgtggccttcgactgcatgaagaactacctggacgccatctacgacgtgaccgtggtgtacgagggcaaggacgacggcggccagagaagagagagccccaccatgaccgagttcctgtgcaaggagtgccccaagatccacatccacatcgacagaatcgacaagaaggacgtgcccgaggagcaggagcacatgagaagatggctgcacgagagattcgagatcaaggacaagatgctgatcgagttctacgagagccccgaccccgagagaagaaagagattccccggcaagagcgtgaacagcaagctgagcatcaagaagaccctgcccagcatgctgatcctgagcggcctgaccgccggcatgctgatgaccgacgccggcagaaagctgtacgtgaacacctggatctacggcaccctgctgggctgcctgtgggtgaccatcaaggcctag

SEQ ID NO: 16152 - DNA, 564 bp, Artificial Sequence
  Description of Artificial Sequence: Synthetic coding sequence
atgggcggcctgttctggagaagcgccctgagaggcctgagatgcggccccagagcccccggccccagcctgctggtgagacacggcagcggcggccccagctggaccagagagagaaccctggtggccgtgaagcccgacggcgtgcagagaagactggtgggcgacgtgatccagagattcgagagaagaggcttcaccctggtgggcatgaagatgctgcaggcccccgagagcgtgctggccgagcactaccaggacctgagaagaaagcccttctaccccgccctgatcagatacatgagcagcggccccgtggtggccatggtgtgggagggctacaacgtggtgagagccagcagagccatgatcggccacaccgacagcgccgaggccgcccccggcaccatcagaggcgacttcagcgtgcacatcagcagaaacgtgatccacgccagcgacagcgtggagggcgcccagagagagatccagctgtggttccagagcagcgagctggtgagctgggccgacggcggccagcacagcagcatccaccccgcctag

SEQ ID NO: 16153 - DNA, 636 bp, Artificial Sequence
  Description of Artificial Sequence: Synthetic coding sequence
atggcccagcccccccccgacgtggagggcgacgactgcctgcccgcctacagacacctgttctgccccgacctgctgagagacaaggtggccttcatcaccggcggcggcagcggcatcggcttcagaatcgccgagatcttcatgagagccagcgaggaccagatgggccactgcagcagcagcggcacctgcctggccggcgtggccaccttcatggtgatcgtgggcaagcagccccccaaccagaagagcagagagaccaaggagcagggcagacagatccccttcgtgtgcgtgagacacggctgccacaccgtgatcgccagcagaagcctgcccagagtgctgaccgccgccagaaagctggccggcgccaccggcagaagatgcctgcccctgagcatggacgtgagagccccccccgccgtgatggccgccgtggaccaggccctgaaggagttcggcagaatcgacatcctgatcaactgcagcagcagcagctgcggcctgcccttctgcagatgcggcagagagctgcccgtgcccagatggagactggtgctgcagagactgcaggacagagacggccacagataccagagacacctgcagtgcgtgagctgcgccctgtag

SEQ ID NO: 16154 - DNA, 813 bp, Artificial Sequence
  Description of Artificial Sequence: Synthetic coding sequence
atgcccagagacaacatggccagcctgatccagagaatcgccagacaggcctgcctgaccttcagaggcagcggcggcggcagaggcgccagcgacagagacgccgccagcggccccgaggcccccatgcagcccggcttccccgagaacctgagcaagctgaagagcctgctgacccagctgagagccgaggacctgaacatcgcccccagaaaggccaccctgcagcccctgccccccaacctgccccccgtgacctacatgcacatctacgagaccgacggcttcagcctgggcgtgttcctgctgaagagcggcaccagcatccccctgcacgaccaccccggcatgcacggcatgctgaaggtgctgtacggcaccgtgagaatcagctgcatggacaagctggacgccggcggcggccagagacccagagccctgccccccgagcagcagttcgagccccccctgcagcccagagagagagaggccgtgagacccggcgtgctgagaagcagagccgagtacaccgaggccagcggcccctgcatcctgaccccccacagagacaacctgcaccagatcgacgccgtggagggccccgccgccttcctggacatcctggcccccccctacgaccccgacgacggcagagactgccactactacagagtgctggagcccgtgagacccaaggaggccagcagcagcgcctgcgacctgcccagagaggtgtggctgctggagaccccccaggccgacgacttctggtgcgagggcgagccctaccccggccccaaggtgttcccctag

SEQ ID NO: 16155 - DNA, 1032 bp, Artificial Sequence
  Description of Artificial Sequence: Synthetic coding sequence
atgctggccaccagactgagcagacccctgagcagactgcccggcaagaccctgagcgcctgcgacagagagaacggcgccagaagacccctgctgctgggcagcaccagcttcatccccatcggcagaagaacctacgccagcgccgccgagcccgtgggcagcaaggccgtgctggtgaccggctgcgacagcggcttcggcttcagcctggccaagcacctgcacagcaagggcttcctggtgttcgccggctgcctgatgaaggacaagggccacgacggcgtgaaggagctggacagcctgaacagcgacagactgagaaccgtgcagctgaacgtgtgcagcagcgaggaggtggagaaggtggtggagatcgtgagaagcagcctgaaggaccccgagaagggcatgtggggcctggtgaacaacgccggcatcagcaccttcggcgaggtggagttcaccagcctggagacctacaagcaggtggccgaggtgaacctgtggggcaccgtgagaatgaccaagagcttcctgcccctgatcagaagagccaagggcagagtggtgaacatcagcagcatgctgggcagaatggccaaccccgccagaagcccctactgcatcaccaagttcggcgtggaggccttcagcgactgcctgagatacgagatgtaccccctgggcgtgaaggtgagcgtggtggagcccggcaacttcatcgccgccaccagcctgtacagccccgagagcatccaggccatcgccaagaagatgtgggaggagctgcccgaggtggtgagaaaggactacggcaagaagtacttcgacgagaagatcgccaagatggagacctactgcagcagcggcagcaccgacaccagccccgtgatcgacgccgtgacccacgccctgaccgccaccaccccctacaccagataccaccccatggactactactggtggctgagaatgcagatcatgacccacctgcccggcgccatcagcgacatgatctacatcagatag

SEQ ID NO: 16156 - DNA, 1032 bp, Artificial Sequence; identical to SEQ ID NO: 16155
  Description of Artificial Sequence: Synthetic coding sequence

SEQ ID NO: 16157 - DNA, 1032 bp, Artificial Sequence; identical to SEQ ID NO: 16155
  Description of Artificial Sequence: Synthetic coding sequence

SEQ ID NO: 16158 - DNA, 270 bp, Artificial Sequence
  Description of Artificial Sequence: Synthetic coding sequence
atgctggccaccagactgagcagacccctgagcagactgcccggcaagaccctgagcgcctgcgacagagagaacggcgccagaagacccctgctgctgggcagcaccagcttcatccccatcggcagaagaacctacgccagcgccgccgagcccgtgggcagcaaggccgtgctggtgaccggctgcgacagcggcttcggcttcagcctggccaagcacctgcacagcaagggcttcctggtgttcgccggctgcctgatgaagtag

SEQ ID NO: 16159 - DNA, 771 bp, Artificial Sequence
  Description of Artificial Sequence: Synthetic coding sequence
atgaaggacaagggccacgacggcgtgaaggagctggacagcctgaacagcgacagactgagaaccgtgcagctgaacgtgtgcagcagcgaggaggtggagaaggtggtggagatcgtgagaagcagcctgaaggaccccgagaagggcatgtggggcctggtgaacaacgccggcatcagcaccttcggcgaggtggagttcaccagcctggagacctacaagcaggtggccgaggtgaacctgtggggcaccgtgagaatgaccaagagcttcctgcccctgatcagaagagccaagggcagagtggtgaacatcagcagcatgctgggcagaatggccaaccccgccagaagcccctactgcatcaccaagttcggcgtggaggccttcagcgactgcctgagatacgagatgtaccccctgggcgtgaaggtgagcgtggtggagcccggcaacttcatcgccgccaccagcctgtacagccccgagagcatccaggccatcgccaagaagatgtgggaggagctgcccgaggtggtgagaaaggactacggcaagaagtacttcgacgagaagatcgccaagatggagacctactgcagcagcggcagcaccgacaccagccccgtgatcgacgccgtgacccacgccctgaccgccaccaccccctacaccagataccaccccatggactactactggtggctgagaatgcagatcatgacccacctgcccggcgccatcagcgacatgatctacatcagatag

SEQ ID NO: 16160 - DNA, 153 bp, Artificial Sequence
  Description of Artificial Sequence: Synthetic coding sequence
atgctggccaccagactgagcagacccctgagcagactgcccggcaagaccctgagcgcctgcgacagagagaacggcgccagaagacccctgctgctgggcagcaccagcttcatccccatcggcagaagaacctacgccagcgccgcctag

SEQ ID NO: 16161 - DNA, 1011 bp, Artificial Sequence
  Description of Artificial Sequence: Synthetic coding sequence
atggccgccagcctgagactgctgggcgccgccagcggcctgagatactggagcagaagactgagacccgccgccggcagcttcgccgccgtgtgcagcagaagcgtggccagcaagacccccgtgggcttcatcggcctgggcaacatgggcaaccccatggccaagaacctgatgaagcacggctaccccctgatcatctacgacgtgttccccgacgcctgcaaggagttccaggacgccggcgagcaggtggtgagcagccccgccgacgtggccgagaaggccgacagaatcatcaccatgctgcccaccagcatcaacgccatcgaggcctacagcggcgccaacggcatcctgaagaaggtgaagaagggcagcctgctgatcgacagcagcaccatcgaccccgccgtgagcaaggagctggccaaggaggtggagaagatgggcgccgtgttcatggacgcccccgtgagcggcggcgtgggcgccgccagaagcggcaacctgaccttcatggtgggcggcgtggaggacgagttcgccgccgcccaggagctgctgggctgcatgggcagcaacgtggtgtactgcggcgccgtgggcaccggccaggccgccaagatctgcaacaacatgctgctggccatcagcatgatcggcaccgccgaggccatgaacctgggcatcagactgggcctggaccccaagctgctggccaagatcctgaacatgagcagcggcagatgctggagcagcgacacctacaaccccgtgcccggcgtgatggacggcgtgcccagcgccaacaactaccagggcggcttcggcaccaccctgatggccaaggacctgggcctggcccaggacagcgccaccagcaccaagagccccatcctgctgggcagcctggcccaccagatctacagaatgatgtgcgccaagggctacagcaagaaggacttcagcagcgtgttccagttcctgagagaggaggagaccttctag

SEQ ID NO: 16162 - DNA, 1554 bp, Artificial Sequence
  Description of Artificial Sequence: Synthetic coding sequence
atggccgccctgagactgctggccagcgtgctgggcagaggcgtgcccgccggcggcagcggcctggccctgagccagggctgcgccagatgcttcgccaccagccccagactgagagccaagttctacgccgaccccgtggagatggtgaaggacatcagcgacggcgccaccgtgatgatcggcggcttcggcctgtgcggcatccccgagaacctgatcgccgccctgctgagaaccagagtgaaggacctgcaggtggtgagcagcaacgtgggcgtggaggacttcggcctgggcctgctgctggccgccagacaggtgagaagaatcgtgtgcagctacgtgggcgagaacaccctgtgcgagagccagtacctggccggcgagctggagctggagctgaccccccagggcaccctggccgagagaatcagagccggcggcgccggcgtgcccgccttctacacccccaccggctacggcaccctggtgcaggagggcggcgcccccatcagatacacccccgacggccacctggccctgatgagccagcccagagaggtgagagagttcaacggcgaccacttcctgctggagagagccatcagagccgacttcgccctggtgaagggctggaaggccgacagagccggcaacgtggtgttcagaagaagcgccagaaacttcaacgtgcccatgtgcaaggccgccgacgtgaccgccgtggaggtggaggagatcgtggaggtgggcgccttcccccccgaggacatccacgtgcccaacatctacgtggacagagtgatcaagggccagaagtacgagaagagaatcgagagactgaccatcctgaaggaggaggacggcgacgccggcaaggaggaggacgccagaaccagaatcatcagaagagccgccctggagttcgaggacggcatgtacgccaacctgggcatcggcatccccctgctggccagcaacttcatcagccccagcatgaccgtgcacctgcacagcgagaacggcatcctgggcctgggccccttccccaccgaggacgaggtggacgccgacctgatcaacgccggcaagcagaccgtgaccgtgctgcccggcggctgcttcttcgccagcgacgacagcttcgccatgatcagaggcggccacatccagctgaccatgctgggcgccatgcaggtgagcaagtacggcgacctggccaactggatgatccccggcaagaaggtgaagggcatgggcggcgccatggacctggtgagcagccagaagaccagagtggtggtgaccatgcagcactgcaccaaggacaacacccccaagatcatggagaagtgcaccatgcccctgaccggcaagagatgcgtggacagaatcatcaccgagaaggccgtgttcgacgtgcacagaaagaaggagctgaccctgagagagctgtgggagggcctgaccgtggacgacatcaagaagagcaccggctgcgccttcgccgtgagccccaacctgagacccatgcagcaggtggccccctag

SEQ ID NO: 16163 - DNA, 798 bp, Artificial Sequence
  Description of Artificial Sequence: Synthetic coding sequence
atggccgccctgagactgctggccagcgtgctgggcagaggcgtgcccgccggcggcagcggcctggccctgagccagggctgcgccagatgcttcgccaccagccccagactgagagccaagttctacgccgaccccgtggagatggtgaaggacatcagcgacggcgccaccgtgatgatcggcggcttcggcctgtgcggcatccccgagaacctgatcgccgccctgctgagaaccagagtgaaggacctgcaggtggtgagcagcaacgtgggcgtggaggacttcggcctgggcctgctgctggccgccagacaggtgagaagaatcgtgtgcagctacgtgggcgagaacaccctgtgcgagagccagtacctggccggcgagctggagctggagctgaccccccagggcaccctggccgagagaatcagagccggcggcgccggcgtgcccgccttctacacccccaccggctacggcaccctggtgcaggagggcggcgcccccatcagatacacccccgacggccacctggccctgatgagccagcccagagaggtgagagagttcaacggcgaccacttcctgctggagagagccatcagagccgacttcgccctggtgaagggctggaaggccgacagagccggcaacgtggtgttcagaagaagcgccagaaacttcaacgtgcccatgtgcaaggccgccgacgtgaccgccgtggaggtggaggagatcgtggaggtgggcgccagcccccagaagaccagcaccttcctgaccttcatgtag

SEQ ID NO: 16164 - DNA, 984 bp, Artificial Sequence
  Description of Artificial Sequence: Synthetic coding sequence
atgctgggcccccaggtgtggagcagcgtgagacagggcctgagcagaagcctgagcagaaacgtgggcgtgtgggccagcggcgagggcaagaaggtggacatcgccggcatctacccccccgtgaccacccccttcaccgccaccgccgaggtggactacggcaagctggaggagaacctgcacaagctgggcaccttccccttcagaggcttcgtggtgcagggcagcaacggcgagttccccttcctgaccagcagcgagagactggaggtggtgagcagagtgagacaggccatgcccaagaacagactgctgctggccggcagcggctgcgagagcacccaggccaccgtggagatgaccgtgagcatggcccaggtgggcgccgacgccgccatggtggtgaccccctgctactacagaggcagaatgagcagcgccgccctgatccaccactacaccaaggtggccgacctgagccccatccccgtggtgctgtacagcgtgcccgccaacaccggcctggacctgcccgtggacgccgtggtgaccctgagccagcaccccaacatcgtgggcatgaaggacagcggcggcgacgtgaccagaatcggcctgatcgtgcacaagaccagaaagcaggacttccaggtgctggccggcagcgccggcttcctgatggccagctacgccctgggcgccgtgggcggcgtgtgcgccctggccaacgtgctgggcgcccaggtgtgccagctggagagactgtgctgcaccggccagtgggaggacgcccagaagctgcagcacagactgatcgagcccaacgccgccgtgaccagaagattcggcatccccggcctgaagaagatcatggactggttcggctactacggcggcccctgcagagcccccctgcaggagctgagccccgccgaggaggaggccctgagaatggacttcaccagcaacggctggctgtag

SEQ ID NO: 16165 - DNA, 495 bp, Artificial Sequence
  Description of Artificial Sequence: Synthetic coding sequence
atgctgggcccccaggtgtggagcagcgtgagacagggcctgagcagaagcctgagcagaaacgtgggcgtgtgggccagcggcgagggcaagaaggtggacatcgccggcatctacccccccgtgaccacccccttcaccgccaccgccgaggtggactacggcaagctggaggagaacctgcacaagctgggcaccttccccttcagaggcgccgtgggcggcgtgtgcgccctggccaacgtgctgggcgcccaggtgtgccagctggagagactgtgctgcaccggccagtgggaggacgcccagaagctgcagcacagactgatcgagcccaacgccgccgtgaccagaagattcggcatccccggcctgaagaagatcatggactggttcggctactacggcggcccctgcagagcccccctgcaggagctgagccccgccgaggaggaggccctgagaatggacttcaccagcaacggctggctgtag

SEQ ID NO: 16166 - DNA, 612 bp, Artificial Sequence
  Description of Artificial Sequence: Synthetic coding sequence
atggccgccgccgccgtgagcagcgccaagagaagcctgagaggcgagctgaagcagagactgagagccatgagcgccgaggagagactgagacagagcagagtgctgagccagaaggtgatcgcccacagcgagtaccagaagagcaagagaatcagcatcttcctgagcatgcaggacgagatcgagaccgaggagatcatcaaggacatcttccagagaggcaagatctgcttcatccccagatacagattccagagcaaccacatggacatggtgagaatcgagagccccgaggagatcagcctgctgcccaagaccagctggaacatcccccagcccggcgagggcgacgtgagagaggaggccctgagcaccggcggcctggacctgatcttcatgcccggcctgggcttcgacaagcacggcaacagactgggcagaggcaagggctactacgacgcctacctgaagagatgcctgcagcaccaggaggtgaagccctacaccctggccctggccttcaaggagcagatctgcctgcaggtgcccgtgaacgagaacgacatgaaggtggacgaggtgctgtacgaggacagcagcaccgcctag

SEQ ID NO: 16167 - DNA, 1392 bp, Artificial Sequence
  Description of Artificial Sequence: Synthetic coding sequence
atgcacagaagcttcctgcaggccagaagaagcagaaacaccaccagacccgccctgctgagactgagcgactacctgctgaccaactacagaaagggcgtgagacccgtgagagactggagaaagcccaccaccgtgagcatcgacgtgatcgtgtacgccatcctgaacgtggacgagaagaaccaggtgctgaccacctacatctggtacagacagtactggaccgacgagttcctgcagtggaaccccgaggacttcgacaacatcaccaagctgagcatccccaccgacagcatctgggtgcccgacatcctgatcaacgagttcgtggacgtgggcaagagccccaacatcccctacgtgtacatcagacaccagggcgaggtgcagaactacaagcccctgcaggtggtgaccgcctgcagcctggacatctacaacttccccttcgacgtgcagaactgcagcctgaccttcaccagctggctgcacaccatccaggacatcaacatcagcctgtggagactgcccgagaaggtgaagagcgacagaagcgtgttcatgaaccagggcgagtgggagctgctgggcgtgctgccctacttcagagagttcagcatggagagcagcaactactacgccgagatgaagttctacgtggtgatcagaagaagacccctgttctacgtggtgagcctgctgctgcccagcatcttcctgatggtgatggacatcgtgggcttctacctgccccccaacagcggcgagagagtgagcttcaagatcaccctgctgctgggctacagcgtgttcctgatcatcgtgagcgacaccctgcccgccaccgccatcggcacccccctgatcggcgtgtacttcgtggtgtgcatggccctgctggtgatcagcctggccgagaccatcttcatcgtgagactggtgcacaagcaggacctgcagcagcccgtgcccgcctggctgagacacctggtgctggagagaatcgcctggctgctgtgcctgagagagcagagcaccagccagagaccccccgccaccagccaggccaccaagaccgacgactgcagcgccatgggcaaccactgcagccacatgggcggcccccaggacttcgagaagagccccagagacagatgcagccccccccccccccccagagaggccagcctggccgtgtgcggcctgctgcaggagctgagcagcatcagacagttcctggagaagagagacgagatcagagaggtggccagagactggctgagagtgggcagcgtgctggacaagctgctgttccacatctacctgctggccgtgctggcctacagcatcaccctggtgatgctgtggagcatctggcagtacgcctag

SEQ ID NO: 16168 - DNA, 1551 bp, Artificial Sequence
  Description of Artificial Sequence: Synthetic coding sequence
atgctgggcaagctggccatgctgctgtgggtgcagcaggccctgctggccctgctgctgcccaccctgctggcccagggcgaggccagaagaagcagaaacaccaccagacccgccctgctgagactgagcgactacctgctgaccaactacagaaagggcgtgagacccgtgagagactggagaaagcccaccaccgtgagcatcgacgtgatcgtgtacgccatcctgaacgtggacgagaagaaccaggtgctgaccacctacatctggtacagacagtactggaccgacgagttcctgcagtggaaccccgaggacttcgacaacatcaccaagctgagcatccccaccgacagcatctgggtgcccgacatcctgatcaacgagttcgtggacgtgggcaagagccccaacatcccctacgtgtacatcagacaccagggcgaggtgcagaactacaagcccctgcaggtggtgaccgcctgcagcctggacatctacaacttccccttcgacgtgcagaactgcagcctgaccttcaccagctggctgcacaccatccaggacatcaacatcagcctgtggagactgcccgagaaggtgaagagcgacagaagcgtgttcatgaaccagggcgagtgggagctgctgggcgtgctgccctacttcagagagttcagcatggagagcagcaactactacgccgagatgaagttctacgtggtgatcagaagaagacccctgttctacgtggtgagcctgctgctgcccagcatcttcctgatggtgatggacatcgtgggcttctacctgccccccaacagcggcgagagagtgagcttcaagatcaccctgctgctgggctacagcgtgttcctgatcatcgtgagcgacaccctgcccgccaccgccatcggcacccccctgatcggcaaggccccccccggcagcagagcccagagcggcgagaagcccgcccccagccacctgctgcacgtgagcctggccagcgccctgggctgcaccggcgtgtacttcgtggtgtgcatggccctgctggtgatcagcctggccgagaccatcttcatcgtgagactggtgcacaagcaggacctgcagcagcccgtgcccgcctggctgagacacctggtgctggagagaatcgcctggctgctgtgcctgagagagcagagcaccagccagagaccccccgccaccagccaggccaccaagaccgacgactgcagcgccatgggcaaccactgcagccacatgggcggcccccaggacttcgagaagagccccagagacagatgcagccccccccccccccccagagaggccagcctggccgtgtgcggcctgctgcaggagctgagcagcatcagacagttcctggagaagagagacgagatcagagaggtggccagagactggctgagagtgggcagcgtgctggacaagctgctgttccacatctacctgctggccgtgctggcctacagcatcaccctggtgatgctgtggagcatctggcagtacgcctag

SEQ ID NO: 16169 - DNA, 1455 bp, Artificial Sequence
  Description of Artificial Sequence: Synthetic coding sequence
atgctgggcaagctggccatgctgctgtgggtgcagcaggccctgctggccctgctgctgcccaccctgctggcccagggcgaggccagaagaagcagaaacaccaccagacccgccctgctgagactgagcgactacctgctgaccaactacagaaagggcgtgagacccgtgagagactggagaaagcccaccaccgtgagcatcgacgtgatcgtgtacgccatcctgaacgtggacgagaagaaccaggtgctgaccacctacatctggtacagacagtactggaccgacgagttcctgcagtggaaccccgaggacttcgacaacatcaccaagctgagcatccccaccgacagcatctgggtgcccgacatcctgatcaacgagttcgtggacgtgggcaagagccccaacatcccctacgtgtacatcagacaccagggcgaggtgcagaactacaagcccctgcaggtggtgaccgcctgcagcctggacatctacaacttccccttcgacgtgcagaactgcagcctgaccttcaccagctggctgcacaccatccaggacatcaacatcagcctgtggagactgcccgagaaggtgaagagcgacagaagcgtgttcatgaaccagggcgagtgggagctgctgggcgtgctgccctacttcagagagttcagcatggagagcagcaactactacgccgagatgaagttctacgtggtgatcagaagaagacccctgttctacgtggtgagcctgctgctgcccagcatcttcctgatggtgatggacatcgtgggcttctacctgccccccaacagcggcgagagagtgagcttcaagatcaccctgctgctgggctacagcgtgttcctgatcatcgtgagcgacaccctgcccgccaccgccatcggcacccccctgatcggcgtgtacttcgtggtgtgcatggccctgctggtgatcagcctggccgagaccatcttcatcgtgagactggtgcacaagcaggacctgcagcagcccgtgcccgcctggctgagacacctggtgctggagagaatcgcctggctgctgtgcctgagagagcagagcaccagccagagaccccccgccaccagccaggccaccaagaccgacgactgcagcgccatgggcaaccactgcagccacatgggcggcccccaggacttcgagaagagccccagagacagatgcagccccccccccccccccagagaggccagcctggccgtgtgcggcctgctgcaggagctgagcagcatcagacagttcctggagaagagagacgagatcagagaggtggccagagactggctgagagtgggcagcgtgctggacaagctgctgttccacatctacctgctggccgtgctggcctacagcatcaccctggtgatgctgtggagcatctggcagtacgcctag

SEQ ID NO: 16170 - DNA, 1437 bp, Artificial Sequence
  Description of Artificial Sequence: Synthetic coding sequence
atgctgctgtgggtgcagcaggccctgctggccctgctgctgcccaccctgctggcccagggcgaggccagaagaagcagaaacaccaccagacccgccctgctgagactgagcgactacctgctgaccaactacagaaagggcgtgagacccgtgagagactggagaaagcccaccaccgtgagcatcgacgtgatcgtgtacgccatcctgaacgtggacgagaagaaccaggtgctgaccacctacatctggtacagacagtactggaccgacgagttcctgcagtggaaccccgaggacttcgacaacatcaccaagctgagcatccccaccgacagcatctgggtgcccgacatcctgatcaacgagttcgtggacgtgggcaagagccccaacatcccctacgtgtacatcagacaccagggcgaggtgcagaactacaagcccctgcaggtggtgaccgcctgcagcctggacatctacaacttccccttcgacgtgcagaactgcagcctgaccttcaccagctggctgcacaccatccaggacatcaacatcagcctgtggagactgcccgagaaggtgaagagcgacagaagcgtgttcatgaaccagggcgagtgggagctgctgggcgtgctgccctacttcagagagttcagcatggagagcagcaactactacgccgagatgaagttctacgtggtgatcagaagaagacccctgttctacgtggtgagcctgctgctgcccagcatcttcctgatggtgatggacatcgtgggcttctacctgccccccaacagcggcgagagagtgagcttcaagatcaccctgctgctgggctacagcgtgttcctgatcatcgtgagcgacaccctgcccgccaccgccatcggcacccccctgatcggcgtgtacttcgtggtgtgcatggccctgctggtgatcagcctggccgagaccatcttcatcgtgagactggtgcacaagcaggacctgcagcagcccgtgcccgcctggctgagacacctggtgctggagagaatcgcctggctgctgtgcctgagagagcagagcaccagccagagaccccccgccaccagccaggccaccaagaccgacgactgcagcgccatgggcaaccactgcagccacatgggcggcccccaggacttcgagaagagccccagagacagatgcagccccccccccccccccagagaggccagcctggccgtgtgcggcctgctgcaggagctgagcagcatcagacagttcctggagaagagagacgagatcagagaggtggccagagactggctgagagtgggcagcgtgctggacaagctgctgttccacatctacctgctggccgtgctggcctacagcatcaccctggtgatgctgtggagcatctggcagtacgcctag

SEQ ID NO: 16171 - DNA, 1533 bp, Artificial Sequence
  Description of Artificial Sequence: Synthetic coding sequence
atgctgctgtgggtgcagcaggccctgctggccctgctgctgcccaccctgctggcccagggcgaggccagaagaagcagaaacaccaccagacccgccctgctgagactgagcgactacctgctgaccaactacagaaagggcgtgagacccgtgagagactggagaaagcccaccaccgtgagcatcgacgtgatcgtgtacgccatcctgaacgtggacgagaagaaccaggtgctgaccacctacatctggtacagacagtactggaccgacgagttcctgcagtggaaccccgaggacttcgacaacatcaccaagctgagcatccccaccgacagcatctgggtgcccgacatcctgatcaacgagttcgtggacgtgggcaagagccccaacatcccctacgtgtacatcagacaccagggcgaggtgcagaactacaagcccctgcaggtggtgaccgcctgcagcctggacatctacaacttccccttcgacgtgcagaactgcagcctgaccttcaccagctggctgcacaccatccaggacatcaacatcagcctgtggagactgcccgagaaggtgaagagcgacagaagcgtgttcatgaaccagggcgagtgggagctgctgggcgtgctgccctacttcagagagttcagcatggagagcagcaactactacgccgagatgaagttctacgtggtgatcagaagaagacccctgttctacgtggtgagcctgctgctgcccagcatcttcctgatggtgatggacatcgtgggcttctacctgccccccaacagcggcgagagagtgagcttcaagatcaccctgctgctgggctacagcgtgttcctgatcatcgtgagcgacaccctgcccgccaccgccatcggcacccccctgatcggcaaggccccccccggcagcagagcccagagcggcgagaagcccgcccccagccacctgctgcacgtgagcctggccagcgccctgggctgcaccggcgtgtacttcgtggtgtgcatggccctgctggtgatcagcctggccgagaccatcttcatcgtgagactggtgcacaagcaggacctgcagcagcccgtgcccgcctggctgagacacctggtgctggagagaatcgcctggctgctgtgcctgagagagcagagcaccagccagagaccccccgccaccagccaggccaccaagaccgacgactgcagcgccatgggcaaccactgcagccacatgggcggcccccaggacttcgagaagagccccagagacagatgcagccccccccccccccccagagaggccagcctggccgtgtgcggcctgctgcaggagctgagcagcatcagacagttcctggagaagagagacgagatcagagaggtggccagagactggctgagagtgggcagcgtgctggacaagctgctgttccacatctacctgctggccgtgctggcctacagcatcaccctggtgatgctgtggagcatctggcagtacgcctag

SEQ ID NO: 16172 - DNA, 717 bp, Artificial Sequence
  Description of Artificial Sequence: Synthetic coding sequence
atgctgctgtgggtgcagcaggccctgctggccctgctgctgcccaccctgctggcccagggcgaggccagaagaagcagaaacaccaccagacccgccctgctgagactgagcgactacctgctgaccaactacagaaagggcgtgagacccgtgagagactggagaaagcccaccaccgtgagcatcgacgtgatcgtgtacgccatcctgaacgtggacgagaagaaccaggtgctgaccacctacatctggtacagacagtactggaccgacgagttcctgcagtggaaccccgaggacttcgacaacatcaccaagctgagcatccccaccgacagcatctgggtgcccgacatcctgatcaacgagttcgtggacgtgggcaagagccccaacatcccctacgtgtacatcagacaccagggcgaggtgcagaactacaagcccctgcaggtggtgaccgcctgcagcctggacatctacaacttccccttcgacgtgcagaactgcagcctgaccttcaccagctggctgcacaccagcggccacccccccgccgcccccctgctgtgcggccagcccgccaccgcccagcacctgccccacggccacggccacagaggcctgctgcccgccccccagcagtggagagagggcctgttccaggactacaccccccccggcctgctgggcctgcccgaccacagattctag

SEQ ID NO: 16173 - DNA, 669 bp, Artificial Sequence
  Description of Artificial Sequence: Synthetic coding sequence
atggtgatggacatcgtgggcttctacctgccccccaacagcggcgagagagtgagcttcaagatcaccctgctgctgggctacagcgtgttcctgatcatcgtgagcgacaccctgcccgccaccgccatcggcacccccctgatcggcgtgtacttcgtggtgtgcatggccctgctggtgatcagcctggccgagaccatcttcatcgtgagactggtgcacaagcaggacctgcagcagcccgtgcccgcctggctgagacacctggtgctggagagaatcgcctggctgctgtgcctgagagagcagagcaccagccagagaccccccgccaccagccaggccaccaagaccgacgactgcagcgccatgggcaaccactgcagccacatgggcggcccccaggacttcgagaagagccccagagacagatgcagccccccccccccccccagagaggccagcctggccgtgtgcggcctgctgcaggagctgagcagcatcagacagttcctggagaagagagacgagatcagagaggtggccagagactggctgagagtgggcagcgtgctggacaagctgctgttccacatctacctgctggccgtgctggcctacagcatcaccctggtgatgctgtggagcatctggcagtacgcctag

SEQ ID NO: 16174 - DNA, 5349 bp, Artificial Sequence
  Description of Artificial Sequence: Synthetic coding sequence
atgggcgccggcagcagcaccgagcagagaagccccgagcagccccccgagggcagcagcacccccgccgagcccgagcccagcggcggcggccccagcgccgaggccgcccccgacaccaccgccgaccccgccatcgccgccagcgaccccgccaccaagctgctgcagaagaacggccagctgagcaccatcaacggcgtggccgagcaggacgagctgagcctgcaggagggcgacctgaacggccagaagggcgccctgaacggccagggcgccctgaacagccaggaggaggaggaggtgatcgtgaccgaggtgggccagagagacagcgaggacgtgagcaagagagacagcgacaaggagatggccaccaagagcgccgtggtgcacgacatcaccgacgacggccaggaggagacccccgagatcatcgagcagatccccagcagcgagagcaacctggaggagctgacccagcccaccgagagccaggccaacgacatcggcttcaagaaggtgttcaagttcgtgggcttcaagttcaccgtgaagaaggacaagaccgagaagcccgacaccgtgcagctgctgaccgtgaagaaggacgagggcgagggcgccgccggcgccggcgaccacaaggaccccagcctgggcgccggcgaggccgccagcaaggagagcgagcccaagcagagcaccgagaagcccgaggagaccctgaagagagagcagagccacgccgagatcagcccccccgccgagagcggccaggccgtggaggagtgcaaggaggagggcgaggagaagcaggagaaggagcccagcaagagcgccgagagccccaccagccccgtgaccagcgagaccggcagcaccttcaagaagttcttcacccagggctgggccggctggagaaagaagaccagcttcagaaagcccaaggaggacgaggtggaggccagcgagaagaagaaggagcaggagcccgagaaggtggacaccgaggaggacggcaaggccgaggtggccagcgagaagctgaccgccagcgagcaggcccacccccaggagcccgccgagagcgcccacgagcccagactgagcgccgagtacgagaaggtggagctgcccagcgaggagcaggtgagcggcagccagggccccagcgaggagaagcccgcccccctggccaccgaggtgttcgacgagaagatcgaggtgcaccaggaggaggtggtggccgaggtgcacgtgagcaccgtggaggagagaaccgaggagcagaagaccgaggtggaggagaccgccggcagcgtgcccgccgaggagctggtggagatggacgccgagccccaggaggccgagcccgccaaggagctggtgaagctgaaggagacctgcgtgagcggcgaggaccccacccagggcgccgacctgagccccgacgagaaggtgctgagcaagccccccgagggcgtggtgagcgaggtggagatgctgagcagccaggagagaatgaaggtgcagggcagccccctgaagaagctgttcaccagcaccggcctgaagaagctgagcggcaagaagcagaagggcaagagaggcggcggcgacgaggagagcggcgagcacacccaggtgcccgccgacagccccgacagccaggaggagcagaagggcgagagcagcgccagcagccccgaggagcccgaggagatcacctgcctggagaagggcctggccgaggtgcagcaggacggcgaggccgaggagggcgccaccagcgacggcgagaagaagagagagggcgtgaccccctgggccagcttcaagaagatggtgacccccaagaagagagtgagaagacccagcgagagcgacaaggaggacgagctggacaaggtgaagagcgccaccctgagcagcaccgagagcaccgccagcgagatgcaggaggagatgaagggcagcgtggaggagcccaagcccgaggagcccaagagaaaggtggacaccagcgtgagctgggaggccctgatctgcgtgggcagcagcaagaagagagccagaagaggcagcagcagcgacgaggagggcggccccaaggccatgggcggcgaccaccagaaggccgacgaggccggcaaggacaaggagaccggcaccgacggcatcctggccggcagccaggagcacgaccccggccagggcagcagcagccccgagcaggccggcagccccaccgagggcgagggcgtgagcacctgggagagcttcaagagactggtgacccccagaaagaagagcaagagcaagctggaggagaagagcgaggacagcatcgccggcagcggcgtggagcacagcacccccgacaccgagcccggcaaggaggagagctgggtgagcatcaagaagttcatccccggcagaagaaagaagagacccgacggcaagcaggagcaggcccccgtggaggacgccggccccaccggcgccaacgaggacgacagcgacgtgcccgccgtggtgcccctgagcgagtacgacgccgtggagagagagaagatggaggcccagcaggcccagaagagcgccgagcagcccgagcagaaggccgccaccgaggtgagcaaggagctgagcgagagccaggtgcacatgatggccgccgccgtggccgacggcaccagagccgccaccatcatcgaggagagaagccccagctggatcagcgccagcgtgaccgagcccctggagcaggtggaggccgaggccgccctgctgaccgaggaggtgctggagagagaggtgatcgccgaggaggagccccccaccgtgaccgagcccctgcccgagaacagagaggccagaggcgacaccgtggtgagcgaggccgagctgacccccgaggccgtgaccgccgccgagaccgccggccccctgggcgccgaggagggcaccgaggccagcgccgccgaggagaccaccgagatggtgagcgccgtgagccagctgaccgacagccccgacaccaccgaggaggccacccccgtgcaggaggtggagggcggcgtgcccgacatcgaggagcaggagagaagaacccaggaggtgctgcaggccgtggccgagaaggtgaaggaggagagccagctgcccggcaccggcggccccgaggacgtgctgcagcccgtgcagagagccgaggccgagagacccgaggagcaggccgaggccagcggcctgaagaaggagaccgacgtggtgctgaaggtggacgcccaggaggccaagaccgagcccttcacccagggcaaggtggtgggccagaccacccccgagagcttcgagaaggccccccaggtgaccgagagcatcgagagcagcgagctggtgaccacctgccaggccgagaccctggccggcgtgaagagccaggagatggtgatggagcaggccatcccccccgacagcgtggagacccccaccgacagcgagaccgacggcagcacccccgtggccgacttcgacgcccccggcaccacccagaaggacgagatcgtggagatccacgaggagaacgaggtggccagcggcacccagagcggcggcaccgaggccgaggccgtgcccgcccagaaggagagaccccccgcccccagcagcttcgtgttccaggaggagaccaaggagcagagcaagatggaggacaccctggagcacaccgacaaggaggtgagcgtggagaccgtgagcatcctgagcaagaccgagggcacccaggaggccgaccagtacgccgacgagaagaccaaggacgtgcccttcttcgagggcctggagggcagcatcgacaccggcatcaccgtgagcagagagaaggtgaccgaggtggccctgaagggcgagggcaccgaggaggccgagtgcaagaaggacgacgccctggagctgcagagccacgccaagagcccccccagccccgtggagagagagatggtggtgcaggtggagagagagaagaccgaggccgagcccacccacgtgaacgaggagaagctggagcacgagaccgccgtgaccgtgagcgaggaggtgagcaagcagctgctgcagaccgtgaacgtgcccatcatcgacggcgccaaggaggtgagcagcctggagggcagcccccccccctgcctgggccaggaggaggccgtgtgcaccaagatccaggtgcagagcagcgaggccagcttcaccctgaccgccgccgccgaggaggagaaggtgctgggcgagaccgccaacatcctggagaccggcgagaccctggagcccgccggcgcccacctggtgctggaggagaagagcagcgagaagaacgaggacttcgccgcccaccccggcgaggacgccgtgcccaccggccccgactgccaggccaagagcacccccgtgatcgtgagcgccaccaccaagaagggcctgagcagcgacctggagggcgagaagaccaccagcctgaagtggaagagcgacgaggtggacgagcaggtggcctgccaggaggtgaaggtgagcgtggccatcgaggacctggagcccgagaacggcatcctggagctggagaccaagagcagcaagctggtgcagaacatcatccagaccgccgtggaccagttcgtgagaaccgaggagaccgccaccgagatgctgaccagcgagctgcagacccaggcccacgtgatcaaggccgacagccaggacgccggccaggagaccgagaaggagggcgaggagccccaggccagcgcccaggacgagacccccatcaccagcgccaaggaggagagcgagagcaccgccgtgggccaggcccacagcgacatcagcaaggacatgagcgaggccagcgagaagaccatgaccgtggaggtggagggcagcaccgtgaacgaccagcagctggaggaggtggtgctgcccagcgaggaggagggcggcggcgccggcaccaagagcgtgcccgaggacgacggccacgccctgctggccgagagaatcgagaagagcctggtggagcccaaggaggacgagaagggcgacgacgtggacgaccccgagaaccagaacagcgccctggccgacaccgacgccagcggcggcctgaccaaggagagccccgacaccaacggccccaagcagaaggagaaggaggacgcccaggaggtggagctgcaggagggcaaggtgcacagcgagagcgacaaggccatcaccccccaggcccaggaggagctgcagaagcaggagagagagagcgccaagagcgagctgaccgagagctag

SEQ ID NO: 16175 - DNA, 5055 bp, Artificial Sequence
  Description of Artificial Sequence: Synthetic coding sequence
atgctgggcaccatcaccatcaccgtgggccagagagacagcgaggacgtgagcaagagagacagcgacaaggagatggccaccaagagcgccgtggtgcacgacatcaccgacgacggccaggaggagacccccgagatcatcgagcagatccccagcagcgagagcaacctggaggagctgacccagcccaccgagagccaggccaacgacatcggcttcaagaaggtgttcaagttcgtgggcttcaagttcaccgtgaagaaggacaagaccgagaagcccgacaccgtgcagctgctgaccgtgaagaaggacgagggcgagggcgccgccggcgccggcgaccacaaggaccccagcctgggcgccggcgaggccgccagcaaggagagcgagcccaagcagagcaccgagaagcccgaggagaccctgaagagagagcagagccacgccgagatcagcccccccgccgagagcggccaggccgtggaggagtgcaaggaggagggcgaggagaagcaggagaaggagcccagcaagagcgccgagagccccaccagccccgtgaccagcgagaccggcagcaccttcaagaagttcttcacccagggctgggccggctggagaaagaagaccagcttcagaaagcccaaggaggacgaggtggaggccagcgagaagaagaaggagcaggagcccgagaaggtggacaccgaggaggacggcaaggccgaggtggccagcgagaagctgaccgccagcgagcaggcccacccccaggagcccgccgagagcgcccacgagcccagactgagcgccgagtacgagaaggtggagctgcccagcgaggagcaggtgagcggcagccagggccccagcgaggagaagcccgcccccctggccaccgaggtgttcgacgagaagatcgaggtgcaccaggaggaggtggtggccgaggtgcacgtgagcaccgtggaggagagaaccgaggagcagaagaccgaggtggaggagaccgccggcagcgtgcccgccgaggagctggtggagatggacgccgagccccaggaggccgagcccgccaaggagctggtgaagctgaaggagacctgcgtgagcggcgaggaccccacccagggcgccgacctgagccccgacgagaaggtgctgagcaagccccccgagggcgtggtgagcgaggtggagatgctgagcagccaggagagaatgaaggtgcagggcagccccctgaagaagctgttcaccagcaccggcctgaagaagctgagcggcaagaagcagaagggcaagagaggcggcggcgacgaggagagcggcgagcacacccaggtgcccgccgacagccccgacagccaggaggagcagaagggcgagagcagcgccagcagccccgaggagcccgaggagatcacctgcctggagaagggcctggccgaggtgcagcaggacggcgaggccgaggagggcgccaccagcgacggcgagaagaagagagagggcgtgaccccctgggccagcttcaagaagatggtgacccccaagaagagagtgagaagacccagcgagagcgacaaggaggacgagctggacaaggtgaagagcgccaccctgagcagcaccgagagcaccgccagcgagatgcaggaggagatgaagggcagcgtggaggagcccaagcccgaggagcccaagagaaaggtggacaccagcgtgagctgggaggccctgatctgcgtgggcagcagcaagaagagagccagaagaggcagcagcagcgacgaggagggcggccccaaggccatgggcggcgaccaccagaaggccgacgaggccggcaaggacaaggagaccggcaccgacggcatcctggccggcagccaggagcacgaccccggccagggcagcagcagccccgagcaggccggcagccccaccgagggcgagggcgtgagcacctgggagagcttcaagagactggtgacccccagaaagaagagcaagagcaagctggaggagaagagcgaggacagcatcgccggcagcggcgtggagcacagcacccccgacaccgagcccggcaaggaggagagctgggtgagcatcaagaagttcatccccggcagaagaaagaagagacccgacggcaagcaggagcaggcccccgtggaggacgccggccccaccggcgccaacgaggacgacagcgacgtgcccgccgtggtgcccctgagcgagtacgacgccgtggagagagagaagatggaggcccagcaggcccagaagagcgccgagcagcccgagcagaaggccgccaccgaggtgagcaaggagctgagcgagagccaggtgcacatgatggccgccgccgtggccgacggcaccagagccgccaccatcatcgaggagagaagccccagctggatcagcgccagcgtgaccgagcccctggagcaggtggaggccgaggccgccctgctgaccgaggaggtgctggagagagaggtgatcgccgaggaggagccccccaccgtgaccgagcccctgcccgagaacagagaggccagaggcgacaccgtggtgagcgaggccgagctgacccccgaggccgtgaccgccgccgagaccgccggccccctgggcgccgaggagggcaccgaggccagcgccgccgaggagaccaccgagatggtgagcgccgtgagccagctgaccgacagccccgacaccaccgaggaggccacccccgtgcaggaggtggagggcggcgtgcccgacatcgaggagcaggagagaagaacccaggaggtgctgcaggccgtggccgagaaggtgaaggaggagagccagctgcccggcaccggcggccccgaggacgtgctgcagcccgtgcagagagccgaggccgagagacccgaggagcaggccgaggccagcggcctgaagaaggagaccgacgtggtgctgaaggtggacgcccaggaggccaagaccgagcccttcacccagggcaaggtggtgggccagaccacccccgagagcttcgagaaggccccccaggtgaccgagagcatcgagagcagcgagctggtgaccacctgccaggccgagaccctggccggcgtgaagagccaggagatggtgatggagcaggccatcccccccgacagcgtggagacccccaccgacagcgagaccgacggcagcacccccgtggccgacttcgacgcccccggcaccacccagaaggacgagatcgtggagatccacgaggagaacgaggtggccagcggcacccagagcggcggcaccgaggccgaggccgtgcccgcccagaaggagagaccccccgcccccagcagcttcgtgttccaggaggagaccaaggagcagagcaagatggaggacaccctggagcacaccgacaaggaggtgagcgtggagaccgtgagcatcctgagcaagaccgagggcacccaggaggccgaccagtacgccgacgagaagaccaaggacgtgcccttcttcgagggcctggagggcagcatcgacaccggcatcaccgtgagcagagagaaggtgaccgaggtggccctgaagggcgagggcaccgaggaggccgagtgcaagaaggacgacgccctggagctgcagagccacgccaagagcccccccagccccgtggagagagagatggtggtgcaggtggagagagagaagaccgaggccgagcccacccacgtgaacgaggagaagctggagcacgagaccgccgtgaccgtgagcgaggaggtgagcaagcagctgctgcagaccgtgaacgtgcccatcatcgacggcgccaaggaggtgagcagcctggagggcagcccccccccctgcctgggccaggaggaggccgtgtgcaccaagatccaggtgcagagcagcgaggccagcttcaccctgaccgccgccgccgaggaggagaaggtgctgggcgagaccgccaacatcctggagaccggcgagaccctggagcccgccggcgcccacctggtgctggaggagaagagcagcgagaagaacgaggacttcgccgcccaccccggcgaggacgccgtgcccaccggccccgactgccaggccaagagcacccccgtgatcgtgagcgccaccaccaagaagggcctgagcagcgacctggagggcgagaagaccaccagcctgaagtggaagagcgacgaggtggacgagcaggtggcctgccaggaggtgaaggtgagcgtggccatcgaggacctggagcccgagaacggcatcctggagctggagaccaagagcagcaagctggtgcagaacatcatccagaccgccgtggaccagttcgtgagaaccgaggagaccgccaccgagatgctgaccagcgagctgcagacccaggcccacgtgatcaaggccgacagccaggacgccggccaggagaccgagaaggagggcgaggagccccaggccagcgcccaggacgagacccccatcaccagcgccaaggaggagagcgagagcaccgccgtgggccaggcccacagcgacatcagcaaggacatgagcgaggccagcgagaagaccatgaccgtggaggtggagggcagcaccgtgaacgaccagcagctggaggaggtggtgctgcccagcgaggaggagggcggcggcgccggcaccaagagcgtgcccgaggacgacggccacgccctgctggccgagagaatcgagaagagcctggtggagcccaaggaggacgagaagggcgacgacgtggacgaccccgagaaccagaacagcgccctggccgacaccgacgccagcggcggcctgaccaaggagagccccgacaccaacggccccaagcagaaggagaaggaggacgcccaggaggtggagctgcaggagggcaaggtgcacagcgagagcgacaaggccatcaccccccaggcccaggaggagctgcagaagcaggagagagagagcgccaagagcgagctgaccgagagctag

SEQ ID NO: 16176 - DNA, 5034 bp, Artificial Sequence
  Description of Artificial Sequence: Synthetic coding sequence
atggtgggccagagagacagcgaggacgtgagcaagagagacagcgacaaggagatggccaccaagagcgccgtggtgcacgacatcaccgacgacggccaggaggagacccccgagatcatcgagcagatccccagcagcgagagcaacctggaggagctgacccagcccaccgagagccaggccaacgacatcggcttcaagaaggtgttcaagttcgtgggcttcaagttcaccgtgaagaaggacaagaccgagaagcccgacaccgtgcagctgctgaccgtgaagaaggacgagggcgagggcgccgccggcgccggcgaccacaaggaccccagcctgggcgccggcgaggccgccagcaaggagagcgagcccaagcagagcaccgagaagcccgaggagaccctgaagagagagcagagccacgccgagatcagcccccccgccgagagcggccaggccgtggaggagtgcaaggaggagggcgaggagaagcaggagaaggagcccagcaagagcgccgagagccccaccagccccgtgaccagcgagaccggcagcaccttcaagaagttcttcacccagggctgggccggctggagaaagaagaccagcttcagaaagcccaaggaggacgaggtggaggccagcgagaagaagaaggagcaggagcccgagaaggtggacaccgaggaggacggcaaggccgaggtggccagcgagaagctgaccgccagcgagcaggcccacccccaggagcccgccgagagcgcccacgagcccagactgagcgccgagtacgagaaggtggagctgcccagcgaggagcaggtgagcggcagccagggccccagcgaggagaagcccgcccccctggccaccgaggtgttcgacgagaagatcgaggtgcaccaggaggaggtggtggccgaggtgcacgtgagcaccgtggaggagagaaccgaggagcagaagaccgaggtggaggagaccgccggcagcgtgcccgccgaggagctggtggagatggacgccgagccccaggaggccgagcccgccaaggagctggtgaagctgaaggagacctgcgtgagcggcgaggaccccacccagggcgccgacctgagccccgacgagaaggtgctgagcaagccccccgagggcgtggtgagcgaggtggagatgctgagcagccaggagagaatgaaggtgcagggcagccccctgaagaagctgttcaccagcaccggcctgaagaagctgagcggcaagaagcagaagggcaagagaggcggcggcgacgaggagagcggcgagcacacccaggtgcccgccgacagccccgacagccaggaggagcagaagggcgagagcagcgccagcagccccgaggagcccgaggagatcacctgcctggagaagggcctggccgaggtgcagcaggacggcgaggccgaggagggcgccaccagcgacggcgagaagaagagagagggcgtgaccccctgggccagcttcaagaagatggtgacccccaagaagagagtgagaagacccagcgagagcgacaaggaggacgagctggacaaggtgaagagcgccaccctgagcagcaccgagagcaccgccagcgagatgcaggaggagatgaagggcagcgtggaggagcccaagcccgaggagcccaagagaaaggtggacaccagcgtgagctgggaggccctgatctgcgtgggcagcagcaagaagagagccagaagaggcagcagcagcgacgaggagggcggccccaaggccatgggcggcgaccaccagaaggccgacgaggccggcaaggacaaggagaccggcaccgacggcatcctggccggcagccaggagcacgaccccggccagggcagcagcagccccgagcaggccggcagccccaccgagggcgagggcgtgagcacctgggagagcttcaagagactggtgacccccagaaagaagagcaagagcaagctggaggagaagagcgaggacagcatcgccggcagcggcgtggagcacagcacccccgacaccgagcccggcaaggaggagagctgggtgagcatcaagaagttcatccccggcagaagaaagaagagacccgacggcaagcaggagcaggcccccgtggaggacgccggccccaccggcgccaacgaggacgacagcgacgtgcccgccgtggtgcccctgagcgagtacgacgccgtggagagagagaagatggaggcccagcaggcccagaagagcgccgagcagcccgagcagaaggccgccaccgaggtgagcaaggagctgagcgagagccaggtgcacatgatggccgccgccgtggccgacggcaccagagccgccaccatcatcgaggagagaagccccagctggatcagcgccagcgtgaccgagcccctggagcaggtggaggccgaggccgccctgctgaccgaggaggtgctggagagagaggtgatcgccgaggaggagccccccaccgtgaccgagcccctgcccgagaacagagaggccagaggcgacaccgtggtgagcgaggccgagctgacccccgaggccgtgaccgccgccgagaccgccggccccctgggcgccgaggagggcaccgaggccagcgccgccgaggagaccaccgagatggtgagcgccgtgagccagctgaccgacagccccgacaccaccgaggaggccacccccgtgcaggaggtggagggcggcgtgcccgacatcgaggagcaggagagaagaacccaggaggtgctgcaggccgtggccgagaaggtgaaggaggagagccagctgcccggcaccggcggccccgaggacgtgctgcagcccgtgcagagagccgaggccgagagacccgaggagcaggccgaggccagcggcctgaagaaggagaccgacgtggtgctgaaggtggacgcccaggaggccaagaccgagcccttcacccagggcaaggtggtgggccagaccacccccgagagcttcgagaaggccccccaggtgaccgagagcatcgagagcagcgagctggtgaccacctgccaggccgagaccctggccggcgtgaagagccaggagatggtgatggagcaggccatcccccccgacagcgtggagacccccaccgacagcgagaccgacggcagcacccccgtggccgacttcgacgcccccggcaccacccagaaggacgagatcgtggagatccacgaggagaacgaggtggccagcggcacccagagcggcggcaccgaggccgaggccgtgcccgcccagaaggagagaccccccgcccccagcagcttcgtgttccaggaggagaccaaggagcagagcaagatggaggacaccctggagcacaccgacaaggaggtgagcgtggagaccgtgagcatcctgagcaagaccgagggcacccaggaggccgaccagtacgccgacgagaagaccaaggacgtgcccttcttcgagggcctggagggcagcatcgacaccggcatcaccgtgagcagagagaaggtgaccgaggtggccctgaagggcgagggcaccgaggaggccgagtgcaagaaggacgacgccctggagctgcagagccacgccaagagcccccccagccccgtggagagagagatggtggtgcaggtggagagagagaagaccgaggccgagcccacccacgtgaacgaggagaagctggagcacgagaccgccgtgaccgtgagcgaggaggtgagcaagcagctgctgcagaccgtgaacgtgcccatcatcgacggcgccaaggaggtgagcagcctggagggcagcccccccccctgcctgggccaggaggaggccgtgtgcaccaagatccaggtgcagagcagcgaggccagcttcaccctgaccgccgccgccgaggaggagaaggtgctgggcgagaccgccaacatcctggagaccggcgagaccctggagcccgccggcgcccacctggtgctggaggagaagagcagcgagaagaacgaggacttcgccgcccaccccggcgaggacgccgtgcccaccggccccgactgccaggccaagagcacccccgtgatcgtgagcgccaccaccaagaagggcctgagcagcgacctggagggcgagaagaccaccagcctgaagtggaagagcgacgaggtggacgagcaggtggcctgccaggaggtgaaggtgagcgtggccatcgaggacctggagcccgagaacggcatcctggagctggagaccaagagcagcaagctggtgcagaacatcatccagaccgccgtggaccagttcgtgagaaccgaggagaccgccaccgagatgctgaccagcgagctgcagacccaggcccacgtgatcaaggccgacagccaggacgccggccaggagaccgagaaggagggcgaggagccccaggccagcgcccaggacgagacccccatcaccagcgccaaggaggagagcgagagcaccgccgtgggccaggcccacagcgacatcagcaaggacatgagcgaggccagcgagaagaccatgaccgtggaggtggagggcagcaccgtgaacgaccagcagctggaggaggtggtgctgcccagcgaggaggagggcggcggcgccggcaccaagagcgtgcccgaggacgacggccacgccctgctggccgagagaatcgagaagagcctggtggagcccaaggaggacgagaagggcgacgacgtggacgaccccgagaaccagaacagcgccctggccgacaccgacgccagcggcggcctgaccaaggagagccccgacaccaacggccccaagcagaaggagaaggaggacgcccaggaggtggagctgcaggagggcaaggtgcacagcgagagcgacaaggccatcaccccccaggcccaggaggagctgcagaagcaggagagagagagcgccaagagcgagctgaccgagagctag

SEQ ID NO: 16177 - DNA, 5349 bp, Artificial Sequence; identical to SEQ ID NO: 16174
  Description of Artificial Sequence: Synthetic coding sequence

SEQ ID NO: 16178 - DNA, 1284 bp, Artificial Sequence
  Description of Artificial Sequence: Synthetic coding sequence
atggagaccaccatcagcgagatccacgtggagaacaaggacgagaagagaagcgccgagggcagccccggcgccgagagacagaaggagaaggccagcatgctgtgcttcaagagaagaaagaaggccgccaaggccctgaagcccaaggccggcagcgaggccgccgacgtggccagaaagtgcccccaggaggccggcgccagcgaccagcccgagcccaccagaggcgcctgggccagcctgaagagactggtgaccagaagaaagagaagcgagagcagcaagcagcagaagcccctggagggcgagatgcagcccgccatcaacgccgaggacgccgacctgagcaagaagaaggccaagagcagactgaagatcccctgcatcaagttccccagaggccccaagagaagcaaccacagcaagatcatcgaggacagcgactgcagcatcaaggtgcaggaggaggccgagatcctggacatccagacccagacccccctgaacgaccaggccaccaaggccaagagcacccaggacctgagcgagggcatcagcagaaaggacggcgacgaggtgtgcgagagcaacgtgagcaacagcaccaccagcggcgagaaggtgatcagcgtggagctgggcctggacaacggccacagcgccatccagaccggcaccctgatcctggaggagatcgagaccatcaaggagaagcaggacgtgcagccccagcaggccagccccctggagaccagcgagaccgaccaccagcagcccgtgctgagcgacgtgccccccctgcccgccatccccgaccagcagatcgtggaggaggccagcaacagcaccctggagagcgcccccaacggcaaggactacgagagcaccgagatcgtggccgaggagaccaagcccaaggacaccgagctgagccaggagagcgacttcaaggagaacggcatcaccgaggagaagagcaagagcgaggagagcaagagaatggagcccatcgccatcatcatcaccgacaccgagatcagcgagttcgacgtgaccaagagcaagaacgtgcccaagcagttcctgatcagcgccgagaacgagcaggtgggcgtgttcgccaacgacaacggcttcgaggacagaaccagcgagcagtacgagaccctgctgatcgagaccgccagcagcctggtgaagaacgccatccagctgagcatcgagcagctggtgaacgagatggccagcgacgacaacaagatcaacaacctgctgcagtag

SEQ ID NO: 16179 - DNA, 1284 bp, Artificial Sequence; identical to SEQ ID NO: 16178
  Description of Artificial Sequence: Synthetic coding sequence

SEQ ID NO: 16180 - DNA, 6960 bp, Artificial Sequence
  Description of Artificial Sequence: Synthetic coding sequence
atgctgaccatgagcgtgaccctgagccccctgagaagccaggacctggaccccatggccaccgacgccagccccatggccatcaacatgacccccaccgtggagcagggcgagggcgaggaggccatgaaggacatggacagcgaccagcagtacgagaagcccccccccctgcacaccggcgccgactggaagatcgtgctgcacctgcccgagatcgagacctggctgagaatgaccagcgagagagtgagagacctgacctacagcgtgcagcaggacagcgacagcaagcacgtggacgtgcacctggtgcagctgaaggacatctgcgaggacatcagcgaccacgtggagcagatccacgccctgctggagaccgagttcagcctgaagctgctgagctacagcgtgaacgtgatcgtggacatccacgccgtgcagctgctgtggcaccagctgagagtgagcgtgctggtgctgagagagagaatcctgcagggcctgcaggacgccaacggcaactacaccagacagaccgacatcctgcaggccttcagcgaggagaccaaggagggcagactggacagcctgaccgaggtggacgacagcggccagctgaccatcaagtgcagccagaactacctgagcctggactgcggcatcaccgccttcgagctgagcgactacagccccagcgaggacctgctgagcggcctgggcgacatgaccagcagccaggtgaagaccaagcccttcgacagctggagctacagcgagatggagaaggagttccccgagctgatcagaagcgtgggcctgctgaccgtggccgccgacagcatcagcaccaacggcagcgaggccgtgaccgaggaggtgagccaggtgagcctgagcgtggacgacaagggcggctgcgaggaggacaacgccagcgccgtggaggagcagcccggcctgaccctgggcgtgagcagcagcagcggcgaggccctgaccaacgccgcccagcccagcagcgagaccgtgcagcaggagagcagcagcagcagccaccacgacgccaagaaccagcagcccgtgccctgcgagaacgccacccccaagagaaccatcagagactgcttcaactacaacgaggacagccccacccagcccaccctgcccaagagaggcctgttcctgaaggaggagaccttcaagaacgacctgaagggcaacggcggcaagagacagatggtggacctgaagcccgagatgagcagaagcacccccagcctggtggacccccccgacagaagcaagctgtgcctggtgctgcagagcagctaccccaacagccccagcgccgccagccagagctacgagtgcctgcacaaggtgggcaacggcaacctggagaacaccgtgaagttccacatcaaggagatcagcagcagcctgggcagactgaacgactgctacaaggagaagagcagactgaagaagccccacaagaccagcgaggaggtgcccccctgcagaacccccaagagaggcaccggcagcggcaagcaggccaagaacaccaagagcagcgccgtgcccaacggcgagctgagctacaccagcaaggccatcgagggcccccagaccaacagcgccagcaccagcagcctggagccctgcaaccagagaagctggaacgccaagctgcagctgcagagcgagaccagcagcagccccgccttcacccagagcagcgagagcagcgtgggcagcgacaacatcatgagccccgtgcccctgctgagcaagcacaagagcaagaagggccaggccagcagccccagccacgtgaccagaaacggcgaggtggtggaggcctggtacggcagcgacgagtacctggccctgcccagccacctgaagcagaccgaggtgctggccctgaagctggagaacctgaccaagctgctgccccagaagcccagaggcgagaccatccagaacatcgacgactgggagctgagcgagatgaacagcgacagcgagatctaccccacctaccacgtgaagaagaagcacaccagactgggcagagtgagccccagcagcagcagcgacatcgccagcagcctgggcgagagcatcgagagcggccccctgagcgacatcctgagcgacgaggagagcagcatgcccctggccggcatgaagaagtacgccgacgagaagagcgagagagccagcagcagcgagaagaacgagagccacagcgccaccaagagcgccctgatccagaagctgatgcaggacatccagcaccaggacaactacgaggccatctgggagaagatcgagggcttcgtgaacaagctggacgagttcatccagtggctgaacgaggccatggagaccaccgagaactggaccccccccaaggccgagatggacgacctgaagctgtacctggagacccacctgagcttcaagctgaacgtggacagccactgcgccctgaaggaggccgtggaggaggagggccaccagctgctggagctgatcgccagccacaaggccggcctgaaggacatgctgagaatgatcgccagccagtggaaggagctgcagagacagatcaagagacagcacagctggatcctgagagccctggacaccatcaaggccgagatcctggccaccgacgtgagcgtggaggacgaggagggcaccggcagccccaaggccgaggtgcagctgtgctacctggaggcccagagagacgccgtggagcagatgagcctgaagctgtacagcgagcagtacaccagcagcagcaagagaaaggaggagttcgccgacatgagcaaggtgcacagcgtgggcagcaacggcctgctggacttcgacagcgagtaccaggagctgtgggactggctgatcgacatggagagcctggtgatggacagccacgacctgatgatgagcgaggagcagcagcagcacctgtacaagagatacagcgtggagatgagcatcagacacctgaagaagaccgagctgctgagcaaggtggaggccctgaagaagggcggcgtgctgctgcccaacgacctgctggagaaggtggacagcatcaacgagaagtgggagctgctgggcaagaccctgggcgagaagatccaggacaccatggccggccacagcggcagcagccccagagacctgctgagccccgagagcggcagcctggtgagacagctggaggtgagaatcaaggagctgaagggctggctgagagacaccgagctgttcatcttcaacagctgcctgagacaggagaaggagggcaccatgaacaccgagaagcagctgcagtacttcaagagcctgtgcagagagatcaagcagagaagaagaggcgtggccagcatcctgagactgtgccagcacctgctggacgacagagagacctgcaacctgaacgccgaccaccagcccatgcagctgatcatcgtgaacctggagagaagatgggaggccatcgtgatgcaggccgtgcagtggcagaccagactgcagaagaagatgggcaaggagagcgagaccctgaacgtgatcgaccccggcctgatggacctgaacggcatgagcgaggacgccctggagtgggacgagatggacatcagcaacaagctgatcagcctgaacgaggagagcaacgacctggaccaggagctgcagcccgtgatccccagcctgaagctgggcgagaccagcaacgaggaccccggctacgacgaggaggccgacaaccacggcggcagccagtacgccagcaacatcaccgcccccagcagcccccacatctaccaggtgtacagcctgcacaacgtggagctgtacgaggacaaccacatgcccttcctgaagaacaaccccaaggtgaccggcatgacccagcccaacgtgctgaccaagagcctgagcaaggacagcagcttcagcagcaccaagagcctgcccgacctgctgggcggcagcaacctggtgaagccctgcgcctgccacggcggcgacatgagccagaacagcggcagcgagagcggcatcgtgagcgagggcgacaccgagaccaccaccaacagcgagatgtgcctgctgaacgccgtggacggcagccccagcaacctggagaccgagcacctggacccccagatgggcgacgccgtgaacgtgctgaagcagaagttcaccgacgagggcgagagcatcaagctgcccaacagcagccagagcagcatcagccccgtgggctgcgtgaacggcaaggtgggcgacctgaacagcatcaccaagcacacccccgactgcctgggcgaggagctgcagggcaagcacgacgtgttcaccttctacgactacagctacctgcagggcagcaagctgaagctgcccatgatcatgaagcagagccagagcgagaaggcccacgtggaggaccccctgctgagaggcttctacttcgacaagaagagctgcaagagcaagcaccagaccaccgagctgcagcccgacgtgcccccccacgagagaatcctggccagcgccagccacgagatggacagaatcagctacaagagcggcaacatcgagaagaccttcaccggcatgcagaacgccaagcagctgagcctgctgagccacagcagcagcatcgagagcctgagccccggcggcgacctgttcggcctgggcatcttcaagaacggcagcgacagcctgcagagaagcaccagcctggagagctggctgaccagctacaagagcaacgaggacctgttcagctgccacagcagcggcgacatcagcgtgagcagcggcagcgtgggcgagctgagcaagagaaccctggacctgctgaacagactggagaacatccagagccccagcgagcagaagatcaagagaagcgtgagcgacatcaccctgcagagcagcagccagaagatgagcttcaccggccagatgagcctggacatcgccagcagcatcaacgaggacagcgccgccagcctgaccgagctgagcagcagcgacgagctgagcctgtgcagcgaggacatcgtgctgcacaagaacaagatccccgagagcaacgccagcttcagaaagagactgaccagaagcgtggccgacgagagcgacgtgaacgtgagcatgatcgtgaacgtgagctgcaccagcgcctgcaccgacgacgaggacgacagcgacctgctgagcagcagcaccctgaccctgaccgaggaggagctgtgcatcaaggacgaggacgacgacagcagcatcgccaccgacgacgagatctacgaggactgcaccctgatgagcggcctggactacatcaagaacgagctgcagacctggatcagacccaagctgagcctgaccagagacaagaagagatgcaacgtgagcgacgagatgaagggcagcaaggacatcagcagcagcgagatgaccaaccccagcgacaccctgaacatcgagaccctgctgaacggcagcgtgaagagagtgagcgagaacaacggcaacggcaagaacagcagccacacccacgagctgggcaccaagagagagaacaagaagaccatcttcaaggtgaacaaggacccctacgtggccgacatggagaacggcaacatcgagggcatccccgagagacagaagggcaagcccaacgtgaccagcaaggtgagcgagaacctgggcagccacggcaaggagatcagcgagagcgagcactgcaagtgcaaggccctgatggacagcctggacgacagcaacaccgccggcaaggagttcgtgagccaggacgtgagacacctgcccaagaagtgccccaaccaccaccacttcgagaaccagagcaccgccagcacccccaccgagaagagcttcagcgagctggccctggagaccagattcaacaacagacaggacagcgacgccctgaagagcagcgacgacgcccccagcatggccggcaagagcgccggctgctgcctggccctggagcagaacggcaccgaggagaacgccagcatcagcaacatcagctgctgcaactgcgagcccgacgtgttccaccagaaggacgccgaggactgcagcgtgcacaacttcgtgaaggagatcatcgacatggccagcaccgccctgaagagcaagagccagcccgagaacgaggtggccgcccccaccagcctgacccagatcaaggagaaggtgctggagcacagccacagacccatccagctgagaaagggcgacttctacagctacctgagcctgagcagccacgacagcgactgcggcgaggtgaccaactacatcgaggagaagagcagcacccccctgcccctggacaccaccgacagcggcctggacgacaaggaggacatcgagtgcttcttcgaggcctgcgtggagggcgacagcgacggcgaggagccctgcttcagcagcgccccccccaacgagagcgccgtgcccagcgaggccgccatgcccctgcaggccaccgcctgcagcagcgagttcagcgacagcagcctgagcgccgacgacgccgacaccgtggccctgagcagccccagcagccaggagagagccgaggtgggcaaggaggtgaacggcctgccccagaccagcagcggctgcgccgagaacctggagttcacccccagcaagctggacagcgagaaggagagcagcggcaagcccggcgagagcggcatgcccgaggagcacaacgccgccagcgccaagagcaaggtgcaggacctgagcctgaaggccaaccagcccaccgacaaggccgccctgcaccccagccccaagaccctgacctgcgaggagaacctgctgaacctgcacgagaagagacacagaaacatgcacagatag

SEQ ID NO: 16181 - DNA, 327 bp, Artificial Sequence
  Description of Artificial Sequence: Synthetic coding sequence
atgctgaccatgagcgtgaccctgagccccctgagaagccaggacctggaccccatggccaccgacgccagccccatggccatcaacatgacccccaccgtggagcagggcgagggcgaggaggccatgaaggacatggacagcgaccagcagtacgagaagcccccccccctgcacaccggcgccgactggaagatcgtgctgcacctgcccgagatcgagacctggctgagaatgaccagcgagagagtgagagacctgacctacagcgtgcagcaggacagcgacagcaagcacgtggacgtgcacctggtgcagctgaagtag

SEQ ID NO: 16182 - DNA, 246 bp, Artificial Sequence
  Description of Artificial Sequence: Synthetic coding sequence
atgggccagctgtgctgcttccccttcagcagagacgagggcaagatcagcgagaagaacggcggcgagcccgacgacgccgagctggtgagactgagcaagagactggtggagaacgccgtgctgaaggccgtgcagcagtacctggaggagacccagaacaagaacaagcccggcgagggcagcagcgtgaagaccgaggccgccgaccagaacggcaacgacaacgagaacaacagaaagtag

SEQ ID NO: 16183 - DNA, 981 bp, Artificial Sequence
  Description of Artificial Sequence: Synthetic coding sequence
atgagcgaggagttcgaggccaacaccatggacagcctggtggacatgcccttcgccaccgtggacatccaggacgactgcggcatcaccgacgagccccagatcaacctgaagagaagccaggagaacgagtgggtgaagagcgaccaggtgaagaagagaaagaagaagagaaaggactaccagcccaactacttcctgagcatccccatcaccaacaaggagatcatcaagggcatcaagatcctgcagaacgccatcatccagcaggacgagagactggccaaggccatggtgagcgacggcagcttccacatcaccctgctggtgatgcagctgctgaacgaggacgaggtgaacatcggcatcgacgccctgctggagctgaagcccttcatcgaggagctgctgcagggcaagcacctgaccctgcccttccagggcatcggcaccttcggcaaccaggtgggcttcgtgaagctggccgagggcgaccacgtgaacagcctgctggagatcgccgagaccgccaacagaaccttccaggagaagggcatcctggtgggcgagagcagaagcttcaagccccacctgaccttcatgaagctgagcaagagcccctggctgagaaagaacggcgtgaagaagatcgaccccgacctgtacgagaagttcatcagccacagattcggcgaggagatcctgtacagaatcgacctgtgcagcatgctgaagaagaagcagagcaacggctactaccactgcgagagcagcatcgtgatcggcgagaagaacggcggcgagcccgacgacgccgagctggtgagactgagcaagagactggtggagaacgccgtgctgaaggccgtgcagcagtacctggaggagacccagaacaagaacaagcccggcgagggcagcagcgtgaagaccgaggccgccgaccagaacggcaacgacaacgagaacaacagaaagtag

SEQ ID NO: 16184 - DNA, 1047 bp, Artificial Sequence
  Description of Artificial Sequence: Synthetic coding sequence
atggagagacccgaggccggcggcatcaacagcaacgagtgcgagaacgtgagcagaaagaagaagatgagcgaggagttcgaggccaacaccatggacagcctggtggacatgcccttcgccaccgtggacatccaggacgactgcggcatcaccgacgagccccagatcaacctgaagagaagccaggagaacgagtgggtgaagagcgaccaggtgaagaagagaaagaagaagagaaaggactaccagcccaactacttcctgagcatccccatcaccaacaaggagatcatcaagggcatcaagatcctgcagaacgccatcatccagcaggacgagagactggccaaggccatggtgagcgacggcagcttccacatcaccctgctggtgatgcagctgctgaacgaggacgaggtgaacatcggcatcgacgccctgctggagctgaagcccttcatcgaggagctgctgcagggcaagcacctgaccctgcccttccagggcatcggcaccttcggcaaccaggtgggcttcgtgaagctggccgagggcgaccacgtgaacagcctgctggagatcgccgagaccgccaacagaaccttccaggagaagggcatcctggtgggcgagagcagaagcttcaagccccacctgaccttcatgaagctgagcaagagcccctggctgagaaagaacggcgtgaagaagatcgaccccgacctgtacgagaagttcatcagccacagattcggcgaggagatcctgtacagaatcgacctgtgcagcatgctgaagaagaagcagagcaacggctactaccactgcgagagcagcatcgtgatcggcgagaagaacggcggcgagcccgacgacgccgagctggtgagactgagcaagagactggtggagaacgccgtgctgaaggccgtgcagcagtacctggaggagacccagaacaagaacaagcccggcgagggcagcagcgtgaagaccgaggccgccgaccagaacggcaacgacaacgagaacaacagaaagtag

SEQ ID NO: 16185 - DNA, 315 bp, Artificial Sequence
  Description of Artificial Sequence: Synthetic coding sequence
atgggccagctgtgctgcttccccttcagcagagacgagggcaagatcagcgagctggagagcagcagcagcgccgtgctgcagagatacagcaaggacatccccagctggagcagcggcgagaagaacggcggcgagcccgacgacgccgagctggtgagactgagcaagagactggtggagaacgccgtgctgaaggccgtgcagcagtacctggaggagacccagaacaagaacaagcccggcgagggcagcagcgtgaagaccgaggccgccgaccagaacggcaacgacaacgagaacaacagaaagtag

SEQ ID NO: 16186 - DNA, 684 bp, Artificial Sequence
  Description of Artificial Sequence: Synthetic coding sequence
atggcccccgactacggcgtgatgggcatgcagggcgccggcggctacgacagcaccatgccctacggctgcggcagaagccagcccagaatgagagacagagacagacccaagagaagaggcttcgacagattcggccccgacggcaccggcagaaagagaaagcagttccagctgtacgaggagcccgacaccaagctggccagagtggacagcgagggcgacttcagcgagaacgacgacgccgccggcgacttcagaagcggcgacgaggagttcaagggcgaggacgagctgtgcgacagcggcagacagagaggcgagaaggaggacgaggacgaggacgtgaagaagagaagagagaagcagagaagaagagacagaaccagagacagagccgccgacagaatccagttcgcctgcagcgtgtgcaagttcagaagcttcgacgacgaggagatccagaagcacctgcagagcaagttccacaaggagaccctgagattcatcagcaccaagctgcccgacaagaccgtggagttcctgcaggagtacatcgtgaacagaaacaagaagatcgagaagagaagacaggagctgatggagaaggagaccgccaagcccaagcccgaccccttcaagggcgagctgagcagccaggacgagtgcttccccggctggtag

SEQ ID NO: 16187 - DNA, 2079 bp, Artificial Sequence
  Description of Artificial Sequence: Synthetic coding sequence
atggaccagggctacggcggctacggcgcctggagcgccggccccgccaacacccagggcgcctacggcaccggcgtggccagctggcagggctacgagaactacaactactacggcgcccagaacaccagcgtgaccaccggcgccacctacagctacggccccgccagctgggaggccgccaaggccaacgacggcggcctggccgccggcgcccccgccatgcacatggccagctacggccccgagccctgcaccgacaacagcgacagcctgatcgccaagatcaaccagagactggacatgatgagcaaggagggcggcagaggcggcagcggcggcggcggcgagggcatccaggacagagagagcagcttcagattccagcccttcgagagctacgacagcagaccctgcctgcccgagcacaacccctacagacccagctacagctacgactacgagttcgacctgggcagcgacagaaacggcagcttcggcggccagtacagcgagtgcagagaccccgccagagagagaggcagcctggacggcttcatgagaggcagaggccagggcagattccaggacagaagcaaccccggcaccttcatgagaagcgaccccttcgtgccccccgccgccagcagcgagcccctgagcaccccctggaacgagctgaactacgtgggcggcagaggcctgggcggccccagccccagcagacccccccccagcctgttcagccagagcatggcccccgactacggcgtgatgggcatgcagggcgccggcggctacgacagcaccatgccctacggctgcggcagaagccagcccagaatgagagacagagacagacccaagagaagaggcttcgacagattcggccccgacggcaccggcagaaagagaaagcagttccagctgtacgaggagcccgacaccaagctggccagagtggacagcgagggcgacttcagcgagaacgacgacgccgccggcgacttcagaagcggcgacgaggagttcaagggcgaggacgagctgtgcgacagcggcagacagagaggcgagaaggaggacgaggacgaggacgtgaagaagagaagagagaagcagagaagaagagacagaaccagagacagagccgccgacagaatccagttcgcctgcagcgtgtgcaagttcagaagcttcgacgacgaggagatccagaagcacctgcagagcaagttccacaaggagaccctgagattcatcagcaccaagctgcccgacaagaccgtggagttcctgcaggagtacatcgtgaacagaaacaagaagatcgagaagagaagacaggagctgatggagaaggagaccgccaagcccaagcccgaccccttcaagggcatcggccaggagcacttcttcaagaagatcgaggccgcccactgcctggcctgcgacatgctgatccccgcccagccccagctgctgcagagacacctgcacagcgtggaccacaaccacaacagaagactggccgccgagcagttcaagaagaccagcctgcacgtggccaagagcgtgctgaacaacagacacatcgtgaagatgctggagaagtacctgaagggcgaggaccccttcaccagcgagaccgtggaccccgagatggagggcgacgacaacctgggcggcgaggacaagaaggagacccccgaggaggtggccgccgacgtgctggccgaggtgatcaccgccgccgtgagagccgtggacggcgagggcgcccccgcccccgagagcagcggcgagcccgccgaggacgagggccccaccgacaccgccgaggccggcagcgacccccaggccgagcagctgctggaggagcaggtgccctgcggcaccgcccacgagaagggcgtgcccaaggccagaagcgaggccgccgaggccggcaacggcgccgagaccatggccgccgaggccgagagcgcccagaccagagtggcccccgcccccgccgccgccgacgccgaggtggagcagaccgacgccgagagcaaggacgccgtgcccaccgagtag

SEQ ID NO: 16188 - DNA, 1881 bp, Artificial Sequence
  Description of Artificial Sequence: Synthetic coding sequence
atggtggccccctggagagtgagcgtgagagtgtgcctgagccacctgagatgcttcgagctgagacagggcctgagcctgctgagacccagcgagtgccccagagacgccagactgtgctggctgctgctgggcaccctgcccaaggtggtgagcctgtgcggcgacgtgggcgagggcgcccccgacgtgctgagcagaagaagagtgagatgcagcggcgccgccggcgccggccccgccgagagcctgcccagagccggccccctgggcggcgtgttcctgcacctgagactgtggctgagagccggcgccctgctggtgaagttcttccccctgctgctgctgtaccccctgacctacctggcccccagcgtgagcaccctgtggctgcacctgctgctgaaggccaccgagaccagcggccccacctacatcaagctgggccagtgggccagcaccagaagagacctgttcagcgaggccttctgcgcccagttcagcaagctgcacgtgagagtgaccccccacccctggacccacaccgagagattcctgagacaggccttcggcgacgactggggcagcatcctgagcttcgagaacagagagcccgtgggcagcggctgcgtggcccaggtgtacaaggcctacgccaacaccgccttcctggagaccgacagcgtgcagagactgggcagagccagctgcctgccccccttcagccacaccggcgccgtgggcggcctgagagagctgttcggctacctgggcaacggcagaaagccccccgagaacctggccgaccagagcttcctggagagactgctgctgcccaaggccgacctggtgggcagcaacgccggcgtgagcagagcccaggtgcccggccaccagcccgaggccaccaacctgatcagcgtggccgtgaaggtgctgcaccccggcctgctggcccaggtgcacatggacctgctgctgatgaagatcggcagcagagtgctgggcgtgctgcccggcatcaagtggctgagcctgcccgagatcgtggaggagttcgagaagctgatggtgcagcagatcgacctgagatacgaggcccagaacctggagcacttccaggtgaacttcagaaacgtgaaggccgtgaagttccccacccccctgagacccttcgtgaccagagaggtgctggtggagacctacgaggagagcgtgcccgtgagcagctaccagcaggccggcatccccgtggacctgaagagaaagatcgccagactgggcatcaacatgctgctgaagatgatcttcgtggacaacttcgtgcacgccgacctgcaccccggcaacatcctggtgcagggcgccaacggcctgagcagcagccaggaggcccagctgcagcaggccgacatctgcgacaccctggtggtggccgtgcccagcagcctgtgccccctgagactggtgctgctggacgccggcatcgtggccgagctgcaggcccccgacctgagaaacttcagagccgtgttcatggccgtggtgatgggccagggccagagagtggccgagctgatcctgcaccacgccagagccagcgagtgcagagacgtggagggcttcaagaccgagatggccatgctggtgacccaggccagaaagaacaccatcaccctggagaagctgcacgtgagcagcctgctgagcagcgtgttcaagctgctgatgacccacaaggtgaagctggagagcaacttcgccagcatcgtgttcgccatcatggtgctggagggcctgggcagaagcctggaccccaagctggacatcctggaggccgccagacccttcctgctgaccggccccgtgtgccccccctag

SEQ ID NO: 16189 - DNA, 1512 bp, Artificial Sequence
  Description of Artificial Sequence: Synthetic coding sequence
atgtggctgaaggtgggcggcctgctgagaggcaccggcggccagctgggccagaccgtgggctggccctgcggcgccctgggccccggcccccacagatggggcccctgcggcggcagctgggcccagaagttctaccaggacggccccggcagaggcctgggcgaggaggacatcagaagagccagagaggccagacccagaaagacccccagaccccagctgagcgacagaagcagagagagaaaggtgcccgccagcagaatcagcagactggccaacttcggcggcctggccgtgggcctgggcctgggcgtgctggccgagatggccaagaagagcatgcccggcggcagactgcagagcgacaacagcttcatcagcccccagctgcagcacatcttcgagagagtgagacagagcgccgacttcatgcccagatggcagatgctgagagtgctggaggaggagctgggcagagactggcaggccaaggtggccagcctggaggaggtgcccttcgccgccgccagcatcggccaggtgcaccagggcctgctgagagacggcaccgaggtggccgtgaagatccagtaccccggcatcgcccagagcatccagagcgacgtgcagaacctgctggccgtgctgaagatgagcgccgccctgcccgccggcctgttcgccgagcagagcctgcaggccctgcagcaggagctggcctgggagtgcgactacagaagagaggccgcctgcgcccagaacttcagacagctgctggccaacgaccccttcttcagagtgcccgccgtggtgaaggagctgtgcaccaccagagtgctgggcatggagctggccggcggcgtgcccctggaccagtgccagggcctgagccaggacctgagaaaccagatctgcttccagctgctgaccctgtgcctgagagagctgttcgagttcagattcatgcagaccgaccccaactgggccaacttcctgtacgacgccagcagccaccaggtgaccctgctggacttcggcgccagcagagagttcggcaccgagttcaccgaccactacatcgaggtggtgaaggccgccgccgacggcgacagagactgcgtgctgcagaagagcagagacctgaagttcctgaccggcttcgagaccaaggccttcagcgacgcccacgtggaggccgtgatgatcctgggcgagcccttcgccacccagggcccctacgacttcggcagcggcgagaccgccagaagaatccaggacctgatccccgtgctgctgagacacagactgtgccccccccccgaggagacctacgccctgcacagaaagctggccggcgccttcctggcctgcgcccacctgagagcccacatcgcctgcagagacctgttccaggacacctaccacagatactgggccagcagacagcccgacgccgccaccgccggcagcctgcccaccaagggcgacagctgggtggaccccagctag

SEQ ID NO: 16190 - DNA, 1635 bp, Artificial Sequence
  Description of Artificial Sequence: Synthetic coding sequence
atgtggctgaaggtgggcggcctgctgagaggcaccggcggccagctgggccagaccgtgggctggccctgcggcgccctgggccccggcccccacagatggggcccctgcggcggcagctgggcccagaagttctaccaggacggccccggcagaggcctgggcgaggaggacatcagaagagccagagaggccagacccagaaagacccccagaccccagctgagcgacagaagcagagagagaaaggtgcccgccagcagaatcagcagactggccaacttcggcggcctggccgtgggcctgggcctgggcgtgctggccgagatggccaagaagagcatgcccggcggcagactgcagagcgagggcggcagcggcctggacagcagccccttcctgagcgaggccaacgccgagagaatcgtgcagaccctgtgcaccgtgagaggcgccgccctgaaggtgggccagatgctgagcatccaggacaacagcttcatcagcccccagctgcagcacatcttcgagagagtgagacagagcgccgacttcatgcccagatggcagatgctgagagtgctggaggaggagctgggcagagactggcaggccaaggtggccagcctggaggaggtgcccttcgccgccgccagcatcggccaggtgcaccagggcctgctgagagacggcaccgaggtggccgtgaagatccagtaccccggcatcgcccagagcatccagagcgacgtgcagaacctgctggccgtgctgaagatgagcgccgccctgcccgccggcctgttcgccgagcagagcctgcaggccctgcagcaggagctggcctgggagtgcgactacagaagagaggccgcctgcgcccagaacttcagacagctgctggccaacgaccccttcttcagagtgcccgccgtggtgaaggagctgtgcaccaccagagtgctgggcatggagctggccggcggcgtgcccctggaccagtgccagggcctgagccaggacctgagaaaccagatctgcttccagctgctgaccctgtgcctgagagagctgttcgagttcagattcatgcagaccgaccccaactgggccaacttcctgtacgacgccagcagccaccaggtgaccctgctggacttcggcgccagcagagagttcggcaccgagttcaccgaccactacatcgaggtggtgaaggccgccgccgacggcgacagagactgcgtgctgcagaagagcagagacctgaagttcctgaccggcttcgagaccaaggccttcagcgacgcccacgtggaggccgtgatgatcctgggcgagcccttcgccacccagggcccctacgacttcggcagcggcgagaccgccagaagaatccaggacctgatccccgtgctgctgagacacagactgtgccccccccccgaggagacctacgccctgcacagaaagctggccggcgccttcctggcctgcgcccacctgagagcccacatcgcctgcagagacctgttccaggacacctaccacagatactgggccagcagacagcccgacgccgccaccgccggcagcctgcccaccaagggcgacagctgggtggaccccagctag

SEQ ID NO: 16191 - DNA, 1512 bp, Artificial Sequence; identical to SEQ ID NO: 16189
  Description of Artificial Sequence: Synthetic coding sequence

SEQ ID NO: 16192 - DNA, 1743 bp, Artificial Sequence
  Description of Artificial Sequence: Synthetic coding sequence
atgtggagacccgtgcagctgtgccacttccacagcgccctgctgcacagaagacagaagccctggcccagccccgccgtgttcttcagaagaaacgtgagaggcctgccccccagattcagcagccccacccccctgtggagaaaggtgctgagcaccgccgtggtgggcgcccccctgctgctgggcgccagatacgtgatggccgaggccagagagaagagaagaatgagactggtggtggacggcatgggcagattcggcagaagcctgaaggtgggcctgcagatcagcctggactactggtggtgcaccaacgtggtgctgagaggcgtggaggagaacagccccggctacctggaggtgatgagcgcctgccaccagagagccgccgacgccctggtggccggcgccatcagcaacggcggcctgtacgtgaagctgggccagggcctgtgcagcttcaaccacctgctgccccccgagtacaccagaaccctgagagtgctggaggacagagccctgaagagaggcttccaggaggtggacgagctgttcctggaggacttccaggccctgccccacgagctgttccaggagttcgactaccagcccatcgccgccgccagcctggcccaggtgcacagagccaagctgcacgacggcaccagcgtggccgtgaaggtgcagtacatcgacctgagagacagattcgacggcgacatccacaccctggagctgctgctgagactggtggaggtgatgcaccccagcttcggcttcagctgggtgctgcaggacctgaagggcaccctggcccaggagctggacttcgagaacgagggcagaaacgccgagagatgcgccagagagctggcccacttcccctacgtggtggtgcccagagtgcactgggacaagagcagcaagagagtgctgaccgccgacttctgcgccggctgcaaggtgaacgacgtggaggccatcagaagccagggcctggccgtgcacgacatcgccgagaagctgatcaaggccttcgccgagcagatcttctacaccggcttcatccacagcgacccccaccccggcaacgtgctggtgagaaagggccccgacggcaaggccgagctggtgctgctggaccacggcctgtaccagttcctggaggagaaggacagagccgccctgtgccagctgtggagagccatcatcctgagagacgacgccgccatgagagcccacgccgccgccctgggcgtgcaggactacctgctgttcgccgagatgctgatgcagagacccgtgagactgggccagctgtggggcagccacctgctgagcagagaggaggccgcctacatggtggacatggccagagagagattcgaggccgtgatggccgtgctgagagagctgcccagacccatgctgctggtgctgagaaacatcaacaccgtgagagccatcaacgtggccctgggcgcccccgtggacagatacttcctgatggccaagagagccgtgagaggctggagcagactggccggcgccacctacagaggcgtgtacggcaccagcctgctgagacacgccaaggtggtgtgggagatgctgaagttcgaggtggccctgagactggagaccctggccatgagactgaccgccctgctggccagagccctggtgcacctgagcctggtgccccccgccgaggagctgtaccagtacctggagacctag

SEQ ID NO: 16193 - DNA, 921 bp, Artificial Sequence
  Description of Artificial Sequence: Synthetic coding sequence
atggccgtggccagactggccgccgtggccgcctgggtgccctgcagaagctggggctgggccgccgtgcccttcggcccccacagaggcctgagcgtgctgctggccagaatcccccagagagcccccagatggctgcccgcctgcagacagaagaccagcctgagcttcctgaacagacccgacctgcccaacctggcctacaagaagctgaagggcaagagccccggcatcatcttcatccccggctacctgagctacatgaacggcaccaaggccctggccatcgaggagttctgcaagagcctgggccacgcctgcatcagattcgactacagcggcgtgggcagcagcgacggcaacagcgaggagagcaccctgggcaagtggagaaaggacgtgctgagcatcatcgacgacctggccgacggcccccagatcctggtgggcagcagcctgggcggctggctgatgctgcacgccgccatcgccagacccgagaaggtggtggccctgatcggcgtggccaccgccgccgacaccctggtgaccaagttcaaccagctgcccgtggagctgaagaaggaggtggagatgaagggcgtgtggagcatgcccagcaagtacagcgaggagggcgtgtacaacgtgcagtacagcttcatcaaggaggccgagcaccactgcctgctgcacagccccatccccgtgaactgccccatcagactgctgcacggcatgaaggacgacatcgtgccctggcacaccagcatgcaggtggccgacagagtgctgagcaccgacgtggacgtgatcctgagaaagcacagcgaccacagaatgagagagaaggccgacatccagctgctggtgtacaccatcgacgacctgatcgacaagctgagcaccatcgtgaactag

SEQ ID NO: 16194 - DNA, 450 bp, Artificial Sequence
  Description of Artificial Sequence: Synthetic coding sequence
atgctgcacgccgccatcgccagacccgagaaggtggtggccctgatcggcgtggccaccgccgccgacaccctggtgaccaagttcaaccagctgcccgtggagctgaagaaggaggtggagatgaagggcgtgtggagcatgcccagcaagtacagcgaggagggcgtgtacaacgtgcagtacagcttcatcaaggaggccgagcaccactgcctgctgcacagccccatccccgtgaactgccccatcagactgctgcacggcatgaaggacgacatcgtgccctggcacaccagcatgcaggtggccgacagagtgctgagcaccgacgtggacgtgatcctgagaaagcacagcgaccacagaatgagagagaaggccgacatccagctgctggtgtacaccatcgacgacctgatcgacaagctgagcaccatcgtgaactag

SEQ ID NO: 16195 - DNA, 1407 bp, Artificial Sequence
  Description of Artificial Sequence: Synthetic coding sequence
atggccgccagcagcaacagcagcctgagcggcagcagcgtgagcagcgacgccgaggagtaccagccccccatctggaagagctacctgtaccagctgcagcaggaggcccccagacccaagagaatcatctgccccagagaggtggagaacagacccaagtactacggcagagagttccacggcatcatcagcagagagcaggccgacgagctgctgggcggcgtggagggcgcctacatcctgagagagagccagagacagcccggctgctacaccctggccctgagattcggcaaccagaccctgaactacagactgttccacgacggcaagcacttcgtgggcgagaagagattcgagagcatccacgacctggtgaccgacggcctgatcaccctgtacatcgagaccaaggccgccgagtacatcagcaagatgaccaccaaccccatctacgagcacatcggctacgccaccctgctgagagagaaggtgagcagaagactgagcagaagcaagaacgagcccagaaagaccaacgtgacccacgaggagcacaccgccgtggagaagatcagcagcctggtgagaagagccgccctgacccacaacgacaaccacttcaactacgagaagacccacaacttcaaggtgcacaccttcagaggcccccactggtgcgagtactgcgccaacttcatgtggggcctgatcgcccagggcgtgagatgcagcgactgcggcctgaacgtgcacaagcagtgcagcaagcacgtgcccaacgactgccagcccgacctgaagagaatcaagaaggtgtactgctgcgacctgaccaccctggtgaaggcccacaacacccagagacccatggtggtggacatctgcatcagagagatcgaggccagaggcctgaagagcgagggcctgtacagagtgagcggcttcaccgagcacatcgaggacgtgaagatggccttcgacagagacggcgagaaggccgacatcagcgccaacgtgtaccccgacatcaacatcatcaccggcgccctgaagctgtacttcagagacctgcccatccccgtgatcacctacgacacctacagcaagttcatcgacgccgccaagatcagcaacgccgacgagagactggaggccgtgcacgaggtgctgatgctgctgccccccgcccactacgagaccctgagatacctgatgatccacctgaagaaggtgaccatgaacgagaaggacaacttcatgaacgccgagaacctgggcatcgtgttcggccccaccctgatgagaccccccgaggacagcaccctgaccaccctgcacgacatgagataccagaagctgatcgtgcagatcctgatcgagaacgaggacgtgctgttctag

SEQ ID NO: 16196 - DNA, 438 bp, Artificial Sequence
  Description of Artificial Sequence: Synthetic coding sequence
atgagagccggccagcagctggccagcatgctgagatggaccagagcctggagactgcccagagagggcctgggcccccacggccccagcttcgccagagtgcccgtggcccccagcagcagcagcggcggcagaggcggcgccgagcccagactgctggacggcgaggccgccctgcccgccgtggtgttcctgcacggcctgttcggcagcaagaccaacttcaacagcatcgccaagatcctggcccagcagaccggcagaagagtgctgaccgtggacgccagaaaccacggcgacagcccccacagccccgacatgagctacgagatcatgagccaggacctgcagcccgccccccacctgggcaccgagggcctgagacaggccctgtgcggccacgaggtgctgcagggctggagcgacctgagactgtag

SEQ ID NO: 16197 - DNA, 777 bp, Artificial Sequence
  Description of Artificial Sequence: Synthetic coding sequence
atgagagccggccagcagctggccagcatgctgagatggaccagagcctggagactgcccagagagggcctgggcccccacggccccagcttcgccagagtgcccgtggcccccagcagcagcagcggcggcagaggcggcgccgagcccagacccctgcccctgagctacagactgctggacggcgaggccgccctgcccgccgtggtgttcctgcacggcctgttcggcagcaagaccaacttcaacagcatcgccaagatcctggcccagcagaccggcagaagagtgctgaccgtggacgccagaaaccacggcgacagcccccacagccccgacatgagctacgagatcatgagccaggacctgcaggacctgctgccccagctgggcctggtgccctgcgtggtggtgggccacagcatgggcggcaagaccgccatgctgctggccctgcagagagacatggccgtgagacagcacctgctgaccaacctggtggaggtggacggcagattcgtgtggagagtgaacctggacgccctgacccagcacctggacaagatcctggccttcccccagagacaggagagctacctgggccccaccctgttcctgctgggcggcaacagccagttcgtgcaccccagccaccaccccgagatcatgagactgttccccagagcccagatgcagaccgtgcccaacgccggccactggatccacgccgacagaccccaggacttcatcgccgccatcagaggcttcctggtgtag

SEQ ID NO: 16198 - DNA, 927 bp, Artificial Sequence
  Description of Artificial Sequence: Synthetic coding sequence
atgagagccggccagcagctggccagcatgctgagatggaccagagcctggagactgcccagagagggcctgggcccccacggccccagcttcgccagagtgcccgtggcccccagcagcagcagcggcggcagaggcggcgccgagcccagactgctggacggcgaggccgccctgcccgccgtggtgttcctgcacggcctgttcggcagcaagaccaacttcaacagcatcgccaagatcctggcccagcagaccggcagaagagtgctgaccgtggacgccagaaaccacggcgacagcccccacagccccgacatgagctacgagatcatgagccaggacctgcaggacctgctgccccagctgggcctggtgccctgcgtggtggtgggccacagcatgggcggcaagaccgccatgctgctggccctgcagagacccgagctggtggagagactgatcgccgtggacatcagccccgtggagagcaccggcgtgagccacttcgccacctacgtggccgccatgagagccatcaacatcgccgacgagctgcccagaagcagagccagaaagctggccgacgagcagctgagcagcgtgatccaggacatggccgtgagacagcacctgctgaccaacctggtggaggtggacggcagattcgtgtggagagtgaacctggacgccctgacccagcacctggacaagatcctggccttcccccagagacaggagagctacctgggccccaccctgttcctgctgggcggcaacagccagttcgtgcaccccagccaccaccccgagatcatgagactgttccccagagcccagatgcagaccgtgcccaacgccggccactggatccacgccgacagaccccaggacttcatcgccgccatcagaggcttcctggtgtag

SEQ ID NO: 16199 - DNA, 1014 bp, Artificial Sequence
  Description of Artificial Sequence: Synthetic coding sequence
atggagaagagctggatgctgtggaacttcgtggagagatggctgatcgccctggccagctggagctgggccctgtgcagaatcagcctgctgcccctgatcgtgaccttccacctgtacggcggcatcatcctgctgctgctgatcttcatcagcatcgccggcatcctgtacaagttccaggacgtgctgctgtacttccccgagcagcccagcagcagcagactgtacgtgcccatgcccaccggcatcccccacgagaacatcttcatcagaaccaaggacggcatcagactgaacctgatcctgatcagatacaccggcgacaacagcccctacagccccaccatcatctacttccacggcaacgccggcaacatcggccacagactgcccaacgccctgctgatgctggtgaacctgaaggtgaacctgctgctggtggactacagaggctacggcaagagcgagggcgaggccagcgaggagggcctgtacctggacagcgaggccgtgctggactacgtgatgaccagacccgacctggacaagaccaagatcttcctgttcggcagaagcctgggcggcgccgtggccatccacctggccagcgagaacagccacagaatcagcgccatcatggtggagaacaccttcctgagcatcccccacatggccagcaccctgttcagcttcttccccatgagatacctgcccctgtggtgctacaagaacaagttcctgagctacagaaagatcagccagtgcagaatgcccagcctgttcatcagcggcctgagcgaccagctgatcccccccgtgatgatgaagcagctgtacgagctgagccccagcagaaccaagagactggccatcttccccgacggcacccacaacgacacctggcagtgccagggctacttcaccgccctggagcagttcatcaaggaggtggtgaagagccacagccccgaggagatggccaagaccagcagcaacgtgaccatcatctag

SEQ ID NO: 16200 - DNA, 816 bp, Artificial Sequence
  Description of Artificial Sequence: Synthetic coding sequence
atggtgggcgccctgtgcggctgctggttcagactgggcggcgccagacccctgatccccctgggccccaccgtggtgcagaccagcatgagcagaagccaggtggccctgctgggcctgagcctgctgctgatgctgctgctgtacgtgggcctgcccggcccccccgagcagaccagctgcctgtggggcgaccccaacgtgaccgtgctggccggcctgacccccggcaacagccccatcttctacagagaggtgctgcccctgaaccaggcccacagagtggaggtggtgctgctgcacggcaaggccttcaacagccacacctgggagcagctgggcaccctgcagctgctgagccagagaggctacagagccgtggccctggacctgcccggcttcggcaacagcgcccccagcaaggaggccagcaccgaggccggcagagccgccctgctggagagagccctgagagacctggaggtgcagaacgccgtgctggtgagccccagcctgagcggccactacgccctgcccttcctgatgagaggccaccaccagctgcacggcttcgtgcccatcgcccccaccagcacccagaactacacccaggagcagttctgggccgtgaagacccccaccctgatcctgtacggcgagctggaccacatcctggccagagagagcctgagacagctgagacacctgcccaaccacagcgtggtgaagctgagaaacgccggccacgcctgctacctgcacaagccccaggacttccacctggtgctgctggccttcctggaccacctgccctag

SEQ ID NO: 16201 - DNA, 690 bp, Artificial Sequence
  Description of Artificial Sequence: Synthetic coding sequence
atgctgctgctgtacgtgggcctgcccggcccccccgagcagaccagctgcctgtggggcgaccccaacgtgaccgtgctggccggcctgacccccggcaacagccccatcttctacagagaggtgctgcccctgaaccaggcccacagagtggaggtggtgctgctgcacggcaaggccttcaacagccacacctgggagcagctgggcaccctgcagctgctgagccagagaggctacagagccgtggccctggacctgcccgtgcccggcagcagcaacagccccgccagcgccagccccgtggccgagatcaccgagaacagcttctgggccgtgctggtgagagacctggaggtgcagaacgccgtgctggtgagccccagcctgagcggccactacgccctgcccttcctgatgagaggccaccaccagctgcacggcttcgtgcccatcgcccccaccagcacccagaactacacccaggagcagttctgggccgtgaagacccccaccctgatcctgtacggcgagctggaccacatcctggccagagagagcctgagacagctgagacacctgcccaaccacagcgtggtgaagctgagaaacgccggccacgcctgctacctgcacaagccccaggacttccacctggtgctgctggccttcctggaccacctgccctag

SEQ ID NO: 16202 - DNA, 618 bp, Artificial Sequence
  Description of Artificial Sequence: Synthetic coding sequence
atgctgctgctgtacgtgggcctgcccggcccccccgagcagaccagctgcctgtggggcgaccccaacgtgaccgtgctggccggcctgacccccggcaacagccccatcttctacagagaggtgctgcccctgaaccaggcccacagagtggaggtggtgctgctgcacggcaaggccttcaacagccacacctgggagcagctgggcaccctgcagctgctgagccagagaggctacagagccgtggccctggacctgcccgtgcccggcagcagcaacagccccgccagcgccagccccgtggccgagatcaccggcttcgtgttcctgatgtgcgccagcgccagcggcccccagctgttcccccccctgtggcccatcgcccccaccagcacccagaactacacccaggagcagttctgggccgtgaagacccccaccctgatcctgtacggcgagctggaccacatcctggccagagagagcctgagacagctgagacacctgcccaaccacagcgtggtgaagctgagaaacgccggccacgcctgctacctgcacaagccccaggacttccacctggtgctgctggccttcctggaccacctgccctag

SEQ ID NO: 16203 - DNA, 465 bp, Artificial Sequence
  Description of Artificial Sequence: Synthetic coding sequence
atgctgctgctgtacgtgggcctgcccggcccccccgagcagaccagctgcctgtggggcgaccccaacgtgaccgtgctggccggcctgacccccggcaacagccccatcttctacagagaggtgctgcccctgaaccaggcccacagagtggaggtggtgctgctgcacggcaaggccttcaacagccacacctgggagcagctgggcaccctgcagctgctgagccagagaggctacagagccgtggccctggacctgcccgtgctgggcttcggcaacagcgcccccagcaaggaggccagcaccgaggccggcagagccgccctgctggagagagccctgagagacctggaggtgcagaacgccgtgctggtgagccccagcctgagcggccactacgccctgcccttcctgatgagaggccaccaccagctgcacggcttcgtgcccatcgccccctag

SEQ ID NO: 16204 - DNA, 1014 bp, Artificial Sequence
  Description of Artificial Sequence: Synthetic coding sequence
atggacctggacgtggtgaacatgttcgtgatcgccggcggcaccctggccatccccatcctggccttcgtggccagcttcctgctgtggcccagcgccctgatcagaatctactactggtactggagaagaaccctgggcatgcaggtgagatacgtgcaccacgaggactaccagttctgctacagcttcagaggcagacccggccacaagcccagcatcctgatgctgcacggcttcagcgcccacaaggacatgtggctgagcgtggtgaagttcctgcccaagaacctgcacctggtgtgcgtggacatgcccggccacgagggcaccaccagaagcagcctggacgacctgagcatcgacggccaggtgaagagaatccaccagttcgtggagtgcctgaagctgaacaagaagcccttccacctggtgggcaccagcatgggcggccaggtggccggcgtgtacgccgcctactaccccagcgacgtgagcagcctgtgcctggtgtgccccgccggcctgcagtacagcaccgacaaccagttcgtgcagagactgaaggagctgcagggcagcgccgccgtggagaagatccccctgatccccagcacccccgaggagatgagcgagatgctgcagctgtgcagctacgtgagattcaaggtgccccagcagatcctgcagggcctggtggacgtgagaatcccccacaacaacttctacagaaagctgttcctggagatcgtgagcgagaagagcagatacagcctgcaccagaacatggacaagatcaaggtgcccacccagatcatctggggcaagcaggaccaggtgctggacgtgagcggcgccgacatgctggccaagagcatcgccaactgccaggtggagctgctggagaactgcggccacagcgtggtgatggagagacccagaaagaccgccaagctgatcatcgacttcctggccagcgtgcacaacaccgacaacaacaagaagctggactag

SEQ ID NO: 16205 - DNA, 678 bp, Artificial Sequence
  Description of Artificial Sequence: Synthetic coding sequence
atggacctggacgtggtgaacatgttcgtgatcgccggcggcaccctggccatccccatcctggccttcgtggccagcttcctgctgtggcccagcgccctgatcagaatctactactggtactggagaagaaccctgggcatgcaggtgagatacgtgcaccacgaggactaccagttctgctacagcttcagaggcagacccggccacaagcccagcatcctgatgctgcacggcttcagcgcccacaaggacatgtggctgagcgtggtgaagttcctgcccaagaacctgcacctggtgtgcgtggacatgcccggccacgagggcaccaccagaagcagcctggacgacctgagcatcgacggccaggtgaagagaatccaccagttcgtggagtgcctgaagctgaacaagaagcccttccacctggtgggcaccagcatgggcggccaggtggccggcgtgtacgccgcctactaccccagcgacgtgagcagcctgtgcctggtgtgccccgccggcctgcagtacagcaccgacaaccagttcgtgcagagactgaaggagctgcagggcagcgccgccgtggagaagatccccctgatccccagcacccccgaggagatgagcgagatgctgcagctgtgcagctacgtgagattcaaggtgccctag

SEQ ID NO: 16206 - DNA, 1014 bp, Artificial Sequence; identical to SEQ ID NO: 16204
  Description of Artificial Sequence: Synthetic coding sequence

SEQ ID NO: 16207 - DNA, 522 bp, Artificial Sequence
  Description of Artificial Sequence: Synthetic coding sequence
atggacctggacgtggtgaacatgttcgtgatcgccggcggcaccctggccatccccatcctggccttcgtggccagcttcctgctgtggcccagcgccctgatcagaatctactactggtactggagaagaaccctgggcatgcaggtgagatacgtgcaccacgaggactaccagttctgctacagcttcagaggcagacccggccacaagcccagcatcctgatgctgcacggcttcagcgcccacaaggacatgtggctgagcgtggtgaagttcctgcccaagaacctgcacctggtgtgcgtggacatgcccggccacgagggcaccaccagaagcagcctggacgacctgagcatcgacggccaggtgaagagaatccaccagttcgtggagtgcctgaagctgaacaagaagcccttccacctggtgggcaccagcatgggcggccaggtggccggcgtgtacgccgcctactaccccagcgacgtgagcagcctgtgcctggtgtgcccctag

SEQ ID NO: 16208 - DNA, 957 bp, Artificial Sequence
  Description of Artificial Sequence: Synthetic coding sequence
atggacctggacgtggtgaacatgttcgtgatcgccggcggcaccctggccatccccatcctggccttcgtggccagcttcctgctgtggcccagcgccctgatcagaatctactactggtactggagaagaaccctgggcatgcaggtgagatacgtgcaccacgaggactaccagttctgctacagcttcagaggcagacccggccacaagcccagcatcctgatgctgcacggcttcagcgcccacaaggacatgtggctgagcgtggtgaagttcctgcccaagaacctgcacctggtgtgcgtggacatgcccggccacgagggcaccaccagaagcagcctggacgacctgagcatcgacggccaggtgaagagaatccaccagttcgtggagtgcctgaagctgaacaagaagcccttccacctggtgggcaccagcatgggcggccaggtggccggcgtgtacgccgcctactaccccagcgacgtgagcagcctgtgcctggtgtgccccgccggcctgcagtacagcaccgacaaccagttcgtgcagagactgaaggagctgcagggcagcgccgccgtggagaagatccccctgatccccagcacccccgaggagatgagcgagatgctgcagctgtgcagctacgtgagattcaaggtgccccagcagatcctgcagggcctggtggacgtgagaatcccccacaacaacttctacagaaagctgttcctggagatcgtgagcgagaagagcagatacagcctgcaccagaacatggacaagatcaaggtgcccacccagatcatctggggcaagcaggaccaggtgctggacgtgagcggcgccgacgtgggccaggtgaactgccagctgcccggcggcgccagcggcaagctgtgggccctgagcagcgacggcaagcccggcagacagcccagcagctag

SEQ ID NO: 16209 - DNA, 1194 bp, Artificial Sequence
  Description of Artificial Sequence: Synthetic coding sequence
atggccctgctgagaggcgtgttcgtggtggccgccaagagaacccccttcggcgcctacggcggcctgctgaaggacttcaccgccaccgacctgagcgagttcgccgccaaggccgccctgagcgccggcaaggtgagccccgagaccgtggacagcgtgatcatgggcaacgtgctgcagagcagcagcgacgccatctacctggccagacacgtgggcctgagagtgggcatccccaaggagacccccgccctgaccatcaacagactgtgcggcagcggcttccagagcatcgtgaacggctgccaggagatctgcgtgaaggaggccgaggtggtgctgtgcggcggcaccgagagcatgagccaggccccctactgcgtgagaaacgtgagattcggcaccaagctgggcagcgacatcaagctggaggacagcctgtgggtgagcctgaccgaccagcacgtgcagctgcccatggccatgaccgccgagaacctggccgtgaagcacaagatcagcagagaggagtgcgacaagtacgccctgcagagccagcagagatggaaggccgccaacgacgccggctacttcaacgacgagatggcccccatcgaggtgaagaccaagaagggcaagcagaccatgcaggtggacgagcacgccagaccccagaccaccctggagcagctgcagaagctgccccccgtgttcaagaaggacggcaccgtgaccgccggcaacgccagcggcgtggccgacggcgccggcgccgtgatcatcgccagcgaggacgccgtgaagaagcacaacttcacccccctggccagaatcgtgggctacttcgtgagcggctgcgaccccagcatcatgggcatcggccccgtgcccgccatcagcggcgccctgaagaaggccggcctgagcctgaaggacatggacctggtggaggtgaacgaggccttcgccccccagtacctggccgtggagagaagcctggacctggacatcagcaagaccaacgtgaacggcggcgccatcgccctgggccaccccctgggcggcagcggcagcagaatcaccgcccacctggtgcacgagctgagaagaagaggcggcaagtacgccgtgggcagcgcctgcatcggcggcggccagggcatcgccgtgatcatccagagcaccgcctag

SEQ ID NO: 16210 - DNA, 378 bp, Artificial Sequence
  Description of Artificial Sequence: Synthetic coding sequence
atgcccggcagacacgtgagcagagtgagagccctgtacaagagagtgctgcagctgcacagagtgctgccccccgacctgaagagcctgggcgaccagtacgtgaaggacgagttcagaagacacaagaccgtgggcagcgacgaggcccagagattcctgcaggagtgggaggtgtacgccaccgccctgctgcagcaggccaacgagaacagacagaacagcaccggcaaggcctgcttcggcaccttcctgcccgaggagaagctgaacgacttcagagacgagcagatcggccagctgcaggagctgatgcaggaggccaccaagcccaacagacagttcagcatcagcgagagcatgaagcccaagttctag

SEQ ID NO: 16211 - DNA, 1605 bp, Artificial Sequence
  Description of Artificial Sequence: Synthetic coding sequence
atgttccagttccacgccggcagctgggagagctggtgctgctgctgcctgatccccgccgacagaccctgggacagaggccagcactggcagctggagatggccgacaccagaagcgtgcacgagaccagattcgaggccgccgtgaaggtgatccagagcctgcccaagaacggcagcttccagcccaccaacgagatgatgctgaagttctacagcttctacaagcaggccaccgagggcccctgcaagctgagcagacccggcttctgggaccccatcggcagatacaagtgggacgcctggagcagcctgggcgacatgaccaaggaggaggccatgatcgcctacgtggaggagatgaagaagatcatcgagaccatgcccatgaccgagaaggtggaggagctgctgagagtgatcggccccttctacgagatcgtggaggacaagaagagcggcagaagcagcgacatcaccagcgtgagactggagaagatcagcaagtgcctggaggacctgggcaacgtgctgaccagcacccccaacgccaagaccgtgaacggcaaggccgagagcagcgacagcggcgccgagagcgaggaggaggaggcccaggaggaggtgaagggcgccgagcagagcgacaacgacaagaagatgatgaagaagagcgccgaccacaagaacctggaggtgatcgtgaccaacggctacgacaaggacggcttcgtgcaggacatccagaacgacatccacgccagcagcagcctgaacggcagaagcaccgaggaggtgaagcccatcgacgagaacctgggccagaccggcaagagcgccgtgtgcatccaccaggacatcaacgacgaccacgtggaggacgtgaccggcatccagcacctgaccagcgacagcgacagcgaggtgtactgcgacagcatggagcagttcggccaggaggagagcctggacagcttcaccagcaacaacggccccttccagtactacctgggcggccacagcagccagcccatggagaacagcggcttcagagaggacatccaggtgccccccggcaacggcaacatcggcaacatgcaggtggtggccgtggagggcaagggcgaggtgaagcacggcggcgaggacggcagaaacaacagcggcgccccccacagagagaagagaggcggcgagaccgacgagttcagcaacgtgagaagaggcagaggccacagaatgcagcacctgagcgagggcaccaagggcagacaggtgggcagcggcggcgacggcgagagatggggcagcgacagaggcagcagaggcagcctgaacgagcagatcgccctggtgctgatgagactgcaggaggacatgcagaacgtgctgcagagactgcagaagctggagaccctgaccgccctgcaggccaagagcagcaccagcaccctgcagaccgccccccagcccaccagccagagacccagctggtggcccttcgagatgagccccggcgtgctgaccttcgccatcatctggcccttcatcgcccagtggctggtgtacctgtactaccagagaagaagaagaaagctgaactag

SEQ ID NO: 16212 - DNA, 1596 bp, Artificial Sequence
  Description of Artificial Sequence: Synthetic coding sequence
ttccacgccggcagctgggagagctggtgctgctgctgcctgatccccgccgacagaccctgggacagaggccagcactggcagctggagatggccgacaccagaagcgtgcacgagaccagattcgaggccgccgtgaaggtgatccagagcctgcccaagaacggcagcttccagcccaccaacgagatgatgctgaagttctacagcttctacaagcaggccaccgagggcccctgcaagctgagcagacccggcttctgggaccccatcggcagatacaagtgggacgcctggagcagcctgggcgacatgaccaaggaggaggccatgatcgcctacgtggaggagatgaagaagatcatcgagaccatgcccatgaccgagaaggtggaggagctgctgagagtgatcggccccttctacgagatcgtggaggacaagaagagcggcagaagcagcgacatcaccagcgtgagactggagaagatcagcaagtgcctggaggacctgggcaacgtgctgaccagcacccccaacgccaagaccgtgaacggcaaggccgagagcagcgacagcggcgccgagagcgaggaggaggaggcccaggaggaggtgaagggcgccgagcagagcgacaacgacaagaagatgatgaagaagagcgccgaccacaagaacctggaggtgatcgtgaccaacggctacgacaaggacggcttcgtgcaggacatccagaacgacatccacgccagcagcagcctgaacggcagaagcaccgaggaggtgaagcccatcgacgagaacctgggccagaccggcaagagcgccgtgtgcatccaccaggacatcaacgacgaccacgtggaggacgtgaccggcatccagcacctgaccagcgacagcgacagcgaggtgtactgcgacagcatggagcagttcggccaggaggagagcctggacagcttcaccagcaacaacggccccttccagtactacctgggcggccacagcagccagcccatggagaacagcggcttcagagaggacatccaggtgccccccggcaacggcaacatcggcaacatgcaggtggtggccgtggagggcaagggcgaggtgaagcacggcggcgaggacggcagaaacaacagcggcgccccccacagagagaagagaggcggcgagaccgacgagttcagcaacgtgagaagaggcagaggccacagaatgcagcacctgagcgagggcaccaagggcagacaggtgggcagcggcggcgacggcgagagatggggcagcgacagaggcagcagaggcagcctgaacgagcagatcgccctggtgctgatgagactgcaggaggacatgcagaacgtgctgcagagactgcagaagctggagaccctgaccgccctgcaggccaagagcagcaccagcaccctgcagaccgccccccagcccaccagccagagacccagctggtggcccttcgagatgagccccggcgtgctgaccttcgccatcatctggcccttcatcgcccagtggctggtgtacctgtactaccagagaagaagaagaaagctgaactag

SEQ ID NO: 16213 - DNA, 1047 bp, Artificial Sequence
  Description of Artificial Sequence: Synthetic coding sequence
atgaccaaggaggaggccatgatcgcctacgtggaggagatgaagaagatcatcgagaccatgcccatgaccgagaaggtggaggagctgctgagagtgatcggccccttctacgagatcgtggaggacaagaagagcggcagaagcagcgacatcaccagcgacctgggcaacgtgctgaccagcacccccaacgccaagaccgtgaacggcaaggccgagagcagcgacagcggcgccgagagcgaggaggaggaggcccaggaggaggtgaagggcgccgagcagagcgacaacgacatcaacgacgaccacgtggaggacgtgaccggcatccagcacctgaccagcgacagcgacagcgaggtgtactgcgacagcatggagcagttcggccaggaggagagcctggacagcttcaccagcaacaacggccccttccagtactacctgggcggccacagcagccagcccatggagaacagcggcttcagagaggacatccaggtgccccccggcaacggcaacatcggcaacatgcaggtggtggccgtggagggcaagggcgaggtgaagcacggcggcgaggacggcagaaacaacagcggcgccccccacagagagaagagaggcggcgagaccgacgagttcagcaacgtgagaagaggcagaggccacagaatgcagcacctgagcgagggcaccaagggcagacaggtgggcagcggcggcgacggcgagagatggggcagcgacagaggcagcagaggcagcctgaacgagcagatcgccctggtgctgatgagactgcaggaggacatgcagaacgtgctgcagagactgcagaagctggagaccctgaccgccctgcaggccaagagcagcaccagcaccctgcagaccgccccccagcccaccagccagagacccagctggtggcccttcgagatgagccccggcgtgctgaccttcgccatcatctggcccttcatcgcccagtggctggtgtacctgtactaccagagaagaagaagaaagctgaactag

SEQ ID NO: 16214 - DNA, 1251 bp, Artificial Sequence
  Description of Artificial Sequence: Synthetic coding sequence
atgaccaaggaggaggccatgatcgcctacgtggaggagatgaagaagatcatcgagaccatgcccatgaccgagaaggtggaggagctgctgagagtgatcggccccttctacgagatcgtggaggacaagaagagcggcagaagcagcgacatcaccagcgacctgggcaacgtgctgaccagcacccccaacgccaagaccgtgaacggcaaggccgagagcagcgacagcggcgccgagagcgaggaggaggaggcccaggaggaggtgaagggcgccgagcagagcgacaacgacaagaagatgatgaagaagagcgccgaccacaagaacctggaggtgatcgtgaccaacggctacgacaaggacggcttcgtgcaggacatccagaacgacatccacgccagcagcagcctgaacggcagaagcaccgaggaggtgaagcccatcgacgagaacctgggccagaccggcaagagcgccgtgtgcatccaccaggacatcaacgacgaccacgtggaggacgtgaccggcatccagcacctgaccagcgacagcgacagcgaggtgtactgcgacagcatggagcagttcggccaggaggagagcctggacagcttcaccagcaacaacggccccttccagtactacctgggcggccacagcagccagcccatggagaacagcggcttcagagaggacatccaggtgccccccggcaacggcaacatcggcaacatgcaggtggtggccgtggagggcaagggcgaggtgaagcacggcggcgaggacggcagaaacaacagcggcgccccccacagagagaagagaggcggcgagaccgacgagttcagcaacgtgagaagaggcagaggccacagaatgcagcacctgagcgagggcaccaagggcagacaggtgggcagcggcggcgacggcgagagatggggcagcgacagaggcagcagaggcagcctgaacgagcagatcgccctggtgctgatgagactgcaggaggacatgcagaacgtgctgcagagactgcagaagctggagaccctgaccgccctgcaggccaagagcagcaccagcaccctgcagaccgccccccagcccaccagccagagacccagctggtggcccttcgagatgagccccggcgtgctgaccttcgccatcatctggcccttcatcgcccagtggctggtgtacctgtactaccagagaagaagaagaaagctgaactag

SEQ ID NO: 16215 - DNA, 1473 bp, Artificial Sequence
  Description of Artificial Sequence: Synthetic coding sequence
atggccgacaccagaagcgtgcacgagaccagattcgaggccgccgtgaaggtgatccagagcctgcccaagaacggcagcttccagcccaccaacgagatgatgctgaagttctacagcttctacaagcaggccaccgagggcccctgcaagctgagcagacccggcttctgggaccccatcggcagatacaagtgggacgcctggagcagcctgggcgacatgaccaaggaggaggccatgatcgcctacgtggaggagatgaagaagatcatcgagaccatgcccatgaccgagaaggtggaggagctgctgagagtgatcggccccttctacgagatcgtggaggacaagaagagcggcagaagcagcgacatcaccagcgacctgggcaacgtgctgaccagcacccccaacgccaagaccgtgaacggcaaggccgagagcagcgacagcggcgccgagagcgaggaggaggaggcccaggaggaggtgaagggcgccgagcagagcgacaacgacaagaagatgatgaagaagagcgccgaccacaagaacctggaggtgatcgtgaccaacggctacgacaaggacggcttcgtgcaggacatccagaacgacatccacgccagcagcagcctgaacggcagaagcaccgaggaggtgaagcccatcgacgagaacctgggccagaccggcaagagcgccgtgtgcatccaccaggacatcaacgacgaccacgtggaggacgtgaccggcatccagcacctgaccagcgacagcgacagcgaggtgtactgcgacagcatggagcagttcggccaggaggagagcctggacagcttcaccagcaacaacggccccttccagtactacctgggcggccacagcagccagcccatggagaacagcggcttcagagaggacatccaggtgccccccggcaacggcaacatcggcaacatgcaggtggtggccgtggagggcaagggcgaggtgaagcacggcggcgaggacggcagaaacaacagcggcgccccccacagagagaagagaggcggcgagaccgacgagttcagcaacgtgagaagaggcagaggccacagaatgcagcacctgagcgagggcaccaagggcagacaggtgggcagcggcggcgacggcgagagatggggcagcgacagaggcagcagaggcagcctgaacgagcagatcgccctggtgctgatgagactgcaggaggacatgcagaacgtgctgcagagactgcagaagctggagaccctgaccgccctgcaggccaagagcagcaccagcaccctgcagaccgccccccagcccaccagccagagacccagctggtggcccttcgagatgagccccggcgtgctgaccttcgccatcatctggcccttcatcgcccagtggctggtgtacctgtactaccagagaagaagaagaaagctgaactag

SEQ ID NO: 16216 - DNA, 1578 bp, Artificial Sequence
  Description of Artificial Sequence: Synthetic coding sequence
atgctgttcctgagcttccacgccggcagctgggagagctggtgctgctgctgcctgatccccgccgacagaccctgggacagaggccagcactggcagctggagatggccgacaccagaagcgtgcacgagaccagattcgaggccgccgtgaaggtgatccagagcctgcccaagaacggcagcttccagcccaccaacgagatgatgctgaagttctacagcttctacaagcaggccaccgagggcccctgcaagctgagcagacccggcttctgggaccccatcggcagatacaagtgggacgcctggagcagcctgggcgacatgaccaaggaggaggccatgatcgcctacgtggaggagatgaagaagatcatcgagaccatgcccatgaccgagaaggtggaggagctgctgagagtgatcggccccttctacgagatcgtggaggacaagaagagcggcagaagcagcgacatcaccagcgacctgggcaacgtgctgaccagcacccccaacgccaagaccgtgaacggcaaggccgagagcagcgacagcggcgccgagagcgaggaggaggaggcccaggaggaggtgaagggcgccgagcagagcgacaacgacaagaagatgatgaagaagagcgccgaccacaagaacctggaggtgatcgtgaccaacggctacgacaaggacggcttcgtgcaggacatccagaacgacatccacgccagcagcagcctgaacggcagaagcaccgaggaggtgaagcccatcgacgagaacctgggccagaccggcaagagcgccgtgtgcatccaccaggacatcaacgacgaccacgtggaggacgtgaccggcatccagcacctgaccagcgacagcgacagcgaggtgtactgcgacagcatggagcagttcggccaggaggagagcctggacagcttcaccagcaacaacggccccttccagtactacctgggcggccacagcagccagcccatggagaacagcggcttcagagaggacatccaggtgccccccggcaacggcaacatcggcaacatgcaggtggtggccgtggagggcaagggcgaggtgaagcacggcggcgaggacggcagaaacaacagcggcgccccccacagagagaagagaggcggcgagaccgacgagttcagcaacgtgagaagaggcagaggccacagaatgcagcacctgagcgagggcaccaagggcagacaggtgggcagcggcggcgacggcgagagatggggcagcgacagaggcagcagaggcagcctgaacgagcagatcgccctggtgctgatgagactgcaggaggacatgcagaacgtgctgcagagactgcagaagctggagaccctgaccgccctgcaggccaagagcagcaccagcaccctgcagaccgccccccagcccaccagccagagacccagctggtggcccttcgagatgagccccggcgtgctgaccttcgccatcatctggcccttcatcgcccagtggctggtgtacctgtactaccagagaagaagaagaaagctgaactag

SEQ ID NO: 16217 - DNA, 756 bp, Artificial Sequence
  Description of Artificial Sequence: Synthetic coding sequence
atggccgacaccagaagcgtgcacgagaccagattcgaggccgccgtgaaggtgatccagagcctgcccaagaacggcagcttccagcccaccaacgagatgatgctgaagttctacagcttctacaagcaggccaccgagggcccctgcaagctgagcagacccggcttctgggaccccatcggcagatacaagtgggacgcctggagcagcctgggcgacatgaccaaggaggaggccatgatcgcctacgtggaggagatgaagaagatcatcgagaccatgcccatgaccgagaaggtggaggagctgctgagagtgatcggccccttctacgagatcgtggaggacaagaagagcggcagaagcagcgacatcaccagcgtgagactggagaagatcagcaagtgcctggaggacctgggcaacgtgctgaccagcacccccaacgccaagaccgtgaacggcaaggccgagagcagcgacagcggcgccgagagcgaggaggaggaggcccaggaggaggtgaagggcgccgagcagagcgacaacgacaagaagatgatgaagaagagcgccgaccacaagaacctggaggtgatcgtgaccaacggctacgacaaggacggcttcgtgcaggacatccagaacgacatccacgccagcagcagcctgaacggcagaagcaccgaggaggtgaagcccatcgacgagaacctgggccagaccggcaagagcgccgtgtgcatccactag

SEQ ID NO: 16218 - DNA, 885 bp, Artificial Sequence
  Description of Artificial Sequence: Synthetic coding sequence
atgcccggcccccccctgagcagcgccagacacgccctgcccctgggcagctgggagagctggtgctgctgctgcctgatccccgccgacagaccctgggacagaggccagcactggcagctggagatggccgacaccagaagcgtgcacgagaccagattcgaggccgccgtgaaggtgatccagagcctgcccaagaacggcagcttccagcccaccaacgagatgatgctgaagttctacagcttctacaagcaggccaccgagggcccctgcaagctgagcagacccggcttctgggaccccatcggcagatacaagtgggacgcctggagcagcctgggcgacatgaccaaggaggaggccatgatcgcctacgtggaggagatgaagaagatcatcgagaccatgcccatgaccgagaaggtggaggagctgctgagagtgatcggccccttctacgagatcgtggaggacaagaagagcggcagaagcagcgacatcaccagcgtgagactggagaagatcagcaagtgcctggaggacctgggcaacgtgctgaccagcacccccaacgccaagaccgtgaacggcaaggccgagagcagcgacagcggcgccgagagcgaggaggaggaggcccaggaggaggtgaagggcgccgagcagagcgacaacgacaagaagatgatgaagaagagcgccgaccacaagaacctggaggtgatcgtgaccaacggctacgacaaggacggcttcgtgcaggacatccagaacgacatccacgccagcagcagcctgaacggcagaagcaccgaggaggtgaagcccatcgacgagaacctgggccagaccggcaagagcgccgtgtgcatccaccagtag

SEQ ID NO: 16219 - DNA, 987 bp, Artificial Sequence
  Description of Artificial Sequence: Synthetic coding sequence
atggcccacagcaagcagcccagccacttccagagcctgatgctgctgcagtggcccctgagctacctggccatcttctggatcctgcagcccctgttcgtgtacctgctgttcaccagcctgtggcccctgcccgtgctgtacttcgcctggctgttcctggactggaagacccccgagagaggcggcagaagaagcgcctgggtgagaaactggtgcgtgtggacccacatcagagactacttccccatcaccatcctgaagaccaaggacctgagccccgagcacaactacctgatgggcgtgcacccccacggcctgctgaccttcggcgccttctgcaacttctgcaccgaggccaccggcttcagcaagaccttccccggcatcaccccccacctggccaccctgagctggttcttcaagatccccttcgtgagagagtacctgatggccaagggcgtgtgcagcgtgagccagcccgccatcaactacctgctgagccacggcaccggcaacctggtgggcatcgtggtgggcggcgtgggcgaggccctgcagagcgtgcccaacaccaccaccctgatcctgcagaagagaaagggcttcgtgagaaccgccctgcagcacggcgcccacctggtgcccaccttcaccttcggcgagaccgaggtgtacgaccaggtgctgttccacaaggacagcagaatgtacaagttccagagctgcttcagaagaatcttcggcttctactgctgcgtgttctacggccagagcttctgccagggcagcaccggcctgctgccctacagcagacccatcgtgaccgtggtgggcgagcccctgcccctgccccagatcgagaagcccagccaggagatggtggacaagtaccacgccctgtacatggacgccctgcacaagctgttcgaccagcacaagacccactacggctgcagcgagacccagaagctgttcttcctgtag

SEQ ID NO: 16220 - DNA, 1002 bp, Artificial Sequence
  Description of Artificial Sequence: Synthetic coding sequence
atgctgctgcccagcaagaaggacctgaagaccgccctggacgtgttcgccgtgttccagtggagcttcagcgccctgctgatcaccaccaccgtgatcgccgtgaacctgtacctggtggtgttcaccccctactggcccgtgaccgtgctgatcctgacctggctggccttcgactggaagaccccccagagaggcggcagaagattcacctgcgtgagacactggagactgtggaagcactacagcgactacttccccctgaagctgctgaagacccacgacatctgccccagcagaaactacatcctggtgtgccacccccacggcctgttcgcccacggctggttcggccacttcgccaccgaggccagcggcttcagcaagatcttccccggcatcaccccctacatcctgaccctgggcgccttcttctggatgcccttcctgagagagtacgtgatgagcaccggcgcctgcagcgtgagcagaagcagcatcgacttcctgctgacccacaagggcaccggcaacatggtgatcgtggtgatcggcggcctggccgagtgcagatacagcctgcccggcagcagcaccctggtgctgaagaacagaagcggcttcgtgagaatggccctgcagcacggcgtgcccctgatccccgcctacgccttcggcgagaccgacctgtacgaccagcacatcttcacccccggcggcttcgtgaacagattccagaagtggttccagagcatggtgcacatctacccctgcgccttctacggcagaggcttcaccaagaacagctggggcctgctgccctacagcagacccgtgaccaccatcgtgggcgagcccctgcccatgcccaagatcgagaaccccagccaggagatcgtggccaagtaccacaccctgtacatcgacgccctgagaaagctgttcgaccagcacaagaccaagttcggcatcagcgagacccaggagctggagatcatctag

SEQ ID NO: 16221 - DNA, 2220 bp, Artificial Sequence
  Description of Artificial Sequence: Synthetic coding sequence
atgttcctgctgctggccctgctgaccgagctgggcagactgcaggcccacgagggcagcgagggcatcttcctgcacgtgaccgtgcccagaaagatcaagagcaacgacagcgaggtgagcgagagaaagatgatctacatcatcaccatcgacggccagccctacaccctgcacctgggcaagcagagcttcctgccccagaacttcctggtgtacacctacaacgagaccggcagcctgcacagcgtgagcccctacttcatgatgcactgccactaccagggctacgccgccgagttccccaacagcttcgtgaccctgagcatctgcagcggcctgagaggcttcctgcagttcgagaacatcagctacggcatcgagcccgtggagagcagcgccagattcgagcacatcatctaccagatgaagaacaacgaccccaacgtgagcatcctggccgtgaactacagccacatctggcagaaggaccagccctacaaggtgcccctgaacagccagatcaagaacctgagcaagctgctgccccagtacctggagatctacatcatcgtggagaaggccctgtacgactacatgggcagcgagatgatggccgtgacccagaagatcgtgcaggtgatcggcctggtgaacaccatgttcacccagttcaagctgaccgtgatcctgagcagcctggagctgtggagcaacgagaaccagatcagcaccagcggcgacgccgacgacatcctgcagagattcctggcctggaagagagactacctgatcctgagaccccacgacatcgcctacctgctggtgtacagaaagcaccccaagtacgtgggcgccaccttccccggcaccgtgtgcaacaagagctacgacgccggcatcgccatgtaccccgacgccatcggcctggagggcttcagcgtgatcatcgcccagctgctgggcctgaacgtgggcctgacctacgacgacatcacccagtgcttctgcctgagagccacctgcatcatgaaccacgaggccgtgagcgccagcggcagaaagatcttcagcaactgcagcatgcacgactacagatacttcgtgagcaagttcgagaccaagtgcctgcagaagctgagcaacctgcagcccctgcaccagaaccagcccgtgtgcggcaacggcatcctggagagcaacgaggagtgcgactgcggcaacaagaacgagtgccagttcaagaagtgctgcgactacaacacctgcaagctgaagggcagcgtgaagtgcggcagcggcccctgctgcaccagcaagtgcgagctgagcatcgccggcaccccctgcagaaagagcatcgaccccgagtgcgacttcaccgagtactgcaacggcaccagcagcaactgcgtgcccgacacctacgccctgaacggcagactgtgcaagctgggcaccgcctactgctacaacggccagtgccagaccaccgacaaccagtgcgccaagatcttcggcaagggcgcccagggcgcccccttcgcctgcttcaaggaggtgaacagcctgcacgagagaagcgagaactgcggcttcaagaacagccagcccctgccctgcgagagaaaggacgtgctgtgcggcaagctggcctgcgtgcagccccacaagaacgccaacaagagcgacgcccagagcaccgtgtacagctacatccaggaccacgtgtgcgtgagcatcgccaccggcagcagcatgagaagcgacggcaccgacaacgcctacgtggccgacggcaccatgtgcggccccgagatgtactgcgtgaacaagacctgcagaaaggtgcacctgatgggctacaactgcaacgccaccaccaagtgcaagggcaagggcatctgcaacaacttcggcaactgccagtgcttccccggccacagaccccccgactgcaagttccagttcggcagccccggcggcagcatcgacgacggcaacttccagaagagcggcgacttctacaccgagaagggctacaacacccactggaacaactggttcatcctgagcttctgcatcttcctgcccttcttcatcgtgttcaccaccgtgatcttcaagagaaacgagatcagcaagagctgcaacagagagaacgccgagtacaacagaaacagcagcgtggtgagcgagagcgacgacgtgggccactag

SEQ ID NO: 16222 - DNA, 2148 bp, Artificial Sequence
  Description of Artificial Sequence: Synthetic coding sequence
atgttcctgctgctggccctgctgaccgagctgggcagactgcaggcccacgagggcagcgagggcatcttcctgcacgtgaccgtgcccagaaagatcaagagcaacgacagcgaggtgagcgagagaaagatgatctacatcatcaccatcgacggccagccctacaccctgcacctgggcaagcagagcttcctgccccagaacttcctggtgtacacctacaacgagaccggcagcctgcacagcgtgagcccctacttcatgatgcactgccactaccagggctacgccgccgagttccccaacagcttcgtgaccctgagcatctgcagcggcctgagaggcttcctgcagttcgagaacatcagctacggcatcgagcccgtggagagcagcgccagattcgagcacatcatctaccagatgaagaacaacgaccccaacgtgagcatcctggccgtgaactacagccacatctggcagaaggaccagccctacaaggtgcccctgaacagccagatcaagaacctgagcaagctgctgccccagtacctggagatctacatcatcgtggagaaggccctgatgttcacccagttcaagctgaccgtgatcctgagcagcctggagctgtggagcaacgagaaccagatcagcaccagcggcgacgccgacgacatcctgcagagattcctggcctggaagagagactacctgatcctgagaccccacgacatcgcctacctgctggtgtacagaaagcaccccaagtacgtgggcgccaccttccccggcaccgtgtgcaacaagagctacgacgccggcatcgccatgtaccccgacgccatcggcctggagggcttcagcgtgatcatcgcccagctgctgggcctgaacgtgggcctgacctacgacgacatcacccagtgcttctgcctgagagccacctgcatcatgaaccacgaggccgtgagcgccagcggcagaaagatcttcagcaactgcagcatgcacgactacagatacttcgtgagcaagttcgagaccaagtgcctgcagaagctgagcaacctgcagcccctgcaccagaaccagcccgtgtgcggcaacggcatcctggagagcaacgaggagtgcgactgcggcaacaagaacgagtgccagttcaagaagtgctgcgactacaacacctgcaagctgaagggcagcgtgaagtgcggcagcggcccctgctgcaccagcaagtgcgagctgagcatcgccggcaccccctgcagaaagagcatcgaccccgagtgcgacttcaccgagtactgcaacggcaccagcagcaactgcgtgcccgacacctacgccctgaacggcagactgtgcaagctgggcaccgcctactgctacaacggccagtgccagaccaccgacaaccagtgcgccaagatcttcggcaagggcgcccagggcgcccccttcgcctgcttcaaggaggtgaacagcctgcacgagagaagcgagaactgcggcttcaagaacagccagcccctgccctgcgagagaaaggacgtgctgtgcggcaagctggcctgcgtgcagccccacaagaacgccaacaagagcgacgcccagagcaccgtgtacagctacatccaggaccacgtgtgcgtgagcatcgccaccggcagcagcatgagaagcgacggcaccgacaacgcctacgtggccgacggcaccatgtgcggccccgagatgtactgcgtgaacaagacctgcagaaaggtgcacctgatgggctacaactgcaacgccaccaccaagtgcaagggcaagggcatctgcaacaacttcggcaactgccagtgcttccccggccacagaccccccgactgcaagttccagttcggcagccccggcggcagcatcgacgacggcaacttccagaagagcggcgacttctacaccgagaagggctacaacacccactggaacaactggttcatcctgagcttctgcatcttcctgcccttcttcatcgtgttcaccaccgtgatcttcaagagaaacgagatcagcaagagctgcaacagagagaacgccgagtacaacagaaacagcagcgtggtgagcgagagcgacgacgtgggccactag

SEQ ID NO: 16223 - DNA, 462 bp, Artificial Sequence
  Description of Artificial Sequence: Synthetic coding sequence
atgagaagcgacggcaccgacaacgcctacgtggccgacggcaccatgtgcggccccgagatgtactgcgtgaacaagacctgcagaaaggtgcacctgatgggctacaactgcaacgccaccaccaagtgcaagggcaagggcatctgcaacaacttcggcaactgccagtgcttccccggccacagaccccccgactgcaagttccagttcggcagccccggcggcagcatcgacgacggcaacttccagaagagcggcgacttctacaccgagaagggctacaacacccactggaacaactggttcatcctgagcttctgcatcttcctgcccttcttcatcgtgttcaccaccgtgatcttcaagagaaacgagatcagcaagagctgcaacagagagaacgccgagtacaacagaaacagcagcgtggtgagcgagagcgacgacgtgggccactag

SEQ ID NO: 16224 - DNA, 549 bp, Artificial Sequence
  Description of Artificial Sequence: Synthetic coding sequence
atgttcctgctgctggccctgctgaccgagctgggcagactgcaggcccacgagggcagcgagggcatcttcctgcacgtgaccgtgcccagaaagatcaagagcaacgacagcgaggtgagcgagagaaagatgatctacatcatcaccatcgacggccagccctacaccctgcacctgggcaagcagagcttcctgccccagaacttcctggtgtacacctacaacgagaccggcagcctgcacagcgtgagcccctacttcatgatgcactgccactaccagggctacgccgccgagttccccaacagcttcgtgaccctgagcatctgcagcggcctgagaggcttcctgcagttcgagaacatcagctacggcatcgagcccgtggagagcagcgccagattcgagcacatcatctaccagatgaagaacaacgaccccaacgtgagcatcctggccgtgaactacagccacatctggcagaaggaccagccctacaaggtgcccctgaacagccaggtgaccgtgatcatcctgatgctgtag

SEQ ID NO: 16225 - DNA, 2364 bp, Artificial Sequence
  Description of Artificial Sequence: Synthetic coding sequence
atgttcagactgtggctgctgctggccggcctgtgcggcctgctggccagcagacccggcttccagaacagcctgctgcagatcgtgatccccgagaagatccagaccaacaccaacgacagcagcgagatcgagtacgagcagatcagctacatcatccccatcgacgagaagctgtacaccgtgcacctgaagcagagatacttcctggccgacaacttcatgatctacctgtacaaccagggcagcatgaacacctacagcagcgacatccagacccagtgctactaccagggcaacatcgagggctaccccgacagcatggtgaccctgagcacctgcagcggcctgagaggcatcctgcagttcgagaacgtgagctacggcatcgagcccctggagagcgccgtggagttccagcacgtgctgtacaagctgaagaacgaggacaacgacatcgccatcttcatcgacagaagcctgaaggagcagcccatggacgacaacatcttcatcagcgagaagagcgagcccgccgtgcccgacctgttccccctgtacctggagatgcacatcgtggtggacaagaccctgtacgactactggggcagcgacagcatgatcgtgaccaacaaggtgatcgagatcgtgggcctggccaacagcatgttcacccagttcaaggtgaccatcgtgctgagcagcctggagctgtggagcgacgagaacaagatcagcaccgtgggcgaggccgacgagctgctgcagaagttcctggagtggaagcagagctacctgaacctgagaccccacgacatcgcctacctgctgatctacatggactaccccagatacctgggcgccgtgttccccggcaccatgtgcatcaccagatacagcgccggcgtggccctgtaccccaaggagatcaccctggaggccttcgccgtgatcgtgacccagatgctggccctgagcctgggcatcagctacgacgaccccaagaagtgccagtgcagcgagagcacctgcatcatgaaccccgaggtggtgcagagcaacggcgtgaagaccttcagcagctgcagcctgagaagcttccagaacttcatcagcaacgtgggcgtgaagtgcctgcagaacaagccccagatgcagaagaagagccccaagcccgtgtgcggcaacggcagactggagggcaacgagatctgcgactgcggcaccgaggcccagtgcggccccgccagctgctgcgacttcagaacctgcgtgctgaaggacggcgccaagtgctacaagggcctgtgctgcaaggactgccagatcctgcagagcggcgtggagtgcagacccaaggcccaccccgagtgcgacatcgccgagaactgcaacggcaccagccccgagtgcggccccgacatcaccctgatcaacggcctgagctgcaagaacaacaagttcatctgctacgacggcgactgccacgacctggacgccagatgcgagagcgtgttcggcaagggcagcagaaacgcccccttcgcctgctacgaggagatccagagccagagcgacagattcggcaactgcggcagagacagaaacaacaagtacgtgttctgcggctggagaaacctgatctgcggcagactggtgtgcacctaccccaccagaaagcccttccaccaggagaacggcgacgtgatctacgccttcgtgagagacagcgtgtgcatcaccgtggactacaagctgcccagaaccgtgcccgaccccctggccgtgaagaacggcagccagtgcgacatcggcagagtgtgcgtgaacagagagtgcgtggagagcagaatcatcaaggccagcgcccacgtgtgcagccagcagtgcagcggccacggcgtgtgcgacagcagaaacaagtgccactgcagccccggctacaagccccccaactgccagatcagaagcaagggcttcagcatcttccccgaggaggacatgggcagcatcatggagagagccagcggcaagaccgagaacacctggctgctgggcttcctgatcgccctgcccatcctgatcgtgaccaccgccatcgtgctggccagaaagcagctgaagaagtggttcgccaaggaggaggagttccccagcagcgagagcaagagcgagggcagcacccagacctacgccagccagagcagcagcgagggcagcacccagacctacgccagccagaccagaagcgagagcagcagccaggccgacaccagcaagagcaagagcgaggacagcgccgaggcctacaccagcagaagcaagagccaggacagcacccagacccagagcagcagcaactag

SEQ ID NO: 16226 - DNA, 837 bp, Artificial Sequence
  Description of Artificial Sequence: Synthetic coding sequence
ttcagaaacctgctgaacaacgtgagcctgtgccaccccggctggagcgccgtggcccagagctggctgaccgccaccagcgccagccaggtgcaggtgatcctgctgccccacccccccaactgctggctgggcctgcaggagcagatcagctacatcatccccatcgacgagaagctgtacaccgtgcacctgaagcagagatacttcctggccgacaacttcatgatctacctgtacaaccagggcagcatgaacacctacagcagcgacatccagacccagtgctactaccagggcaacatcgagggctaccccgacagcatggtgaccctgagcacctgcagcggcctgagaggcatcctgcagttcgagaacgtgagctacggcatcgagcccctggagagcgccgtggagttccagcacgtgctgtacaagctgaagaacgaggacaacgacatcgccatcttcatcgacagaagcctgaaggagcagcccatggacgacaacatcttcatcagcgagaagagcgagcccgccgtgcccgacctgttccccctgtacctggagatgcacatcgtggtggacaagaccctgtacgactactggggcagcgacagcatgatcgtgaccaacaaggtgatcgagatcgtgggcctggccaacagcatgttcacccagttcaaggtgaccatcgtgctgagcagcctggagctgtggagcgacgagaacaagatcagcaccgtgggcgaggccgacgagctgctgcagaagttcctggagtggaagcagagctacctgaacctgagaccccacgacatcgcctacctgctgtag

SEQ ID NO: 16227 - DNA, 2358 bp, Artificial Sequence
  Description of Artificial Sequence: Synthetic coding sequence
atggtggtgcccagcctgaagctgcaggacctgatcgaggagatcagaggcgccaagacccaggcccaggagagagaggtgatccagaaggagtgcgcccacatcagagccagcttcagagacggcgaccccgtgcacagacacagacagctggccaagctgctgtacgtgcacatgctgggctaccccgcccacttcggccagatggagtgcctgaagctgatcgccagcagcagattcaccgacaagagagtgggctacctgggcgccatgctgctgctggacgagagacacgacgcccacctgctgatcaccaacagcatcaagaacgacctgagccagggcatccagcccgtgcagggcctggccctgtgcaccctgagcaccatgggcagcgccgagatgtgcagagacctggcccccgaggtggagaagctgctgctgcagcccagcccctacgtgagaaagaaggccatcctgaccgccgtgcacatgatcagaaaggtgcccgagctgagcagcgtgttcctgcccccctgcgcccagctgctgcacgagagacaccacggcatcctgctgggcaccatcaccctgatcaccgagctgtgcgagagaagccccgccgccctgagacacttcagaaaggtggtgccccagctggtgcacatcctgagaaccctggtgaccatgggctacagcaccgagcacagcatcagcggcgtgagcgaccccttcctgcaggtgcagatcctgagactgctgagaatcctgggcagaaaccacgaggagagcagcgagaccatgaacgacctgctggcccaggtggccaccaacaccgacaccagcagaaacgccggcaacgccgtgctgttcgagaccgtgctgaccatcatggacatcagaagcgccgccggcctgagagtgctggccgtgaacatcctgggcagattcctgctgaacagcgacagaaacatcagatacgtggccctgaccagcctgctgagactggtgcagagcgaccacagcgccgtgcagagacacagacccaccgtggtggagtgcctgagagagaccgacgccagcctgagcagaagagccctggagctgagcctggccctggtgaacagcagcaacgtgagagccatgatgcaggagctgcaggccttcctggagagctgcccccccgacctgagagccgactgcgccagcggcatcctgctggccgccgagagattcgcccccaccaagagatggcacatcgacaccatcctgcacgtgctgaccaccgccggcacccacgtgagagacgacgccgtggccaacctgacccagctgatcggcggcgcccaggagctgcacgcctacagcgtgagaagactgtacaacgccctggccgaggacatcagccagcagcccctggtgcaggtggccgcctggtgcatcggcgagtacggcgacctgctgctggccggcaactgcgaggagatcgagcccctgcaggtggacgaggaggaggtgctggccctgctggagaaggtgctgcagagccacatgagcctgcccgccaccagaggctacgccctgaccgccctgatgaagctgagcaccagactgtgcggcgacaacaacagaatcagacaggtggtgagcatctacggcagctgcctggacgtggagctgcagcagagagccgtggagtacgacaccctgttcagaaagtacgaccacatgagagccgccatcctggagaagatgcccctggtggagagagacggcccccaggccgacgaggaggccaaggagagcaaggaggccgcccagctgagcgaggccgcccccgtgcccaccgagccccaggccagccagctgctggacctgctggacctgctggacggcgccagcggcgacgtgcagcaccccccccacctggaccccagccccggcggcgccctggtgcacctgctggacctgccctgcgtgccccccccccccgcccccatccccgacctgaaggtgttcgagagagagggcgtgcagctgaacctgagcttcatcagaccccccgagaaccccgccctgctgctgatcaccatcaccgccaccaacttcagcgagggcgacgtgacccacttcatctgccaggccgccgtgcccaagagcctgcagctgcagctgcaggcccccagcggcaacaccgtgcccgccagaggcggcctgcccatcacccagctgttcagaatcctgaaccccaacaaggcccccctgagactgaagctgagactgacctacgaccacttccaccagagcgtgcaggagatcttcgaggtgaacaacctgcccgtggagagctggcagtag

SEQ ID NO: 16228 - DNA, 2358 bp, Artificial Sequence; identical to SEQ ID NO: 16227
  Description of Artificial Sequence: Synthetic coding sequence

SEQ ID NO: 16229 - DNA, 1923 bp, Artificial Sequence
  Description of Artificial Sequence: Synthetic coding sequence
atggacagaagaatcgagaacagaatgggcacccccgcccacagaagaagagtggtgcacacccacagacacaccagaaacagactgagctgcccctggcccccccccttcaccagccccaccctgacccccggcatcctgctgggcaccatcaccctgatcaccgagctgtgcgagagaagccccgccgccctgagacacttcagaaaggtggtgccccagctggtgcacatcctgagaaccctggtgaccatgggctacagcaccgagcacagcatcagcggcgtgagcgaccccttcctgcaggtgcagatcctgagactgctgagaatcctgggcagaaaccacgaggagagcagcgagaccatgaacgacctgctggcccaggtggccaccaacaccgacaccagcagaaacgccggcaacgccgtgctgttcgagaccgtgctgaccatcatggacatcagaagcgccgccggcctgagagtgctggccgtgaacatcctgggcagattcctgctgaacagcgacagaaacatcagatacgtggccctgaccagcctgctgagactggtgcagagcgaccacagcgccgtgcagagacacagacccaccgtggtggagtgcctgagagagaccgacgccagcctgagcagaagagccctggagctgagcctggccctggtgaacagcagcaacgtgagagccatgatgcaggagctgcaggccttcctggagagctgcccccccgacctgagagccgactgcgccagcggcatcctgctggccgccgagagattcgcccccaccaagagatggcacatcgacaccatcctgcacgtgctgaccaccgccggcacccacgtgagagacgacgccgtggccaacctgacccagctgatcggcggcgcccaggagctgcacgcctacagcgtgagaagactgtacaacgccctggccgaggacatcagccagcagcccctggtgcaggtggccgcctggtgcatcggcgagtacggcgacctgctgctggccggcaactgcgaggagatcgagcccctgcaggtggacgaggaggaggtgctggccctgctggagaaggtgctgcagagccacatgagcctgcccgccaccagaggctacgccctgaccgccctgatgaagctgagcaccagactgtgcggcgacaacaacagaatcagacaggtggtgagcatctacggcagctgcctggacgtggagctgcagcagagagccgtggagtacgacaccctgttcagaaagtacgaccacatgagagccgccatcctggagaagatgcccctggtggagagagacggcccccaggccgacgaggaggccaaggagagcaaggaggccgcccagctgagcgaggccgcccccgtgcccaccgagccccaggccagccagctgctggacctgctggacctgctggacggcgccagcggcgacgtgcagcaccccccccacctggaccccagccccggcggcgccctggtgcacctgctggacctgccctgcgtgccccccccccccgcccccatccccgacctgaaggtgttcgagagagagggcgtgcagctgaacctgagcttcatcagaccccccgagaaccccgccctgctgctgatcaccatcaccgccaccaacttcagcgagggcgacgtgacccacttcatctgccaggccgccgtgcccaagagcctgcagctgcagctgcaggcccccagcggcaacaccgtgcccgccagaggcggcctgcccatcacccagctgttcagaatcctgaaccccaacaaggcccccctgagactgaagctgagactgacctacgaccacttccaccagagcgtgcaggagatcttcgaggtgaacaacctgcccgtggagagctggcagtag

SEQ ID NO: 16230 - DNA, 1665 bp, Artificial Sequence
  Description of Artificial Sequence: Synthetic coding sequence
atgagcgtgaccatggtggtgccccagctggtgcacatcctgagaaccctggtgaccatgggctacagcaccgagcacagcatcagcggcgtgagcgaccccttcctgcaggtgcagatcctgagactgctgagaatcctgggcagaaaccacgaggagagcagcgagaccatgaacgacctgaccgtgctgaccatcatggacatcagaagcgccgccggcctgagagtgctggccgtgaacatcctgggcagattcctgctgaacagcgacagaaacatcagatacgtggccctgaccagcctgctgagactggtgcagagcgaccacagcgccgtgcagagacacagacccaccgtggtggagtgcctgagagagaccgacgccagcctgagcagaagagccctggagctgagcctggccctggtgaacagcagcaacgtgagagccatgatgcaggagctgcaggccttcctggagagctgcccccccgacctgagagccgactgcgccagcggcatcctgctggccgccgagagattcgcccccaccaagagatggcacatcgacaccatcctgcacgtgctgaccaccgccggcacccacgtgagagacgacgccgtggccaacctgacccagctgatcggcggcgcccaggagctgcacgcctacagcgtgagaagactgtacaacgccctggccgaggacatcagccagcagcccctggtgcaggtggccgcctggtgcatcggcgagtacggcgacctgctgctggccggcaactgcgaggagatcgagcccctgcaggtggacgaggaggaggtgctggccctgctggagaaggtgctgcagagccacatgagcctgcccgccaccagaggctacgccctgaccgccctgatgaagctgagcaccagactgtgcggcgacaacaacagaatcagacaggtggtgagcatctacggcagctgcctggacgtggagctgcagcagagagccgtggagtacgacaccctgttcagaaagtacgaccacatgagagccgccatcctggagaagatgcccctggtggagagagacggcccccaggccgacgaggaggccaaggagagcaaggaggccgcccagctgagcgaggccgcccccgtgcccaccgagccccaggccagccagctgctggacctgctggacctgctggacggcgccagcggcgacgtgcagcaccccccccacctggaccccagccccggcggcgccctggtgcacctgctggacctgccctgcgtgccccccccccccgcccccatccccgacctgaaggtgttcgagagagagggcgtgcagctgaacctgagcttcatcagaccccccgagaaccccgccctgctgctgatcaccatcaccgccaccaacttcagcgagggcgacgtgacccacttcatctgccaggccgccgtgcccaagagcctgcagctgcagctgcaggcccccagcggcaacaccgtgcccgccagaggcggcctgcccatcacccagctgttcagaatcctgaaccccaacaaggcccccctgagactgaagctgagactgacctacgaccacttccaccagagcgtgcaggagatcttcgaggtgaacaacctgcccgtggagagctggcagtag

SEQ ID NO: 16231 - DNA, 414 bp, Artificial Sequence
  Description of Artificial Sequence: Synthetic coding sequence
atggtggtgcccagcctgaagctgcaggacctgatcgaggagatcagaggcgccaagacccaggcccaggagagagaggtgatccagaaggagtgcgcccacatcagagccagcttcagagacggcgaccccgtgcacagacacagacagctggccaagctgctgtacgtgcacatgctgggctaccccgcccacttcggccagatggagtgcctgaagctgatcgccagcagcagattcaccgacaagagagtgggctacctgggcgccatgctgctgctggacgagagacacgacgcccacctgctgatcaccaacagcatcaagaacgacctgagccagggcatccagcccgtgcagggcctggccctgtgcaccctgagcaccatgggcagcgccgagatgtgcagatag

SEQ ID NO: 16232 - DNA, 603 bp, Artificial Sequence
  Description of Artificial Sequence: Synthetic coding sequence
atggtggtgcccagcctgaagctgcaggacctgatcgaggagatcagaggcgccaagacccaggcccaggagagagaggtgatccagaaggagtgcgcccacatcagagccagcttcagagacggcgaccccgtgcacagacacagacagctggccaagctgctgtacgtgcacatgctgggctaccccgcccacttcggccagatggagtgcctgaagctgatcgccagcagcagattcaccgacaagagagtgggctacctgggcgccatgctgctgctggacgagagacacgacgcccacctgctgatcaccaacagcatcaagaacgacctgagccagggcatccagcccgtgcagggcctggccctgtgcaccctgagcaccatgggcagcgccgagatgtgcagagacctggcccccgaggtggagaagctgctgctgcagcccagcccctacgtgagaaagaaggccatcctgaccgccgtgcacatgatcagaaaggtgcccgagctgagcagcgtgttcctgcccccctgcgcccagctgctgcacgagagacaccacggcatcctgctgggcaccatcaccctgatcacctag

SEQ ID NO: 16233 - DNA, 465 bp, Artificial Sequence
  Description of Artificial Sequence: Synthetic coding sequence
atgatccacttcatcctgctgttcagcagacagggcaagctgagactgcagaagtggtacatcaccctgcccgacaaggagagaaagaagatcaccagagagatcgtgcagatcatcctgagcagaggccacagaaccagcagcttcgtggactggaaggagctgaagctggtgtacaagagatacgccagcctgtacttctgctgcgccatcgagaaccaggacaacgagctgctgaccctggagatcgtgcacagatacgtggagctgctggacaagtacttcggcaacgtgtgcgagctggacatcatcttcaacttcgagaaggcctacttcatcctggacgagttcatcatcggcggcgagatccaggagaccagcaagaagatcgccgtgaaggccatcgaggacagcgacatgctgcaggagaccatggaggagtacatgaacaagcccaccttctag

SEQ ID NO: 16234 - DNA, 315 bp, Artificial Sequence
  Description of Artificial Sequence: Synthetic coding sequence
atgatccacttcatcctgctgttcagcagacagggcaagctgagactgcagaagtggtacatcaccctgcccgacaaggagagaaagaagatcaccagagagatcgtgcagatcatcctgagcagaggccacagaaccagcagcttcgtggactggaaggagctgaagctggtgtacaagagatacgccagcctgtacttctgctgcgccatcgagaaccaggacaacgagctgctgaccctggagatcgtgcacagatacgtggagctgctggacaagtacttcggcaacacctggcccttcgccagagcctag

SEQ ID NO: 16235 - DNA, 495 bp, Artificial Sequence
  Description of Artificial Sequence: Synthetic coding sequence
atgatccacttcatcctgctgttcagcagacagggcaagctgagactgcagaagtggtacatcaccctgcccgacaaggagagaaagaagatcaccagagagatcgtgcagatcatcctgagcagaggccacagaaccagcagcttcgtggactggaaggagctgaagctggtgtacaagagatacgccagcctgtacttctgctgcgccatcgagaaccaggacaacgagctgctgaccctggagatcgtgcacagatacgtggagctgctggacaagtacttcggcaacgtgtgcgagctggacatcatcttcaacttcgagaaggcctacttcatcctggacgagttcatcatcggcggcgagatccaggagaccagcaagaagatcgccgtgaaggccatcgaggacagcgacatgctgcaggagaacagactgagccccagaggcagagactgcagcgagcccagaagctgccactgcaccctggcctag

SEQ ID NO: 16236 - DNA, 465 bp, Artificial Sequence
  Description of Artificial Sequence: Synthetic coding sequence
atgatccacttcatcctgctgttcagcagacagggcaagctgagactgcagaagtggtacatcaccctgcccgacaaggagagaaagaagatcaccagagagatcgtgcagatcatcctgagcagaggccacagaaccagcagcttcgtggactggaaggagctgaagctggtgtacaagagatacgccagcctgtacttctgctgcgccatcgagaaccaggacaacgagctgctgaccctggagatcgtgcacagatacgtggagctgctggacaagtacttcggcaacgtgtgcgagctggacatcatcttcaacttcgagaaggcctacttcatcctggacgagttcatcatcggcggcgagatccaggagaccagcaagaagatcgccgtgaaggccatcgaggacagcgacatgctgcaggaggtgagcaccgtgagccagaccatgggcgagagatag

SEQ ID NO: 16237 - DNA, 3249 bp, Artificial Sequence
  Description of Artificial Sequence: Synthetic coding sequence
atgagcgccgcccccgcctacagcgaggacaagggcggcagcgccggccccggcgagcccgagtacggccacgaccccgccagcggcggcatcttcagcagcgactacaagagacacgacgacctgaaggagatgctggacaccaacaaggacagcctgaagctggaggccatgaagagaatcgtggccatgatcgccagaggcaagaacgccagcgacctgttccccgccgtggtgaagaacgtggcctgcaagaacatcgaggtgaagaagctggtgtacgtgtacctggtgagatacgccgaggagcagcaggacctggccctgctgagcatcagcaccttccagagaggcctgaaggaccccaaccagctgatcagagccagcgccctgagagtgctgagcagcatcagagtgcccatcatcgtgcccatcatgatgctggccatcaaggaggccgccagcgacatgagcccctacgtgagaaagaccgccgcccacgccatccccaagctgtacagcctggacagcgaccagaaggaccagctgatcgaggtgatcgagaagctgctggccgacaagaccaccctggtggccggcagcgtggtgatggccttcgaggaggtgtgccccgagagaatcgacctgatccacaagaactacagaaagctgtgcaacctgctgatcgacgtggaggagtggggccaggtggtgatcatcagcatgctgaccagatacgccagaacccagttcctgagccccacccagaacgagagcctgctggaggagaacgccgagaaggccttctacggcagcgaggaggacgaggccaagggcgccggcagcgaggagaccgccgccgccgccgcccccagcagaaagccctacgtgatggaccccgaccacagactgctgctgagaaacaccaagcccctgctgcagagcagaagcgccgccgtggtgatggccgtggcccagctgtacttccacctggcccccaaggccgaggtgggcgtgatcgccaaggccctggtgagactgctgagaagccacagcgaggtgcagtacgtggtgctgcagaacgtggccaccatgagcatcaagagaagaggcatgttcgagccctacctgaagagcttctacatcagaagcaccgaccccacccagatcaagatcctgaagctggaggtgctgaccaacctggccaacgagaccaacatccccaccgtgctgagagagttccagacctacatcagaagcatggacaaggacttcgtggccgccaccatccaggccatcggcagatgcgccaccaacatcggcagagtgagagacacctgcctgaacggcctggtgcagctgctgagcaacagagacgagctggtggtggccgagagcgtggtggtgatcaagaagctgctgcagatgcagcccgcccagcacggcgagatcatcaagcacctggccaagctgaccgacaacatccaggtgcccatggccagagccagcatcctgtggctgatcggcgagtactgcgagcacgtgcccagaatcgcccccgacgtgctgagaaagatggccaagagcttcaccgccgaggaggacatcgtgaagctgcaggtgatcaacctggccgccaagctgtacctgaccaacagcaagcagaccaagctgctgacccagtacgtgctgagcctggccaagtacgaccagaactacgacatcagagacagagccagattcaccagacagctgatcgtgcccagcgagcagggcggcgccctgagcagacacgccaagaagctgttcctggcccccaagcccgcccccgtgctggagagcagcttcaaggacagagaccacttccagctgggcagcctgagccacctgctgaacgccaaggccaccggctaccaggagctgcccgactggcccgaggaggcccccgaccccagcgtgagaaacgtggaggtgcccgagtggaccaagtgcagcaacagagagaagagaaaggagaaggagaagcccttctacagcgacagcgagggcgagagcggccccaccgagagcgccgacagcgaccccgagagcgagagcgagagcgacagcaagagcagcagcgagagcggcagcggcgagagcagcagcgagagcgacaacgaggaccaggacgaggacgaggagaagggcagaggcagcgagagcgagcagagcgaggaggacggcaagagaaagaccaagaagaaggtgcccgagagaaagggcgaggccagcagcagcgacgagggcagcgacagcagcagcagcagcagcgagagcgagatgaccagcgagagcgaggaggagcagctggagcccgccagctggagcagaaagaccccccccagcagcaagagcgcccccgccaccaaggagatcagcctgctggacctggaggacttcaccccccccagcgtgcagcccgtgagcccccccgccatcgtgagcaccagcctggccgccgacctggagggcctgaccctgaccgacagcaccctggtgcccagcctgctgagccccgtgagcggcgtgggcagacaggagctgctgcacagagtggccggcgagggcctggccgtggactacaccttcagcagacagcccttcagcggcgacccccacatggtgagcgtgcacatccacttcagcaacagcagcgacacccccatcaagggcctgcacgtgggcacccccaagctgcccgccggcatcagcatccaggagttccccgagatcgagagcctggcccccggcgagagcgccaccgccgtgatgggcatcaacttctgcgacagcacccaggccgccaacttccagctgtgcacccagaccagacagttctacgtgagcatccagccccccgtgggcgagctgatggcccccgtgttcatgagcgagaacgagttcaagaaggagcagggcaagctgatgggcatgaacgagatcaccgagaagctgatgctgcccgacacctgcagaagcgaccacatcgtggtgcagaaggtgaccgccaccgccaacctgggcagagtgccctgcggcaccagcgacgagtacagattcgccggcagaaccctgaccggcggcagcctggtgctgctgaccctggacgccagacccgccggcgccgcccagctgaccgtgaacagcgagaagatggtgatcggcaccatgctggtgaaggacgtgatccaggccctgacccagtag

SEQ ID NO: 16238 - DNA, 3153 bp, Artificial Sequence
  Description of Artificial Sequence: Synthetic coding sequence
atgagcgccgcccccgcctacagcgaggacaagggcggcagcgccggccccggcgagcccgagtacggccacgaccccgccagcggcggcatcttcagcagcgactacaagagacacgacgacctgaaggagatgctggacaccaacaaggacagcctgaagctggaggccatgaagagaatcgtggccatgatcgccagaggcaagaacgccagcgacctgttccccgccgtggtgaagaacgtggcctgcaagaacatcgaggaccccaaccagctgatcagagccagcgccctgagagtgctgagcagcatcagagtgcccatcatcgtgcccatcatgatgctggccatcaaggaggccgccagcgacatgagcccctacgtgagaaagaccgccgcccacgccatccccaagctgtacagcctggacagcgaccagaaggaccagctgatcgaggtgatcgagaagctgctggccgacaagaccaccctggtggccggcagcgtggtgatggccttcgaggaggtgtgccccgagagaatcgacctgatccacaagaactacagaaagctgtgcaacctgctgatcgacgtggaggagtggggccaggtggtgatcatcagcatgctgaccagatacgccagaacccagttcctgagccccacccagaacgagagcctgctggaggagaacgccgagaaggccttctacggcagcgaggaggacgaggccaagggcgccggcagcgaggagaccgccgccgccgccgcccccagcagaaagccctacgtgatggaccccgaccacagactgctgctgagaaacaccaagcccctgctgcagagcagaagcgccgccgtggtgatggccgtggcccagctgtacttccacctggcccccaaggccgaggtgggcgtgatcgccaaggccctggtgagactgctgagaagccacagcgaggtgcagtacgtggtgctgcagaacgtggccaccatgagcatcaagagaagaggcatgttcgagccctacctgaagagcttctacatcagaagcaccgaccccacccagatcaagatcctgaagctggaggtgctgaccaacctggccaacgagaccaacatccccaccgtgctgagagagttccagacctacatcagaagcatggacaaggacttcgtggccgccaccatccaggccatcggcagatgcgccaccaacatcggcagagtgagagacacctgcctgaacggcctggtgcagctgctgagcaacagagacgagctggtggtggccgagagcgtggtggtgatcaagaagctgctgcagatgcagcccgcccagcacggcgagatcatcaagcacctggccaagctgaccgacaacatccaggtgcccatggccagagccagcatcctgtggctgatcggcgagtactgcgagcacgtgcccagaatcgcccccgacgtgctgagaaagatggccaagagcttcaccgccgaggaggacatcgtgaagctgcaggtgatcaacctggccgccaagctgtacctgaccaacagcaagcagaccaagctgctgacccagtacgtgctgagcctggccaagtacgaccagaactacgacatcagagacagagccagattcaccagacagctgatcgtgcccagcgagcagggcggcgccctgagcagacacgccaagaagctgttcctggcccccaagcccgcccccgtgctggagagcagcttcaaggacagagaccacttccagctgggcagcctgagccacctgctgaacgccaaggccaccggctaccaggagctgcccgactggcccgaggaggcccccgaccccagcgtgagaaacgtggaggtgcccgagtggaccaagtgcagcaacagagagaagagaaaggagaaggagaagcccttctacagcgacagcgagggcgagagcggccccaccgagagcgccgacagcgaccccgagagcgagagcgagagcgacagcaagagcagcagcgagagcggcagcggcgagagcagcagcgagagcgacaacgaggaccaggacgaggacgaggagaagggcagaggcagcgagagcgagcagagcgaggaggacggcaagagaaagaccaagaagaaggtgcccgagagaaagggcgaggccagcagcagcgacgagggcagcgacagcagcagcagcagcagcgagagcgagatgaccagcgagagcgaggaggagcagctggagcccgccagctggagcagaaagaccccccccagcagcaagagcgcccccgccaccaaggagatcagcctgctggacctggaggacttcaccccccccagcgtgcagcccgtgagcccccccgccatcgtgagcaccagcctggccgccgacctggagggcctgaccctgaccgacagcaccctggtgcccagcctgctgagccccgtgagcggcgtgggcagacaggagctgctgcacagagtggccggcgagggcctggccgtggactacaccttcagcagacagcccttcagcggcgacccccacatggtgagcgtgcacatccacttcagcaacagcagcgacacccccatcaagggcctgcacgtgggcacccccaagctgcccgccggcatcagcatccaggagttccccgagatcgagagcctggcccccggcgagagcgccaccgccgtgatgggcatcaacttctgcgacagcacccaggccgccaacttccagctgtgcacccagaccagacagttctacgtgagcatccagccccccgtgggcgagctgatggcccccgtgttcatgagcgagaacgagttcaagaaggagcagggcaagctgatgggcatgaacgagatcaccgagaagctgatgctgcccgacacctgcagaagcgaccacatcgtggtgcagaaggtgaccgccaccgccaacctgggcagagtgccctgcggcaccagcgacgagtacagattcgccggcagaaccctgaccggcggcagcctggtgctgctgaccctggacgccagacccgccggcgccgcccagctgaccgtgaacagcgagaagatggtgatcggcaccatgctggtgaaggacgtgatccaggccctgacccagtag

SEQ ID NO: 16239 - DNA, 3306 bp, Artificial Sequence
  Description of Artificial Sequence: Synthetic coding sequence
atgagcgccgcccccgcctacagcgaggacaagggcggcagcgccggccccggcgagcccgagtacggccacgaccccgccagcggcggcatcttcagcagcgactacaagagacacgacgacctgaaggagatgctggacaccaacaaggacagcctgaagctggaggccatgaagagaatcgtggccatgatcgccagaggcaagaacgccagcgacctgttccccgccgtggtgaagaacgtggcctgcaagaacatcgaggtgaagaagctggtgtacgtgtacctggtgagatacgccgaggagcagcaggacctggccctgctgagcatcagcaccttccagagaggcctgaaggaccccaaccagctgatcagagccagcgccctgagagtgctgagcagcatcagagtgcccatcatcgtgcccatcatgatgctggccatcaaggaggccgccagcgacatgagcccctacgtgagaaagaccgccgcccacgccatccccaagctgtacagcctggacagcgaccagaaggaccagctgatcgaggtgatcgagaagctgctggccgacaagaccaccctggtggccggcagcgtggtgatggccttcgaggaggtgtgccccgagagaatcgacctgatccacaagaactacagaaagctgtgcaacctgctgatcgacgtggaggagtggggccaggtggtgatcatcagcatgctgaccagatacgccagaacccagttcctgagccccacccagaacgagagcctgctggaggagaacgccgagaaggccttctacggcagcgaggaggacgaggccaagggcgccggcagcgaggagaccgccgccgccgccgcccccagcagaaagccctacgtgatggaccccgaccacagactgctgctgagaaacaccaagcccctgctgcagagcagaagcgccgccgtggtgatggccgtggcccagctgtacttccacctggcccccaaggccgaggtgggcgtgatcgccaaggccctggtgagactgctgagaagccacagcgaggtgcagtacgtggtgctgcagaacgtggccaccatgagcatcaagagaagaggcatgttcgagccctacctgaagagcttctacatcagaagcaccgaccccacccagatcaagatcctgaagctggaggtgctgaccaacctggccaacgagaccaacatccccaccgtgctgagagagttccagacctacatcagaagcatggacaaggacttcgtggccgccaccatccaggccatcggcagatgcgccaccaacatcggcagagtgagagacacctgcctgaacggcctggtgcagctgctgagcaacagagacgagctggtggtggccgagagcgtggtggtgatcaagaagctgctgcagatgcagcccgcccagcacggcgagatcatcaagcacctggccaagctgaccgacaacatccaggtgcccatggccagagccagcatcctgtggctgatcggcgagtactgcgagcacgtgcccagaatcgcccccgacgtgctgagaaagatggccaagagcttcaccgccgaggaggacatcgtgaagctgcaggtgatcaacctggccgccaagctgtacctgaccaacagcaagcagaccaagctgctgacccagtacgtgctgagcctggccaagtacgaccagaactacgacatcagagacagagccagattcaccagacagctgatcgtgcccagcgagcagggcggcgccctgagcagacacgccaagaagctgttcctggcccccaagcccgcccccgtgctggagagcagcttcaaggacagagaccacttccagctgggcagcctgagccacctgctgaacgccaaggccaccggctaccaggagctgcccgactggcccgaggaggcccccgaccccagcgtgagaaacgtggaggaggaggacctgagcctgatcgagacccacgtgggcctgctgggcgagtacaccgaggtgcccgagtggaccaagtgcagcaacagagagaagagaaaggagaaggagaagcccttctacagcgacagcgagggcgagagcggccccaccgagagcgccgacagcgaccccgagagcgagagcgagagcgacagcaagagcagcagcgagagcggcagcggcgagagcagcagcgagagcgacaacgaggaccaggacgaggacgaggagaagggcagaggcagcgagagcgagcagagcgaggaggacggcaagagaaagaccaagaagaaggtgcccgagagaaagggcgaggccagcagcagcgacgagggcagcgacagcagcagcagcagcagcgagagcgagatgaccagcgagagcgaggaggagcagctggagcccgccagctggagcagaaagaccccccccagcagcaagagcgcccccgccaccaaggagatcagcctgctggacctggaggacttcaccccccccagcgtgcagcccgtgagcccccccgccatcgtgagcaccagcctggccgccgacctggagggcctgaccctgaccgacagcaccctggtgcccagcctgctgagccccgtgagcggcgtgggcagacaggagctgctgcacagagtggccggcgagggcctggccgtggactacaccttcagcagacagcccttcagcggcgacccccacatggtgagcgtgcacatccacttcagcaacagcagcgacacccccatcaagggcctgcacgtgggcacccccaagctgcccgccggcatcagcatccaggagttccccgagatcgagagcctggcccccggcgagagcgccaccgccgtgatgggcatcaacttctgcgacagcacccaggccgccaacttccagctgtgcacccagaccagacagttctacgtgagcatccagccccccgtgggcgagctgatggcccccgtgttcatgagcgagaacgagttcaagaaggagcagggcaagctgatgggcatgaacgagatcaccgagaagctgatgctgcccgacacctgcagaagcgaccacatcgtggtgcagaaggtgaccgccaccgccaacctgggcagagtgccctgcggcaccagcgacgagtacagattcgccggcagaaccctgaccggcggcagcctggtgctgctgaccctggacgccagacccgccggcgccgcccagctgaccgtgaacagcgagaagatggtgatcggcaccatgctggtgaaggacgtgatccaggccctgacccagtag

SEQ ID NO: 16240 - DNA, 3066 bp, Artificial Sequence
  Description of Artificial Sequence: Synthetic coding sequence
atggccctgaagatggtgaagggcagcatcgacagaatgttcgacaagaacctgcaggacctggtgagaggcatcagaaaccacaaggaggacgaggccaagtacatcagccagtgcatcgacgagatcaagcaggagctgaagcaggacaacatcgccgtgaaggccaacgccgtgtgcaagctgacctacctgcagatgctgggctacgacatcagctgggccgccttcaacatcatcgaggtgatgagcgccagcaagttcaccttcaagagaatcggctacctggccgccagccagagcttccacgagggcaccgacgtgatcatgctgaccaccaaccagatcagaaaggacctgagcagccccagccagtacgacaccggcgtggccctgaccggcctgagctgcttcgtgacccccgacctggccagagacctggccaacgacatcatgaccctgatgagccacaccaagccctacatcagaaagaaggccgtgctgatcatgtacaaggtgttcctgaagtaccccgagagcctgagacccgccttccccagactgaaggagaagctggaggaccccgaccccggcgtgcagagcgccgccgtgaacgtgatctgcgagctggccagaagaaaccccaagaactacctgagcctggcccccctgttcttcaagctgatgaccagcagcaccaacaactgggtgctgatcaagatcatcaagctgttcggcgccctgacccccctggagcccagactgggcaagaagctgatcgagcccctgaccaacctgatccacagcaccagcgccatgagcctgctgtacgagtgcgtgaacaccgtgatcgccgtgctgatcagcctgagcagcggcatgcccaaccacagcgccagcatccagctgtgcgtgcagaagctgagaatcctgatcgaggacagcgaccagaacctgaagtacctgggcctgctggccatgagcaagatcctgaagacccaccccaagagcgtgcagagccacaaggacctgatcctgcagtgcctggacgacaaggacgagagcatcagactgagagccctggacctgctgtacggcatggtgagcaagaagaacctgatggagatcgtgaagaagctgatgacccacgtggacaaggccgagggcaccacctacagagacgagctgctgaccaagatcatcgacatctgcagccagagcaactaccagtacatcaccaacttcgagtggtacatcagcatcctggtggagctgaccagactggagggcaccagacacggccacctgatcgccgcccagatgctggacgtggccatcagagtgaaggccatcagaaagttcgccgtgagccagatgagcgccctgctggacagcgcccacctgctggccagcagcacccagagaaacggcatctgcgaggtgctgtacgccgccgcctggatctgcggcgagttcagcgagcacctgcaggagccccaccacaccctggaggccatgctgagacccagagtgaccaccctgcccggccacatccaggccgtgtacgtgcagaacgtggtgaagctgtacgccagcatcctgcagcagaaggagcaggccggcgaggccgagggcgcccaggccgtgacccagctgatggtggacagactgccccagttcgtgcagagcgccgacctggaggtgcaggagagagccagctgcatcctgcagctggtgaagcacatccagaagctgcaggccaaggacgtgcccgtggccgaggaggtgagcgccctgttcgccggcgagctgaaccccgtggcccccaaggcccagaagaaggtgcccgtgcccgagggcctggacctggacgcctggatcaacgagcccctgagcgacagcgagagcgaggacgagagacccagagccgtgttccacgaggaggagcagagaagacccaagcacagacccagcgaggccgacgaggaggagctggccagaagaagagaggccagaaagcaggagcaggccaacaaccccttctacatcaagagcagccccagcccccagaagagataccaggacacccccggcgtggagcacatccccgtggtgcagatcgacctgagcgtgcccctgaaggtgcccggcctgcccatgagcgaccagtacgtgaagctggaggaggagagaagacacagacagaagctggagaaggacaagagaagaaagaagagaaaggagaaggaggagagaaccaagggcaagaagaagagcaagaagcagccccccggcagcgaggaggccgccggcgagcccgtgcagaacggcgcccccgaggaggagcagctgccccccgagagcagctacagcctgctggccgagaacagctacgtgaagatgacctgcgacatcagaggcagcctgcaggaggacagccaggtgaccgtggccatcgtgctggagaacagaagcagcagcatcctgaagggcatggagctgagcgtgctggacagcctgaacgccagaatggccagaccccagggcagcagcgtgcacgacggcgtgcccgtgcccttccagctgccccccggcgtgagcaacgaggcccagtacgtgttcaccatccagagcatcgtgatggcccagaagctgaagggcaccctgagcttcatcgccaagaacgacgagggcgccacccacgagaagctggacttcagactgcacttcagctgcagcagctacctgatcaccaccccctgctacagcgacgccttcgccaagctgctggagagcggcgacctgagcatgagcagcatcaaggtggacggcatcagaatgagcttccagaacctgctggccaagatctgcttccaccaccacttcagcgtggtggagagagtggacagctgcgccagcatgtacagcagaagcatccagggccaccacgtgtgcctgctggtgaagaagggcgagaacagcgtgagcgtggacggcaagtgcagcgacagcaccctgctgagcaacctgctggaggagatgaaggccaccctggccaagtgctag

SEQ ID NO: 16241 - DNA, 3462 bp, Artificial Sequence
  Description of Artificial Sequence: Synthetic coding sequence
atggccctgaagatggtgaagggcagcatcgacagaatgttcgacaagaacctgcaggacctggtgagaggcatcagaaaccacaaggaggacgaggccaagtacatcagccagtgcatcgacgagatcaagcaggagctgaagcaggacaacatcgccgtgaaggccaacgccgtgtgcaagctgacctacctgcagatgctgggctacgacatcagctgggccgccttcaacatcatcgaggtgatgagcgccagcaagttcaccttcaagagaatcggctacctggccgccagccagagcttccacgagggcaccgacgtgatcatgctgaccaccaaccagatcagaaaggacctgagcagccccagccagtacgacaccggcgtggccctgaccggcctgagctgcttcgtgacccccgacctggccagagacctggccaacgacatcatgaccctgatgagccacaccaagccctacatcagaaagaaggccgtgctgatcatgtacaaggtgttcctgaagtaccccgagagcctgagacccgccttccccagactgaaggagaagctggaggaccccgaccccggcgtgcagagcgccgccgtgaacgtgatctgcgagctggccagaagaaaccccaagaactacctgagcctggcccccctgttcttcaagctgatgaccagcagcaccaacaactgggtgctgatcaagatcatcaagctgttcggcgccctgacccccctggagcccagactgggcaagaagctgatcgagcccctgaccaacctgatccacagcaccagcgccatgagcctgctgtacgagtgcgtgaacaccgtgatcgccgtgctgatcagcctgagcagcggcatgcccaaccacagcgccagcatccagctgtgcgtgcagaagctgagaatcctgatcgaggacagcgaccagaacctgaagtacctgggcctgctggccatgagcaagatcctgaagacccaccccaagagcgtgcagagccacaaggacctgatcctgcagtgcctggacgacaaggacgagagcatcagactgagagccctggacctgctgtacggcatggtgagcaagaagaacctgatggagatcgtgaagaagctgatgacccacgtggacaaggccgagggcaccacctacagagacgagctgctgaccaagatcatcgacatctgcagccagagcaactaccagtacatcaccaacttcgagtggtacatcagcatcctggtggagctgaccagactggagggcaccagacacggccacctgatcgccgcccagatgctggacgtggccatcagagtgaaggccatcagaaagttcgccgtgagccagatgagcgccctgctggacagcgcccacctgctggccagcagcacccagagaaacggcatctgcgaggtgctgtacgccgccgcctggatctgcggcgagttcagcgagcacctgcaggagccccaccacaccctggaggccatgctgagacccagagtgaccaccctgcccggccacatccaggccgtgtacgtgcagaacgtggtgaagctgtacgccagcatcctgcagcagaaggagcaggccggcgaggccgagggcgcccaggccgtgacccagctgatggtggacagactgccccagttcgtgcagagcgccgacctggaggtgcaggagagagccagctgcatcctgcagctggtgaagcacatccagaagctgcaggccaaggacgtgcccgtggccgaggaggtgagcgccctgttcgccggcgagctgaaccccgtggcccccaaggcccagaagaaggtgcccgtgcccgagggcctggacctggacgcctggatcaacgagcccctgagcgacagcgagagcgaggacgagagacccagagccgtgttccacgaggaggagcagagaagacccaagcacagacccagcgaggccgacgaggaggagctggccagaagaagagaggccagaaagcaggagcaggccaacaaccccttctacatcaagagcagccccagcccccagaagagataccaggacacccccggcgtggagcacatccccgtggtgcagatcgacctgagcgtgcccctgaaggtgcccggcctgcccatgagcgaccagtacgtgaagctggaggaggagagaagacacagacagaagctggagaaggacaagagaagaaagaagagaaaggagaaggagaagaagggcaagagaagacacagcagcctgcccaccgagagcgacgaggacatcgcccccgcccagcaggtggacatcgtgaccgaggagatgcccgagaacgccctgcccagcgacgaggacgacaaggaccccaacgacccctacagagccctggacatcgacctggacaagcccctggccgacagcgagaagctgcccatccagaagcacagaaacaccgagaccagcaagagccccgagaaggacgtgcccatggtggagaagaagagcaagaagcccaagaagaaggagaagaagcacaaggagaaggagagagacaaggagaagaagaaggagaaggagaagaagaagagccccaagcccaagaagaagaagcacagaaaggagaaggaggagagaaccaagggcaagaagaagagcaagaagcagccccccggcagcgaggaggccgccggcgagcccgtgcagaacggcgcccccgaggaggagcagctgccccccgagagcagctacagcctgctggccgagaacagctacgtgaagatgacctgcgacatcagaggcagcctgcaggaggacagccaggtgaccgtggccatcgtgctggagaacagaagcagcagcatcctgaagggcatggagctgagcgtgctggacagcctgaacgccagaatggccagaccccagggcagcagcgtgcacgacggcgtgcccgtgcccttccagctgccccccggcgtgagcaacgaggcccagtacgtgttcaccatccagagcatcgtgatggcccagaagctgaagggcaccctgagcttcatcgccaagaacgacgagggcgccacccacgagaagctggacttcagactgcacttcagctgcagcagctacctgatcaccaccccctgctacagcgacgccttcgccaagctgctggagagcggcgacctgagcatgagcagcatcaaggtggacggcatcagaatgagcttccagaacctgctggccaagatctgcttccaccaccacttcagcgtggtggagagagtggacagctgcgccagcatgtacagcagaagcatccagggccaccacgtgtgcctgctggtgaagaagggcgagaacagcgtgagcgtggacggcaagtgcagcgacagcaccctgctgagcaacctgctggaggagatgaaggccaccctggccaagtgctag

SEQ ID NO: 16242 - DNA, 2955 bp, Artificial Sequence
  Description of Artificial Sequence: Synthetic coding sequence
atggccctgaagatggtgaagggcagcatcgacagaatgttcgacaagaacctgcaggacctggtgagaggcatcagaaaccacaaggaggacgaggccaagtacatcagccagtgcatcgacgagatcaagcaggagctgaagcaggacaacatcgccgtgaaggccaacgccgtgtgcaagctgacctacctgcagatgctgggctacgacatcagctgggccgccttcaacatcatcgaggtgatgagcgccagcaagttcaccttcaagagaatcggctacctggccgccagccagagcttccacgagggcaccgacgtgatcatgctgaccaccaaccagatcctgctgatcagcctgagcagcggcatgcccaaccacagcgccagcatccagctgtgcgtgcagaagctgagaatcctgatcgaggacagcgaccagaacctgaagtacctgggcctgctggccatgagcaagatcctgaagacccaccccaagagcgtgcagagccacaaggacctgatcctgcagtgcctggacgacaaggacgagagcatcagactgagagccctggacctgctgtacggcatggtgagcaagaagaacctgatggagatcgtgaagaagctgatgacccacgtggacaaggccgagggcaccacctacagagacgagctgctgaccaagatcatcgacatctgcagccagagcaactaccagtacatcaccaacttcgagtggtacatcagcatcctggtggagctgaccagactggagggcaccagacacggccacctgatcgccgcccagatgctggacgtggccatcagagtgaaggccatcagaaagttcgccgtgagccagatgagcgccctgctggacagcgcccacctgctggccagcagcacccagagaaacggcatctgcgaggtgctgtacgccgccgcctggatctgcggcgagttcagcgagcacctgcaggagccccaccacaccctggaggccatgctgagacccagagtgaccaccctgcccggccacatccaggccgtgtacgtgcagaacgtggtgaagctgtacgccagcatcctgcagcagaaggagcaggccggcgaggccgagggcgcccaggccgtgacccagctgatggtggacagactgccccagttcgtgcagagcgccgacctggaggtgcaggagagagccagctgcatcctgcagctggtgaagcacatccagaagctgcaggccaaggacgtgcccgtggccgaggaggtgagcgccctgttcgccggcgagctgaaccccgtggcccccaaggcccagaagaaggtgcccgtgcccgagggcctggacctggacgcctggatcaacgagcccctgagcgacagcgagagcgaggacgagagacccagagccgtgttccacgaggaggagcagagaagacccaagcacagacccagcgaggccgacgaggaggagctggccagaagaagagaggccagaaagcaggagcaggccaacaaccccttctacatcaagagcagccccagcccccagaagagataccaggacacccccggcgtggagcacatccccgtggtgcagatcgacctgagcgtgcccctgaaggtgcccggcctgcccatgagcgaccagtacgtgaagctggaggaggagagaagacacagacagaagctggagaaggacaagagaagaaagaagagaaaggagaaggagaagaagggcaagagaagacacagcagcctgcccaccgagagcgacgaggacatcgcccccgcccagcaggtggacatcgtgaccgaggagatgcccgagaacgccctgcccagcgacgaggacgacaaggaccccaacgacccctacagagccctggacatcgacctggacaagcccctggccgacagcgagaagctgcccatccagaagcacagaaacaccgagaccagcaagagccccgagaaggacgtgcccatggtggagaagaagagcaagaagcccaagaagaaggagaagaagcacaaggagaaggagagagacaaggagaagaagaaggagaaggagaagaagaagagccccaagcccaagaagaagaagcacagaaaggagaaggaggagagaaccaagggcaagaagaagagcaagaagcagccccccggcagcgaggaggccgccggcgagcccgtgcagaacggcgcccccgaggaggagcagctgccccccgagagcagctacagcctgctggccgagaacagctacgtgaagatgacctgcgacatcagaggcagcctgcaggaggacagccaggtgaccgtggccatcgtgctggagaacagaagcagcagcatcctgaagggcatggagctgagcgtgctggacagcctgaacgccagaatggccagaccccagggcagcagcgtgcacgacggcgtgcccgtgcccttccagctgccccccggcgtgagcaacgaggcccagtacgtgttcaccatccagagcatcgtgatggcccagaagctgaagggcaccctgagcttcatcgccaagaacgacgagggcgccacccacgagaagctggacttcagactgcacttcagctgcagcagctacctgatcaccaccccctgctacagcgacgccttcgccaagctgctggagagcggcgacctgagcatgagcagcatcaaggtggacggcatcagaatgagcttccagaacctgctggccaagatctgcttccaccaccacttcagcgtggtggagagagtggacagctgcgccagcatgtacagcagaagcatccagggccaccacgtgtgcctgctggtgaagaagggcgagaacagcgtgagcgtggacggcaagtgcagcgacagcaccctgctgagcaacctgctggaggagatgaaggccaccctggccaagtgctag

SEQ ID NO: 16243 - DNA, 3648 bp, Artificial Sequence
  Description of Artificial Sequence: Synthetic coding sequence
atggccctgaagatggtgaagggcagcatcgacagaatgttcgacaagaacctgcaggacctggtgagaggcatcagaaaccacaaggaggacgaggccaagtacatcagccagtgcatcgacgagatcaagcaggagctgaagcaggacaacatcgccgtgaaggccaacgccgtgtgcaagctgacctacctgcagatgctgggctacgacatcagctgggccgccttcaacatcatcgaggtgatgagcgccagcaagttcaccttcaagagaatcggctacctggccgccagccagagcttccacgagggcaccgacgtgatcatgctgaccaccaaccagatcagaaaggacctgagcagccccagccagtacgacaccggcgtggccctgaccggcctgagctgcttcgtgacccccgacctggccagagacctggccaacgacatcatgaccctgatgagccacaccaagccctacatcagaaagaaggccgtgctgatcatgtacaaggtgttcctgaagtaccccgagagcctgagacccgccttccccagactgaaggagaagctggaggaccccgaccccggcgtgcagagcgccgccgtgaacgtgatctgcgagctggccagaagaaaccccaagaactacctgagcctggcccccctgttcttcaagctgatgaccagcagcaccaacaactgggtgctgatcaagatcatcaagctgttcggcgccctgacccccctggagcccagactgggcaagaagctgatcgagcccctgaccaacctgatccacagcaccagcgccatgagcctgctgtacgagtgcgtgaacaccgtgatcgccgtgctgatcagcctgagcagcggcatgcccaaccacagcgccagcatccagctgtgcgtgcagaagctgagaatcctgatcgaggacagcgaccagaacctgaagtacctgggcctgctggccatgagcaagatcctgaagacccaccccaagagcgtgcagagccacaaggacctgatcctgcagtgcctggacgacaaggacgagagcatcagactgagagccctggacctgctgtacggcatggtgagcaagaagaacctgatggagatcgtgaagaagctgatgacccacgtggacaaggccgagggcaccacctacagagacgagctgctgaccaagatcatcgacatctgcagccagagcaactaccagtacatcaccaacttcgagtggtacatcagcatcctggtggagctgaccagactggagggcaccagacacggccacctgatcgccgcccagatgctggacgtggccatcagagtgaaggccatcagaaagttcgccgtgagccagatgagcgccctgctggacagcgcccacctgctggccagcagcacccagagaaacggcatctgcgaggtgctgtacgccgccgcctggatctgcggcgagttcagcgagcacctgcaggagccccaccacaccctggaggccatgctgagacccagagtgaccaccctgcccggccacatccaggccgtgtacgtgcagaacgtggtgaagctgtacgccagcatcctgcagcagaaggagcaggccggcgaggccgagggcgcccaggccgtgacccagctgatggtggacagactgccccagttcgtgcagagcgccgacctggaggtgcaggagagagccagctgcatcctgcagctggtgaagcacatccagaagctgcaggccaaggacgtgcccgtggccgaggaggtgagcgccctgttcgccggcgagctgaaccccgtggcccccaaggcccagaagaaggtgcccgtgcccgagggcctggacctggacgcctggatcaacgagcccctgagcgacagcgagagcgaggacgagagacccagagccgtgttccacgaggaggagcagagaagacccaagcacagacccagcgaggccgacgaggaggagctggccagaagaagagaggccagaaagcaggagcaggccaacaaccccttctacatcaagagcagccccagcccccagaagagataccaggacacccccggcgtggagcacatccccgtggtgcagatcgacctgagcgtgcccctgaaggtgcccggcctgcccatgagcgaccagtacgtgaagctggaggaggagagaagacacagacagaagctggagaaggacaagagaagaaagaagagaaaggagaaggagaagaagggcaagagaagacacagcagcctgcccaccgagagcgacgaggacatcgcccccgcccagcaggtggacatcgtgaccgaggagatgcccgagaacgccctgcccagcgacgaggacgacaaggaccccaacgacccctacagagccctggacatcgacctggacaagcccctggccgacagcgagaagctgcccatccagaagcacagaaacaccgagaccagcaagagccccgagaaggacgtgcccatggtggagaagaagagcaagaagcccaagaagaaggagaagaagcacaaggagaaggagagagacaaggagaagaagaaggagaaggagaagaaggccgaggacctggacttctggctgagcaccacccccccccccgcccccgcccccgcccccgcccccgtgcccagcaccggcgagctgagcgtgaacaccgtgaccacccccaaggacgagtgcgaggacgccaagaccgaggcccagggcgaggaggacgacgccgagggccaggaccaggacaagaagagccccaagcccaagaagaagaagcacagaaaggagaaggaggagagaaccaagggcaagaagaagagcaagaagcagccccccggcagcgaggaggccgccggcgagcccgtgcagaacggcgcccccgaggaggagcagctgccccccgagagcagctacagcctgctggccgagaacagctacgtgaagatgacctgcgacatcagaggcagcctgcaggaggacagccaggtgaccgtggccatcgtgctggagaacagaagcagcagcatcctgaagggcatggagctgagcgtgctggacagcctgaacgccagaatggccagaccccagggcagcagcgtgcacgacggcgtgcccgtgcccttccagctgccccccggcgtgagcaacgaggcccagtacgtgttcaccatccagagcatcgtgatggcccagaagctgaagggcaccctgagcttcatcgccaagaacgacgagggcgccacccacgagaagctggacttcagactgcacttcagctgcagcagctacctgatcaccaccccctgctacagcgacgccttcgccaagctgctggagagcggcgacctgagcatgagcagcatcaaggtggacggcatcagaatgagcttccagaacctgctggccaagatctgcttccaccaccacttcagcgtggtggagagagtggacagctgcgccagcatgtacagcagaagcatccagggccaccacgtgtgcctgctggtgaagaagggcgagaacagcgtgagcgtggacggcaagtgcagcgacagcaccctgctgagcaacctgctggaggagatgaaggccaccctggccaagtgctag

SEQ ID NO: 16244 - DNA, 3339 bp, Artificial Sequence
  Description of Artificial Sequence: Synthetic coding sequence
atggccctgaagatggtgaagggcagcatcgacagaatgttcgacaagaacctgcaggacctggtgagaggcatcagaaaccacaaggaggacgaggccaagtacatcagccagtgcatcgacgagatcaagcaggagctgaagcaggacaacatcgccgtgaaggccaacgccgtgtgcaagctgacctacctgcagatgctgggctacgacatcagctgggccgccttcaacatcatcgaggtgatgagcgccagcaagttcaccttcaagagaatcggctacctggccgccagccagagcttccacgagggcaccgacgtgatcatgctgaccaccaaccagatcagaaaggacctgagcagccccagccagtacgacaccggcgtggccctgaccggcctgagctgcttcgtgacccccgacctggccagagacctggccaacgacatcatgaccctgatgagccacaccaagccctacatcagaaagaaggccaagctgatcgagcccctgaccaacctgatccacagcaccagcgccatgagcctgctgtacgagtgcgtgaacaccgtgatcgccgtgctgatcagcctgagcagcggcatgcccaaccacagcgccagcatccagctgtgcgtgcagaagctgagaatcctgatcgaggacagcgaccagaacctgaagtacctgggcctgctggccatgagcaagatcctgaagacccaccccaagagcgtgcagagccacaaggacctgatcctgcagtgcctggacgacaaggacgagagcatcagactgagagccctggacctgctgtacggcatggtgagcaagaagaacctgatggagatcgtgaagaagctgatgacccacgtggacaaggccgagggcaccacctacagagacgagctgctgaccaagatcatcgacatctgcagccagagcaactaccagtacatcaccaacttcgagtggtacatcagcatcctggtggagctgaccagactggagggcaccagacacggccacctgatcgccgcccagatgctggacgtggccatcagagtgaaggccatcagaaagttcgccgtgagccagatgagcgccctgctggacagcgcccacctgctggccagcagcacccagagaaacggcatctgcgaggtgctgtacgccgccgcctggatctgcggcgagttcagcgagcacctgcaggagccccaccacaccctggaggccatgctgagacccagagtgaccaccctgcccggccacatccaggccgtgtacgtgcagaacgtggtgaagctgtacgccagcatcctgcagcagaaggagcaggccggcgaggccgagggcgcccaggccgtgacccagctgatggtggacagactgccccagttcgtgcagagcgccgacctggaggtgcaggagagagccagctgcatcctgcagctggtgaagcacatccagaagctgcaggccaaggacgtgcccgtggccgaggaggtgagcgccctgttcgccggcgagctgaaccccgtggcccccaaggcccagaagaaggtgcccgtgcccgagggcctggacctggacgcctggatcaacgagcccctgagcgacagcgagagcgaggacgagagacccagagccgtgttccacgaggaggagcagagaagacccaagcacagacccagcgaggccgacgaggaggagctggccagaagaagagaggccagaaagcaggagcaggccaacaaccccttctacatcaagagcagccccagcccccagaagagataccaggacacccccggcgtggagcacatccccgtggtgcagatcgacctgagcgtgcccctgaaggtgcccggcctgcccatgagcgaccagtacgtgaagctggaggaggagagaagacacagacagaagctggagaaggacaagagaagaaagaagagaaaggagaaggagaagaagggcaagagaagacacagcagcctgcccaccgagagcgacgaggacatcgcccccgcccagcaggtggacatcgtgaccgaggagatgcccgagaacgccctgcccagcgacgaggacgacaaggaccccaacgacccctacagagccctggacatcgacctggacaagcccctggccgacagcgagaagctgcccatccagaagcacagaaacaccgagaccagcaagagccccgagaaggacgtgcccatggtggagaagaagagcaagaagcccaagaagaaggagaagaagcacaaggagaaggagagagacaaggagaagaagaaggagaaggagaagaaggccgaggacctggacttctggctgagcaccacccccccccccgcccccgcccccgcccccgcccccgtgcccagcaccgacgagtgcgaggacgccaagaccgaggcccagggcgaggaggacgacgccgagggccaggaccaggacaagaagagccccaagcccaagaagaagaagcacagaaaggagaaggaggagagaaccaagggcaagaagaagagcaagaagcagccccccggcagcgaggaggccgccggcgagcccgtgcagaacggcgcccccgaggaggagcagctgccccccgagagcagctacagcctgctggccgagaacagctacgtgaagatgacctgcgacatcagaggcagcctgcaggaggacagccaggtgaccgtggccatcgtgctggagaacagaagcagcagcatcctgaagggcatggagctgagcgtgctggacagcctgaacgccagaatggccagaccccagggcagcagcgtgcacgacggcgtgcccgtgcccttccagctgccccccggcgtgagcaacgaggcccagtacgtgttcaccatccagagcatcgtgatggcccagaagctgaagggcaccctgagcttcatcgccaagaacgacgagggcgccacccacgagaagctggacttcagactgcacttcagctgcagcagctacctgatcaccaccccctgctacagcgacgccttcgccaagctgctggagagcggcgacctgagcatgagcagcatcaaggtggacggcatcagaatgagcttccagaacctgctggccaagatctgcttccaccaccacttcagcgtggtggagagagtggacagctgcgccagcatgtacagcagaagcatccagggccaccacgtgtgcctgctggtgaagaagggcgagaacagcgtgagcgtggacggcaagtgcagcgacagcaccctgctgagcaacctgctggaggagatgaaggccaccctggccaagtgctag

SEQ ID NO: 16245 - DNA, 1257 bp, Artificial Sequence
  Description of Artificial Sequence: Synthetic coding sequence
atgatccacagcctgttcctgatcaactgcagcggcgacatcttcctggagaagcactggaagagcgtggtgagccagagcgtgtgcgactacttcttcgaggcccaggagaaggccgccgacgtggagaacgtgccccccgtgatcagcaccccccaccactacctgatcagcatctacagagacaagctgttcttcgtgagcgtgatccagaccgaggtgccccccctgttcgtgatcgagttcctgcacagagtggccgacaccttccaggactacttcggcgagtgcagcgaggccgccatcaaggacaacgtggtgatcgtgtacgagctgctggaggagatgctggacaacggcttccccctggccaccgagagcaacatcctgaaggagctgatcaagccccccaccatcctgagaagcgtggtgaacagcatcaccggcagcagcaacgtgggcgacaccctgcccaccggccagctgagcaacatcccctggagaagagccggcgtgaagtacaccaacaacgaggcctacttcgacgtggtggaggagatcgacgccatcatcgacaagagcggcagcaccgtgttcgccgagatccagggcgtgatcgacgcctgcatcaagctgagcggcatgcccgacctgagcctgagcttcatgaaccccagactgctggacgacgtgagcttccacccctgcatcagattcaagagatgggagagcgagagagtgctgagcttcatcccccccgacggcaacttcagactgatcagctacagagtgagcagccagaacctggtggccatccccgtgtacgtgaagcacagcatcagcttcaaggagaacagcagctgcggcagattcgacatcaccatcggccccaagcagaacatgggcaagaccatcgagggcatcaccgtgaccgtgcacatgcccaaggtggtgctgaacatgaacctgacccccacccagggcagctacaccttcgaccccgtgaccaaggtgctgacctgggacgtgggcaagatcaccccccagaagctgcccagcctgaagggcctggtgaacctgcagagcggcgcccccaagcccgaggagaaccccagcctgaacatccagttcaagatccagcagctggccatcagcggcctgaaggtgaacagactggacatgtacggcgagaagtacaagcccttcaagggcgtgaagtacgtgaccaaggccggcaagttccaggtgagaacctag

SEQ ID NO: 16246 - DNA, 1257 bp, Artificial Sequence; identical to SEQ ID NO: 16245
  Description of Artificial Sequence: Synthetic coding sequence

SEQ ID NO: 16247 - DNA, 1257 bp, Artificial Sequence
  Description of Artificial Sequence: Synthetic coding sequence
atgatccacagcctgttcctgatcaacagcagcggcgacatcttcctggagaagcactggaagagcgtggtgagcagaagcgtgtgcgactacttcttcgaggcccaggagagagccaccgaggccgagaacgtgccccccgtgatccccaccccccaccactacctgctgagcgtgtacagacacaagatcttcttcgtggccgtgatccagaccgaggtgccccccctgttcgtgatcgagttcctgcacagagtggtggacaccttccaggactacttcggcgtgtgcagcgagcccgtgatcaaggacaacgtggtggtggtgtacgaggtgctggaggagatgctggacaacggcttccccctggccaccgagagcaacatcctgaaggagctgatcaagccccccaccatcctgagaaccgtggtgaacaccatcaccggcagcaccaacgtgggcgaccagctgcccaccggccagctgagcgtggtgccctggagaagaaccggcgtgaagtacaccaacaacgaggcctacttcgacgtgatcgaggagatcgacgccatcatcgacaagagcggcagcaccatcaccgccgagatccagggcgtgatcgacgcctgcgtgaagctgaccggcatgcccgacctgaccctgagcttcatgaaccccagactgctggacgacgtgagcttccacccctgcgtgagattcaagagatgggagagcgagagaatcctgagcttcatcccccccgacggcaacttcagactgctgagctaccacgtgagcgcccagaacctggtggccatccccgtgtacgtgaagcacaacatcagcttcagagacagcagcagcctgggcagattcgagatcaccgtgggccccaagcagaccatgggcaagaccatcgagggcgtgaccgtgaccagccagatgcccaagggcgtgctgaacatgagcctgacccccagccagggcacccacaccttcgaccccgtgaccaagatgctgagctgggacgtgggcaagatcaacccccagaagctgcccagcctgaagggcaccatgagcctgcaggccggcgccagcaagcccgacgagaaccccaccatcaacctgcagttcaagatccagcagctggccatcagcggcctgaaggtgaacagactggacatgtacggcgagaagtacaagcccttcaagggcatcaagtacatgaccaaggccggcaagttccaggtgagaacctag

SEQ ID NO: 16248 - DNA, 1257 bp, Artificial Sequence; identical to SEQ ID NO: 16247
  Description of Artificial Sequence: Synthetic coding sequence

SEQ ID NO: 16249 - DNA, 33 bp, Artificial Sequence
  Description of Artificial Sequence: Synthetic coding sequence
atgatccacagcctgttcctgatcaacagctag

SEQ ID NO: 16250 - DNA, 1257 bp, Artificial Sequence; identical to SEQ ID NO: 16247
  Description of Artificial Sequence: Synthetic coding sequence

SEQ ID NO: 16251 - DNA, 420 bp, Artificial Sequence
  Description of Artificial Sequence: Synthetic coding sequence
atgatccacagcctgttcctgatcaacagcagcggcgacatcttcctggagaagcactggaagagcgtggtgagcagaagcgtgtgcgactacttcttcgaggcccaggagagagccaccgaggccgagaacgtgccccccgtgatccccaccccccaccactacctgctgagcgtgtacagacacaagatcttcttcgtggccgtgatccagaccgaggtgccccccctgttcgtgatcgagttcctgcacagagtggtggacaccttccaggactacttcggcgtgtgcagcgagcccgtgatcaaggacaacgtggtggtggtgtacgaggtgctggaggagatgctggacaacggcttccccctggccaccgagagcaacatcctgaaggagctgatcaagccccccaccatctag

SEQ ID NO: 16252 - DNA, 822 bp, Artificial Sequence
  Description of Artificial Sequence: Synthetic coding sequence
atgatccacagcctgttcctgatcaacagcagcggcgacatcttcctggagaagcactggaagagcgtggtgagcagaagcgtgtgcgactacttcttcgaggcccaggagagagccaccgaggccgagaacgtgccccccgtgatccccaccccccaccactacctgctgagcgtgtacagacacaagatcttcttcgtggccgtgatccagaccgaggtgccccccctgttcgtgatcgagttcctgcacagagtggtggacaccttccaggactacttcggcgtgtgcagcgagcccgtgatcaaggacaacgtggtggtggtgtacgaggtgctggaggagatgctggacaacggcttccccctggccaccgagagcaacatcctgaaggagctgatcaagccccccaccatcctgagaaccgtggtgaacaccatcaccggcagcaccaacgtgggcgaccagctgcccaccggccagctgagcgtggtgccctggagaagaaccggcgtgaagtacaccaacaacgaggcctacttcgacgtgatcgaggagatcgacgccatcatcgacaagagcggcagcaccatcaccgccgagatccagggcgtgatcgacgcctgcgtgaagctgaccggcatgcccgacctgaccctgagcttcatgaaccccagactgctggacgacgtgagcttccacccctgcgtgagattcaagagatgggagagcgagagaatcctgagcttcatcccccccgacggcaacttcagactgctgagctaccacgtgagcgcccagaagtgctgcctgggcatgtag

SEQ ID NO: 16253 - DNA, 582 bp, Artificial Sequence
  Description of Artificial Sequence: Synthetic coding sequence
atgatccaggccatcctggtgttcaacaaccacggcaagcccagactggtgagattctaccagagattccccgaggagatccagcagcagatcgtgagagagaccttccacctggtgctgaagagagacgacaacatctgcaacttcctggagggcggcagcctgatcggcggcagcgactacaagctgatctacagacactacgccaccctgtacttcgtgttctgcgtggacagcagcgagagcgagctgggcatcctggacctgatccaggtgttcgtggagaccctggacaagtgcttcgagaacgtgtgcgagctggacctgatcttccacatggacaaggtgcactacatcctgcaggaggtggtgatgggcggcatggtgctggagaccaacatgaacgagatcgtggcccagatcgaggcccagaacagactggagaagagcgagggcggcctgagcgccgcccccgccagagccgtgagcgccgtgaagaacatcaacctgcccgagatccccagaaacatcaacatcggcgacctgaacatcaaggtgcccaacctgagccagttcgtgtag

SEQ ID NO: 16254 - DNA, 375 bp, Artificial Sequence
  Description of Artificial Sequence: Synthetic coding sequence
atgatccaggccatcctggtgttcaacaaccacggcaagcccagactggtgagattctaccagagattccccgaggagatccagcagcagatcgtgagagagaccttccacctggtgctgaagagagacgacaacatctgcaacttcctggagggcggcagcctgatcggcggcagcgactacaagctgatctacagacactacgccaccctgtacttcgtgttctgcgtggacagcagcgagagcgagctgggcatcctggacctgatccagctgaagaagagagagagaaagaagagccagtgcaacaccctgcagaccggcaccctggccctgtgggagcagggccccgacatcagaaccagaagactgtag

SEQ ID NO: 16255 - DNA, 375 bp, Artificial Sequence; identical to SEQ ID NO: 16254
  Description of Artificial Sequence: Synthetic coding sequence

SEQ ID NO: 16256 - DNA, 1506 bp, Artificial Sequence
  Description of Artificial Sequence: Synthetic coding sequence
atgcccgccgccatgctgccctacgcctgcgtgctggtgctgctgggcgcccacaccgcccccgccgccggcgaggccggcggcagctgcctgagatgggagccccactgccagcagcccctgcccgacagagtgcccagcaccgccatcctgccccccagactgaacggcccctggatcagcaccggctgcgaggtgagacccggccccgagttcctgaccagagcctacaccttctaccccagcagactgttcagagcccaccagttctactacgaggaccccttctgcggcgagcccgcccacagcctgctggtgaagggcaaggtgagactgagaagagccagctgggtgaccagaggcgccaccgaggccgactaccacctgcacaaggtgggcatcgtgttccacagcagaagagccctggtggacgtgaccggcagactgaaccagaccagagccggcagagactgcgccagaagactgccccccgccagagcctggctgcccggcgccctgtacgagctgagaagcgccagagcccagggcgactgcctggaggccctgggcctgaccatgcacgagctgagcctggtgagagtgcagagaagactgcagccccagcccagagccagccccagactggtggaggagctgtacctgggcgacatccacaccgaccccgccgagagaagacactacagacccaccggctaccagagacccctgcagagcgccctgcaccacgtgcagccctgccccgcctgcggcctgatcgccagaagcgacgtgcaccacccccccgtgctgcccccccccctggccctgcccctgcacctgggcggctggtgggtgagcagcggctgcgaggtgagacccgccgtgctgttcctgaccagactgttcaccttccacggccacagcagaagctgggagggctactaccaccacttcagcgaccccgcctgcagacagcccaccttcaccgtgtacgccgccggcagatacaccagaggcacccccagcaccagagtgagaggcggcaccgagctggtgttcgaggtgaccagagcccacgtgacccccatggaccaggtgaccaccgccatgctgaacttcagcgagcccagcagctgcggcggcgccggcgcctggagcatgggcaccgagagagacgtgaccgccaccaacggctgcctgcccctgggcatcagactgccccacgtggagtacgagctgttcaagatggagcaggaccccctgggccagagcctgctgttcatcggccagagacccaccgacggcagcagccccgacacccccgagaagagacccaccagctaccaggcccccctggtgctgtgccacggcgaggcccccgacttcagcagacccccccagcacagacccagcctgcagaagcaccccagcaccggcggcctgcacatcgcccccttccccctgctgcccctggtgctgggcctggccttcctgcactggctgtag

SEQ ID NO: 16257 - DNA, 1539 bp, Artificial Sequence
  Description of Artificial Sequence: Synthetic coding sequence
atggccgagaacagcggccccggcgtgagaccccccggctgggaggcccagatcaacatcatcagcaccagactggccctggcccacaccgcccccgccgccggcgaggccggcggcagctgcctgagatgggagccccactgccagcagcccctgcccgacagagtgcccagcaccgccatcctgccccccagactgaacggcccctggatcagcaccggctgcgaggtgagacccggccccgagttcctgaccagagcctacaccttctaccccagcagactgttcagagcccaccagttctactacgaggaccccttctgcggcgagcccgcccacagcctgctggtgaagggcaaggtgagactgagaagagccagctgggtgaccagaggcgccaccgaggccgactaccacctgcacaaggtgggcatcgtgttccacagcagaagagccctggtggacgtgaccggcagactgaaccagaccagagccggcagagactgcgccagaagactgccccccgccagagcctggctgcccggcgccctgtacgagctgagaagcgccagagcccagggcgactgcctggaggccctgggcctgaccatgcacgagctgagcctggtgagagtgcagagaagactgcagccccagcccagagccagccccagactggtggaggagctgtacctgggcgacatccacaccgaccccgccgagagaagacactacagacccaccggctaccagagacccctgcagagcgccctgcaccacgtgcagccctgccccgcctgcggcctgatcgccagaagcgacgtgcaccacccccccgtgctgcccccccccctggccctgcccctgcacctgggcggctggtgggtgagcagcggctgcgaggtgagacccgccgtgctgttcctgaccagactgttcaccttccacggccacagcagaagctgggagggctactaccaccacttcagcgaccccgcctgcagacagcccaccttcaccgtgtacgccgccggcagatacaccagaggcacccccagcaccagagtgagaggcggcaccgagctggtgttcgaggtgaccagagcccacgtgacccccatggaccaggtgaccaccgccatgctgaacttcagcgagcccagcagctgcggcggcgccggcgcctggagcatgggcaccgagagagacgtgaccgccaccaacggctgcctgcccctgggcatcagactgccccacgtggagtacgagctgttcaagatggagcaggaccccctgggccagagcctgctgttcatcggccagagacccaccgacggcagcagccccgacacccccgagaagagacccaccagctaccaggcccccctggtgctgtgccacggcgaggcccccgacttcagcagacccccccagcacagacccagcctgcagaagcaccccagcaccggcggcctgcacatcgcccccttccccctgctgcccctggtgctgggcctggccttcctgcactggctgtag

SEQ ID NO: 16258 - DNA, 1452 bp, Artificial Sequence
  Description of Artificial Sequence: Synthetic coding sequence
atgcaggagttcaccaagttccccaccaagaccggcagaagaagcctgagcagaagcatcagccagagcagcaccgacagctacagcagcgccgccagctacaccgacagcagcgacgacgaggtgagccccagagagaagcagcagaccaacagcaagggcagcagcaacttctgcgtgaagaacatcaagcaggccgagttcggcagaagagagatcgagatcgccgagcaggacatgagcgccctgatcagcctgagaaagagagcccagggcgagaagcccctggccggcgccaagatcgtgggctgcacccacatcaccgcccagaccgccgtgctgatcgagaccctgtgcgccctgggcgcccagtgcagatggagcgcctgcaacatctacagcacccagaacgaggtggccgccgccctggccgaggccggcgtggccgtgttcgcctggaagggcgagagcgaggacgacttctggtggtgcatcgacagatgcgtgaacatggacggctggcaggccaacatgatcctggacgacggcggcgacctgacccactgggtgtacaagaagtaccccaacgtgttcaagaagatcagaggcatcgtggaggagagcgtgaccggcgtgcacagactgtaccagctgagcaaggccggcaagctgtgcgtgcccgccatgaacgtgaacgacagcgtgaccaagcagaagttcgacaacctgtactgctgcagagagagcatcctggacggcctgaagagaaccaccgacgtgatgttcggcggcaagcaggtggtggtgtgcggctacggcgaggtgggcaagggctgctgcgccgccctgaaggccctgggcgccatcgtgtacatcaccgagatcgaccccatctgcgccctgcaggcctgcatggacggcttcagagtggtgaagctgaacgaggtgatcagacaggtggacgtggtgatcacctgcaccggcaacaagaacgtggtgaccagagagcacctggacagaatgaagaacagctgcatcgtgtgcaacatgggccacagcaacaccgagatcgacgtgaccagcctgagaacccccgagctgacctgggagagagtgagaagccaggtggaccacgtgatctggcccgacggcaagagagtggtgctgctggccgagggcagactgctgaacctgagctgcagcaccgtgcccaccttcgtgctgagcatcaccgccaccacccaggccctggccctgatcgagctgtacaacgcccccgagggcagatacaagcaggacgtgtacctgctgcccaagaagatggacgagtacgtggccagcctgcacctgcccagcttcgacgcccacctgaccgagctgaccgacgaccaggccaagtacctgggcctgaacaagaacggccccttcaagcccaactactacagatactag

SEQ ID NO: 16259 - DNA, 1593 bp, Artificial Sequence
  Description of Artificial Sequence: Synthetic coding sequence
atgagcatgcccgacgccatgcccctgcccggcgtgggcgaggagctgaagcaggccaaggagatcgaggacgccgagaagtacagcttcatggccaccgtgaccaaggcccccaagaagcagatccagttcgccgacgacatgcaggagttcaccaagttccccaccaagaccggcagaagaagcctgagcagaagcatcagccagagcagcaccgacagctacagcagcgccgccagctacaccgacagcagcgacgacgaggtgagccccagagagaagcagcagaccaacagcaagggcagcagcaacttctgcgtgaagaacatcaagcaggccgagttcggcagaagagagatcgagatcgccgagcaggacatgagcgccctgatcagcctgagaaagagagcccagggcgagaagcccctggccggcgccaagatcgtgggctgcacccacatcaccgcccagaccgccgtgctgatcgagaccctgtgcgccctgggcgcccagtgcagatggagcgcctgcaacatctacagcacccagaacgaggtggccgccgccctggccgaggccggcgtggccgtgttcgcctggaagggcgagagcgaggacgacttctggtggtgcatcgacagatgcgtgaacatggacggctggcaggccaacatgatcctggacgacggcggcgacctgacccactgggtgtacaagaagtaccccaacgtgttcaagaagatcagaggcatcgtggaggagagcgtgaccggcgtgcacagactgtaccagctgagcaaggccggcaagctgtgcgtgcccgccatgaacgtgaacgacagcgtgaccaagcagaagttcgacaacctgtactgctgcagagagagcatcctggacggcctgaagagaaccaccgacgtgatgttcggcggcaagcaggtggtggtgtgcggctacggcgaggtgggcaagggctgctgcgccgccctgaaggccctgggcgccatcgtgtacatcaccgagatcgaccccatctgcgccctgcaggcctgcatggacggcttcagagtggtgaagctgaacgaggtgatcagacaggtggacgtggtgatcacctgcaccggcaacaagaacgtggtgaccagagagcacctggacagaatgaagaacagctgcatcgtgtgcaacatgggccacagcaacaccgagatcgacgtgaccagcctgagaacccccgagctgacctgggagagagtgagaagccaggtggaccacgtgatctggcccgacggcaagagagtggtgctgctggccgagggcagactgctgaacctgagctgcagcaccgtgcccaccttcgtgctgagcatcaccgccaccacccaggccctggccctgatcgagctgtacaacgcccccgagggcagatacaagcaggacgtgtacctgctgcccaagaagatggacgagtacgtggccagcctgcacctgcccagcttcgacgcccacctgaccgagctgaccgacgaccaggccaagtacctgggcctgaacaagaacggccccttcaagcccaactactacagatactag

SEQ ID NO: 16260 - DNA, 1452 bp, Artificial Sequence; identical to SEQ ID NO: 16258
  Description of Artificial Sequence: Synthetic coding sequence

SEQ ID NO: 16261 - DNA, 1119 bp, Artificial Sequence
  Description of Artificial Sequence: Synthetic coding sequence
ttcgtgttcaaggcctacatgtacctgaacgagggccagaagctgctgaagaccctgaagaaggacaagagctggagccagaccttcgagagcgccaccttctacagcctgaagggcgaggtgtgcttcaacatgggccagatcgtgctggccaagaagatgctgagaaaggccctgaagctgctgaacagaatcttcccctacaacctgatcagcctgttcctgcacatccacgtggagaagaacagacacttccactacgtgaacagacaggcccaggagagccccccccccggcaagaagagactggcccagctgtacagacagaccgtgtgcctgagcctgctgtggagaatctacagctacagctacctgttccactgcaagtactacgcccacctggccgtgatgatgcagatgaacaccgccctggagacccagaactgcttccagatcatcaaggcctacctggactacagcctgtaccaccacctggccggctacaagggcgtgtggttcaagtacgaggtgatggccatggagcacatcttcaacctgcccctgaagggcgagggcatcgagatcgtggcctacgtggccgagaccctggtgttcaacaagctgatcatgggccacctggacctggccatcgagctgggcagcagagccctgcagatgtgggccctgctgcagaaccccaacagacactaccagagcctgtgcagactgagcagatgcctgctgctgaacagcagatacccccagctgatccaggtgctgggcagactgtgggagctgagcgtgacccaggagcacatcttcagcaaggccttcttctacttcgtgtgcctggacatcctgctgtacagcggcttcgtgtacagaaccttcgaggagtgcctggagttcatccaccagtacgagaacaacagaatcctgaagttccacagcggcctgctgctgggcctgtacagcagcgtggccatctgggagtgcgaggccggcgtgggcagaagactgcacaccagcagagaccccggcatgcccgacttcagaaacggcaccaccttcaccaacttccccatcgagctgaagatcttctgccaggaggagccctag

SEQ ID NO: 16262 - DNA, 4557 bp, Artificial Sequence
  Description of Artificial Sequence: Synthetic coding sequence
atgagcctgagcgagggcgacgccctgctggccctgtggagagtggagagaaagcagctgaagaacatcatcaccgtggtgatcaagtgcagcctggagatccacggcctgttcgagacccaggagtgggaggagggcctggacatcagagtgaagatcggcctggccgccggccacatcagcatgctggtgttcggcgacgagacccacagccacttcctggtgatcggccaggccgtggacgacgtgagactggcccagaacatggcccagatgaacgacgtgatcctgagccccaactgctggcagctgtgcgacagaagcatgatcgagatcgagagcgtgcccgaccagagagccgtgaaggtgaacttcctgaagcccccccccaacttcaacttcgacgagttcttcaccaagtgcaccaccttcatgcactactaccccagcggcgagcacaagaacctgctgagactggcctgcaccctgaagcccgaccccgagctggagatgagcctgcagaagtacgtgatggagagcatcctgaagcagatcgacaacaagcagctgcagggctacctgagcgagctgagacccgtgaccatcgtgttcgtgaacctgatgttcgaggaccaggacaaggccgaggagatcggccccgccatccaggacgcctacatgcacatcaccagcgtgctgaagatcttccagggccagatcaacaaggtgttcatgttcgacaagggctgcagcttcctgtgcgtgttcggcttccccggcgagaaggtgcccgacgagctgacccacgccctggagtgcgccatggacatcttcgacttctgcagccaggtgcacaagatccagaccgtgagcatcggcgtggccagcggcatcgtgttctgcggcatcgtgggccacaccgtgagacacgagtacaccgtgatcggccagaaggtgaacctggccgccagaatgatgatgtactaccccggcatcgtgacctgcgacagcgtgacctacaacggcagcaacctgcccgcctacttcttcaaggagctgcccaagaaggtgatgaagggcgtggccgacagcggccccctgtaccagtactggggcagaaccgagaaggtgatgttcggcatggcctgcctgatctgcaacagaaaggaggactaccccctgctgggcagaaacaaggagatcaactacttcatgtacaccatgaagaagttcctgatcagcaacagcagccaggtgctgatgtacgagggcctgcccggctacggcaagagccagatcctgatgaagatcgagtacctggcccagggcaagaaccacagaatcatcgccatcagcctgaacaagatcagcttccaccagaccttctacaccatccagatgttcatggccaacgtgctgggcctggacacctgcaagcactacaaggagagacagaccaacctgagaaacaaggtgatgaccctgctggacgagaagttctactgcctgctgaacgacatcttccacgtgcagttccccatcagcagagagatcagcagaatgagcaccctgaagaagcagaagcagctggagatcctgttcatgaagatcctgaagctgatcgtgaaggaggagagaatcatcttcatcatcgacgaggcccagttcgtggacagcaccagctggagattcatggagaagctgatcagaaccctgcccatcttcatcatcatgagcctgtgccccttcgtgaacatcccctgcgccgccgccagagccgtgatcaagaacagaaacaccacctacatcgtgatcggcgccgtgcagcccaacgacatcagcaacaagatctgcctggacctgaacgtgagctgcatcagcaaggagctggacagctacctgggcgagggcagctgcggcatccccttctactgcgaggagctgctgaagaacctggagcaccacgaggtgctggtgttccagcagaccgagagcgaggagaagaccaacagaacctggaacaacctgttcaagtacagcatcaagctgaccgagaagctgaacatggtgaccctgcacagcgacaaggagagcgaggaggtgtgccacctgaccagcggcgtgagactgaagaacctgagcccccccaccagcctgaaggagatcagcctgatccagctggacagcatgagactgagccaccagatgctggtgagatgcgccgccatcatcggcctgaccttcaccaccgagctgctgttcgagatcctgccctgctggaacatgaagatgatgatcaagaccctggccaccctggtggagagcaacatcttctactgcttcagaaacggcaaggagctgcagaaggccctgaagcagaacgaccccagcttcgaggtgcactacagaagcctgagcctgaagcccagcgagggcatggaccacggcgaggaggagcagctgagagagctggagaacgaggtgatcgagtgccacagaatcagattctgcaaccccatgatgcagaagaccgcctacgagctgtggctgaaggaccagagaaaggccatgcacctgaagtgcgccagattcctggaggaggacgcccacagatgcgaccactgcagaggcagagacttcatcccctaccaccacttcaccgtgaacatcagactgaacgccctggacatggacgccatcaagaagatggccatgagccacggcttcaagaccgaggagaagctgatcctgagcaacagcgagatccccgagaccagcgccttcttccccgagaacagaagccccgaggagatcagagagaagatcctgaacttcttcgaccacgtgctgaccaagatgaagaccagcgacgaggacatcatccccctggagagctgccagtgcgaggagatcctggagatcgtgatcctgcccctggcccaccacttcctggccctgggcgagaacgacaaggccctgtactacttcctggagatcgccagcgcctacctgatcttctgcgacaactacatggcctacatgtacctgaacgagggccagaagctgctgaagaccctgaagaaggacaagagctggagccagaccttcgagagcgccaccttctacagcctgaagggcgaggtgtgcttcaacatgggccagatcgtgctggccaagaagatgctgagaaaggccctgaagctgctgaacagaatcttcccctacaacctgatcagcctgttcctgcacatccacgtggagaagaacagacacttccactacgtgaacagacaggcccaggagagccccccccccggcaagaagagactggcccagctgtacagacagaccgtgtgcctgagcctgctgtggagaatctacagctacagctacctgttccactgcaagtactacgcccacctggccgtgatgatgcagatgaacaccgccctggagacccagaactgcttccagatcatcaaggcctacctggactacagcctgtaccaccacctggccggctacaagggcgtgtggttcaagtacgaggtgatggccatggagcacatcttcaacctgcccctgaagggcgagggcatcgagatcgtggcctacgtggccgagaccctggtgttcaacaagctgatcatgggccacctggacctggccatcgagctgggcagcagagccctgcagatgtgggccctgctgcagaaccccaacagacactaccagagcctgtgcagactgagcagatgcctgctgctgaacagcagatacccccagctgatccaggtgctgggcagactgtgggagctgagcgtgacccaggagcacatcttcagcaaggccttcttctacttcgtgtgcctggacatcctgctgtacagcggcttcgtgtacagaaccttcgaggagtgcctggagttcatccaccagtacgagaacaacagaatcctgaagttccacagcggcctgctgctgggcctgtacagcagcgtggccatctggtacgccagactgcaggagtgggacaacttctacaagttcagcaacagagccaagaacctgctgcccagaagaaccatgaccctgacctactacgacggcatcagcagatacatggagggccaggtgctgcacctgcagaagcagatcaaggagcagagcgagaacgcccaggccagcggcgaggagctgctgaagaacctggagaacctggtggcccagaacaccaccggccccgtgttctgccccagactgtaccacctgatggcctacgtgtgcatcctgatgggcgacggccagaagtgcggcctgttcctgaacaccgccctgagactgagcgagacccagggcaacatcctggagaagtgctggctgaacatgaacaaggagagctggtacagcaccagcgagctgaaggaggaccagtggctgcagaccatcctgagcctgcccagctgggagaagatcgtggccggcagagtgaacatccaggacctgcagaagaacaagttcctgatgagagccaacaccgtggacaaccacttctag

SEQ ID NO: 16263 - DNA, 4833 bp, Artificial Sequence
  Description of Artificial Sequence: Synthetic coding sequence
atgaacacccccaaggaggagttccaggactggcccatcgtgagaatcgccgcccacctgcccgacctgatcgtgtacggccacttcagccccgagagacccttcatggactacttcgacggcgtgctgatgttcgtggacatcagcggcttcaccgccatgaccgagaagttcagcagcgccatgtacatggacagaggcgccgagcagctggtggagatcctgaactaccacatcagcgccatcgtggagaaggtgctgatcttcggcggcgacatcctgaagttcgccggcgacgccctgctggccctgtggagagtggagagaaagcagctgaagaacatcatcaccgtggtgatcaagtgcagcctggagatccacggcctgttcgagacccaggagtgggaggagggcctggacatcagagtgaagatcggcctggccgccggccacatcagcatgctggtgttcggcgacgagacccacagccacttcctggtgatcggccaggccgtggacgacgtgagactggcccagaacatggcccagatgaacgacgtgatcctgagccccaactgctggcagctgtgcgacagaagcatgatcgagatcgagagcgtgcccgaccagagagccgtgaaggtgaacttcctgaagcccccccccaacttcaacttcgacgagttcttcaccaagtgcaccaccttcatgcactactaccccagcggcgagcacaagaacctgctgagactggcctgcaccctgaagcccgaccccgagctggagatgagcctgcagaagtacgtgatggagagcatcctgaagcagatcgacaacaagcagctgcagggctacctgagcgagctgagacccgtgaccatcgtgttcgtgaacctgatgttcgaggaccaggacaaggccgaggagatcggccccgccatccaggacgcctacatgcacatcaccagcgtgctgaagatcttccagggccagatcaacaaggtgttcatgttcgacaagggctgcagcttcctgtgcgtgttcggcttccccggcgagaaggtgcccgacgagctgacccacgccctggagtgcgccatggacatcttcgacttctgcagccaggtgcacaagatccagaccgtgagcatcggcgtggccagcggcatcgtgttctgcggcatcgtgggccacaccgtgagacacgagtacaccgtgatcggccagaaggtgaacctggccgccagaatgatgatgtactaccccggcatcgtgacctgcgacagcgtgacctacaacggcagcaacctgcccgcctacttcttcaaggagctgcccaagaaggtgatgaagggcgtggccgacagcggccccctgtaccagtactggggcagaaccgagaaggtgatgttcggcatggcctgcctgatctgcaacagaaaggaggactaccccctgctgggcagaaacaaggagatcaactacttcatgtacaccatgaagaagttcctgatcagcaacagcagccaggtgctgatgtacgagggcctgcccggctacggcaagagccagatcctgatgaagatcgagtacctggcccagggcaagaaccacagaatcatcgccatcagcctgaacaagatcagcttccaccagaccttctacaccatccagatgttcatggccaacgtgctgggcctggacacctgcaagcactacaaggagagacagaccaacctgagaaacaaggtgatgaccctgctggacgagaagttctactgcctgctgaacgacatcttccacgtgcagttccccatcagcagagagatcagcagaatgagcaccctgaagaagcagaagcagctggagatcctgttcatgaagatcctgaagctgatcgtgaaggaggagagaatcatcttcatcatcgacgaggcccagttcgtggacagcaccagctggagattcatggagaagctgatcagaaccctgcccatcttcatcatcatgagcctgtgccccttcgtgaacatcccctgcgccgccgccagagccgtgatcaagaacagaaacaccacctacatcgtgatcggcgccgtgcagcccaacgacatcagcaacaagatctgcctggacctgaacgtgagctgcatcagcaaggagctggacagctacctgggcgagggcagctgcggcatccccttctactgcgaggagctgctgaagaacctggagcaccacgaggtgctggtgttccagcagaccgagagcgaggagaagaccaacagaacctggaacaacctgttcaagtacagcatcaagctgaccgagaagctgaacatggtgaccctgcacagcgacaaggagagcgaggaggtgtgccacctgaccagcggcgtgagactgaagaacctgagcccccccaccagcctgaaggagatcagcctgatccagctggacagcatgagactgagccaccagatgctggtgagatgcgccgccatcatcggcctgaccttcaccaccgagctgctgttcgagatcctgccctgctggaacatgaagatgatgatcaagaccctggccaccctggtggagagcaacatcttctactgcttcagaaacggcaaggagctgcagaaggccctgaagcagaacgaccccagcttcgaggtgcactacagaagcctgagcctgaagcccagcgagggcatggaccacggcgaggaggagcagctgagagagctggagaacgaggtgatcgagtgccacagaatcagattctgcaaccccatgatgcagaagaccgcctacgagctgtggctgaaggaccagagaaaggccatgcacctgaagtgcgccagattcctggaggaggacgcccacagatgcgaccactgcagaggcagagacttcatcccctaccaccacttcaccgtgaacatcagactgaacgccctggacatggacgccatcaagaagatggccatgagccacggcttcaagaccgaggagaagctgatcctgagcaacagcgagatccccgagaccagcgccttcttccccgagaacagaagccccgaggagatcagagagaagatcctgaacttcttcgaccacgtgctgaccaagatgaagaccagcgacgaggacatcatccccctggagagctgccagtgcgaggagatcctggagatcgtgatcctgcccctggcccaccacttcctggccctgggcgagaacgacaaggccctgtactacttcctggagatcgccagcgcctacctgatcttctgcgacaactacatggcctacatgtacctgaacgagggccagaagctgctgaagaccctgaagaaggacaagagctggagccagaccttcgagagcgccaccttctacagcctgaagggcgaggtgtgcttcaacatgggccagatcgtgctggccaagaagatgctgagaaaggccctgaagctgctgaacagaatcttcccctacaacctgatcagcctgttcctgcacatccacgtggagaagaacagacacttccactacgtgaacagacaggcccaggagagccccccccccggcaagaagagactggcccagctgtacagacagaccgtgtgcctgagcctgctgtggagaatctacagctacagctacctgttccactgcaagtactacgcccacctggccgtgatgatgcagatgaacaccgccctggagacccagaactgcttccagatcatcaaggcctacctggactacagcctgtaccaccacctggccggctacaagggcgtgtggttcaagtacgaggtgatggccatggagcacatcttcaacctgcccctgaagggcgagggcatcgagatcgtggcctacgtggccgagaccctggtgttcaacaagctgatcatgggccacctggacctggccatcgagctgggcagcagagccctgcagatgtgggccctgctgcagaaccccaacagacactaccagagcctgtgcagactgagcagatgcctgctgctgaacagcagatacccccagctgatccaggtgctgggcagactgtgggagctgagcgtgacccaggagcacatcttcagcaaggccttcttctacttcgtgtgcctggacatcctgctgtacagcggcttcgtgtacagaaccttcgaggagtgcctggagttcatccaccagtacgagaacaacagaatcctgaagttccacagcggcctgctgctgggcctgtacagcagcgtggccatctggtacgccagactgcaggagtgggacaacttctacaagttcagcaacagagccaagaacctgctgcccagaagaaccatgaccctgacctactacgacggcatcagcagatacatggagggccaggtgctgcacctgcagaagcagatcaaggagcagagcgagaacgcccaggccagcggcgaggagctgctgaagaacctggagaacctggtggcccagaacaccaccggccccgtgttctgccccagactgtaccacctgatggcctacgtgtgcatcctgatgggcgacggccagaagtgcggcctgttcctgaacaccgccctgagactgagcgagacccagggcaacatcctggagaagtgctggctgaacatgaacaaggagagctggtacagcaccagcgagctgaaggaggaccagtggctgcagaccatcctgagcctgcccagctgggagaagatcgtggccggcagagtgaacatccaggacctgcagaagaacaagttcctgatgagagccaacaccgtggacaaccacttctag

SEQ ID NO: 16264 - DNA, 4374 bp, Artificial Sequence
  Description of Artificial Sequence: Synthetic coding sequence
atgctggtgttcggcgacgagacccacagccacttcctggtgatcggccaggccgtggacgacgtgagactggcccagaacatggcccagatgaacgacgtgatcctgagccccaactgctggcagctgtgcgacagaagcatgatcgagatcgagagcgtgcccgaccagagagccgtgaaggtgaacttcctgaagcccccccccaacttcaacttcgacgagttcttcaccaagtgcaccaccttcatgcactactaccccagcggcgagcacaagaacctgctgagactggcctgcaccctgaagcccgaccccgagctggagatgagcctgcagaagtacgtgatggagagcatcctgaagcagatcgacaacaagcagctgcagggctacctgagcgagctgagacccgtgaccatcgtgttcgtgaacctgatgttcgaggaccaggacaaggccgaggagatcggccccgccatccaggacgcctacatgcacatcaccagcgtgctgaagatcttccagggccagatcaacaaggtgttcatgttcgacaagggctgcagcttcctgtgcgtgttcggcttccccggcgagaaggtgcccgacgagctgacccacgccctggagtgcgccatggacatcttcgacttctgcagccaggtgcacaagatccagaccgtgagcatcggcgtggccagcggcatcgtgttctgcggcatcgtgggccacaccgtgagacacgagtacaccgtgatcggccagaaggtgaacctggccgccagaatgatgatgtactaccccggcatcgtgacctgcgacagcgtgacctacaacggcagcaacctgcccgcctacttcttcaaggagctgcccaagaaggtgatgaagggcgtggccgacagcggccccctgtaccagtactggggcagaaccgagaaggtgatgttcggcatggcctgcctgatctgcaacagaaaggaggactaccccctgctgggcagaaacaaggagatcaactacttcatgtacaccatgaagaagttcctgatcagcaacagcagccaggtgctgatgtacgagggcctgcccggctacggcaagagccagatcctgatgaagatcgagtacctggcccagggcaagaaccacagaatcatcgccatcagcctgaacaagatcagcttccaccagaccttctacaccatccagatgttcatggccaacgtgctgggcctggacacctgcaagcactacaaggagagacagaccaacctgagaaacaaggtgatgaccctgctggacgagaagttctactgcctgctgaacgacatcttccacgtgcagttccccatcagcagagagatcagcagaatgagcaccctgaagaagcagaagcagctggagatcctgttcatgaagatcctgaagctgatcgtgaaggaggagagaatcatcttcatcatcgacgaggcccagttcgtggacagcaccagctggagattcatggagaagctgatcagaaccctgcccatcttcatcatcatgagcctgtgccccttcgtgaacatcccctgcgccgccgccagagccgtgatcaagaacagaaacaccacctacatcgtgatcggcgccgtgcagcccaacgacatcagcaacaagatctgcctggacctgaacgtgagctgcatcagcaaggagctggacagctacctgggcgagggcagctgcggcatccccttctactgcgaggagctgctgaagaacctggagcaccacgaggtgctggtgttccagcagaccgagagcgaggagaagaccaacagaacctggaacaacctgttcaagtacagcatcaagctgaccgagaagctgaacatggtgaccctgcacagcgacaaggagagcgaggaggtgtgccacctgaccagcggcgtgagactgaagaacctgagcccccccaccagcctgaaggagatcagcctgatccagctggacagcatgagactgagccaccagatgctggtgagatgcgccgccatcatcggcctgaccttcaccaccgagctgctgttcgagatcctgccctgctggaacatgaagatgatgatcaagaccctggccaccctggtggagagcaacatcttctactgcttcagaaacggcaaggagctgcagaaggccctgaagcagaacgaccccagcttcgaggtgcactacagaagcctgagcctgaagcccagcgagggcatggaccacggcgaggaggagcagctgagagagctggagaacgaggtgatcgagtgccacagaatcagattctgcaaccccatgatgcagaagaccgcctacgagctgtggctgaaggaccagagaaaggccatgcacctgaagtgcgccagattcctggaggaggacgcccacagatgcgaccactgcagaggcagagacttcatcccctaccaccacttcaccgtgaacatcagactgaacgccctggacatggacgccatcaagaagatggccatgagccacggcttcaagaccgaggagaagctgatcctgagcaacagcgagatccccgagaccagcgccttcttccccgagaacagaagccccgaggagatcagagagaagatcctgaacttcttcgaccacgtgctgaccaagatgaagaccagcgacgaggacatcatccccctggagagctgccagtgcgaggagatcctggagatcgtgatcctgcccctggcccaccacttcctggccctgggcgagaacgacaaggccctgtactacttcctggagatcgccagcgcctacctgatcttctgcgacaactacatggcctacatgtacctgaacgagggccagaagctgctgaagaccctgaagaaggacaagagctggagccagaccttcgagagcgccaccttctacagcctgaagggcgaggtgtgcttcaacatgggccagatcgtgctggccaagaagatgctgagaaaggccctgaagctgctgaacagaatcttcccctacaacctgatcagcctgttcctgcacatccacgtggagaagaacagacacttccactacgtgaacagacaggcccaggagagccccccccccggcaagaagagactggcccagctgtacagacagaccgtgtgcctgagcctgctgtggagaatctacagctacagctacctgttccactgcaagtactacgcccacctggccgtgatgatgcagatgaacaccgccctggagacccagaactgcttccagatcatcaaggcctacctggactacagcctgtaccaccacctggccggctacaagggcgtgtggttcaagtacgaggtgatggccatggagcacatcttcaacctgcccctgaagggcgagggcatcgagatcgtggcctacgtggccgagaccctggtgttcaacaagctgatcatgggccacctggacctggccatcgagctgggcagcagagccctgcagatgtgggccctgctgcagaaccccaacagacactaccagagcctgtgcagactgagcagatgcctgctgctgaacagcagatacccccagctgatccaggtgctgggcagactgtgggagctgagcgtgacccaggagcacatcttcagcaaggccttcttctacttcgtgtgcctggacatcctgctgtacagcggcttcgtgtacagaaccttcgaggagtgcctggagttcatccaccagtacgagaacaacagaatcctgaagttccacagcggcctgctgctgggcctgtacagcagcgtggccatctggtacgccagactgcaggagtgggacaacttctacaagttcagcaacagagccaagaacctgctgcccagaagaaccatgaccctgacctactacgacggcatcagcagatacatggagggccaggtgctgcacctgcagaagcagatcaaggagcagagcgagaacgcccaggccagcggcgaggagctgctgaagaacctggagaacctggtggcccagaacaccaccggccccgtgttctgccccagactgtaccacctgatggcctacgtgtgcatcctgatgggcgacggccagaagtgcggcctgttcctgaacaccgccctgagactgagcgagacccagggcaacatcctggagaagtgctggctgaacatgaacaaggagagctggtacagcaccagcgagctgaaggaggaccagtggctgcagaccatcctgagcctgcccagctgggagaagatcgtggccggcagagtgaacatccaggacctgcagaagaacaagttcctgatgagagccaacaccgtggacaaccacttctag

SEQ ID NO: 16265 - DNA, 672 bp, Artificial Sequence
  Description of Artificial Sequence: Synthetic coding sequence
atggccagcaagctgctgagagccgtgatcctgggcccccccggcagcggcaagggcaccgtgtgccagagaatcgcccagaacttcggcctgcagcacctgagcagcggccacttcctgagagagaacatcaaggccagcaccgaggtgggcgagatggccaagcagtacatcgagaagagcctgctggtgcccgaccacgtgatcaccagactgatgatgagcgagctggagaacagaagaggccagcactggctgctggacggcttccccagaaccctgggccaggccgaggccctggacaagatctgcgaggtggacctggtgatcagcctgaacatccccttcgagaccctgaaggacagactgagcagaagatggatccacccccccagcggcagagtgtacaacctggacttcaaccccccccacgtgcacggcatcgacgacgtgaccggcgagcccctggtgcagcaggaggacgacaagcccgaggccgtggccgccagactgagacagtacaaggacgtggccaagcccgtgatcgagctgtacaagagcagaggcgtgctgcaccagttcagcggcaccgagaccaacaagatctggccctacgtgtacaccctgttcagcaacaagatcacccccatccagagcaaggaggcctactag

SEQ ID NO: 16266 - DNA, 672 bp, Artificial Sequence; identical to SEQ ID NO: 16265
  Description of Artificial Sequence: Synthetic coding sequence

SEQ ID NO: 16267 - DNA, 672 bp, Artificial Sequence; identical to SEQ ID NO: 16265
  Description of Artificial Sequence: Synthetic coding sequence

SEQ ID NO: 16268 - DNA, 1482 bp, Artificial Sequence
  Description of Artificial Sequence: Synthetic coding sequence
atgcacccccacagagaccccagaggcctgtggctgctgctgcccagcctgagcctgctgctgttcgaggtggccagagccggcagagccgtggtgagctgccccgccgcctgcctgtgcgccagcaacatcctgagctgcagcaagcagcagctgcccaacgtgccccacagcctgcccagctacaccgccctgctggacctgagccacaacaacctgagcagactgagagccgagtggacccccaccagactgacccagctgcacagcctgctgctgagccacaaccacctgaacttcatcagcagcgaggccttcagccccgtgcccaacctgagatacctggacctgagcagcaaccagctgagaaccctggacgagttcctgttcagcgacctgcaggtgctggaggtgctgctgctgtacaacaaccacatcatggccgtggacagatgcgccttcgacgacatggcccagctgcagaagctgtacctgagccagaaccagatcagcagattccccctggagctggtgaaggagggcgccaagctgcccaagctgaccctgctggacctgagcagcaacaagctgaagaacctgcccctgcccgacctgcagaagctgcccgcctggatcaagaacggcctgtacctgcacaacaaccccctgaactgcgactgcgagctgtaccagctgttcagccactggcagtacagacagctgagcagcgtgatggacttccaggaggacctgtactgcatgaacagcaagaagctgcacaacgtgttcaacctgagcttcctgaactgcggcgagtacaaggagagagcctgggaggcccacctgggcgacaccctgatcatcaagtgcgacaccaagcagcagggcatgaccaaggtgtgggtgacccccagcaacgagagagtgctggacgaggtgaccaacggcaccgtgagcgtgagcaaggacggcagcctgctgttccagcaggtgcaggtggaggacggcggcgtgtacacctgctacgccatgggcgagaccttcaacgagaccctgagcgtggagctgaaggtgcacaacttcaccctgcacggccaccacgacaccctgaacaccgcctacaccaccctggtgggctgcatcctgagcgtggtgctggtgctgatctacctgtacctgaccccctgcagatgctggtgcagaggcgtggagaagcccagcagccaccagggcgacagcctgagcagcagcatgctgagcaccacccccaaccacgaccccatggccggcggcgacaaggacgacggcttcgacagaagagtggccttcctggagcccgccggccccggccagggccagaacggcaagctgaagcccggcaacaccctgcccgtgcccgaggccaccggcaagggccagagaagaatgagcgaccccgagagcgtgagcagcgtgttcagcgacacccccatcgtggtgtag

SEQ ID NO: 16269 - DNA, 1482 bp, Artificial Sequence; identical to SEQ ID NO: 16268
  Description of Artificial Sequence: Synthetic coding sequence

SEQ ID NO: 16270 - DNA, 1569 bp, Artificial Sequence
  Description of Artificial Sequence: Synthetic coding sequence
atgagcctgagagtgcacaccctgcccaccctgctgggcgccgtggtgagacccggctgcagagagctgctgtgcctgctgatgatcaccgtgaccgtgggccccggcgccagcggcgtgtgccccaccgcctgcatctgcgccaccgacatcgtgagctgcaccaacaagaacctgagcaaggtgcccggcaacctgttcagactgatcaagagactggacctgagctacaacagaatcggcctgctggacagcgagtggatccccgtgagcttcgccaagctgaacaccctgatcctgagacacaacaacatcaccagcatcagcaccggcagcttcagcaccacccccaacctgaagtgcctggacctgagcagcaacaagctgaagaccgtgaagaacgccgtgttccaggagctgaaggtgctggaggtgctgctgctgtacaacaaccacatcagctacctggaccccagcgccttcggcggcctgagccagctgcagaagctgtacctgagcggcaacttcctgacccagttccccatggacctgtacgtgggcagattcaagctggccgagctgatgttcctggacgtgagctacaacagaatccccagcatgcccatgcaccacatcaacctggtgcccggcaagcagctgagaggcatctacctgcacggcaaccccttcgtgtgcgactgcagcctgtacagcctgctggtgttctggtacagaagacacttcagcagcgtgatggacttcaagaacgactacacctgcagactgtggagcgacagcagacacagcagacaggtgctgctgctgcaggacagcttcatgaactgcagcgacagcatcatcaacggcagcttcagagccctgggcttcatccacgaggcccaggtgggcgagagactgatggtgcactgcgacagcaagaccggcaacgccaacaccgacttcatctgggtgggccccgacaacagactgctggagcccgacaaggagatggagaacttctacgtgttccacaacggcagcctggtgatcgagagccccagattcgaggacgccggcgtgtacagctgcatcgccatgaacaagcagagactgctgaacgagaccgtggacgtgaccatcaacgtgagcaacttcaccgtgagcagaagccacgcccacgaggccttcaacaccgccttcaccaccctggccgcctgcgtggccagcatcgtgctggtgctgctgtacctgtacctgaccccctgcccctgcaagtgcaagaccaagagacagaagaacatgctgcaccagagcaacgcccacagcagcatcctgagccccggccccgccagcgacgccagcgccgacgagagaaaggccggcgccggcaagagagtggtgttcctggagcccctgaaggacaccgccgccggccagaacggcaaggtgagactgttccccagcgaggccgtgatcgccgagggcatcctgaagagcaccagaggcaagagcgacagcgacagcgtgaacagcgtgttcagcgacacccccttcgtggccagcacctag

SEQ ID NO: 16271 - DNA, 1569 bp, Artificial Sequence; identical to SEQ ID NO: 16270
  Description of Artificial Sequence: Synthetic coding sequence

SEQ ID NO: 16272 - DNA, 1569 bp, Artificial Sequence; identical to SEQ ID NO: 16270
  Description of Artificial Sequence: Synthetic coding sequence

SEQ ID NO: 16273 - DNA, 1569 bp, Artificial Sequence; identical to SEQ ID NO: 16270
  Description of Artificial Sequence: Synthetic coding sequence

SEQ ID NO: 16274 - DNA, 1515 bp, Artificial Sequence
  Description of Artificial Sequence: Synthetic coding sequence
atgacctggctggtgctgctgggcaccctgctgtgcatgctgagagtgggcctgggcacccccgacagcgagggcttcccccccagagccctgcacaactgcccctacaagtgcatctgcgccgccgacctgctgagctgcaccggcctgggcctgcaggacgtgcccgccgagctgcccgccgccaccgccgacctggacctgagccacaacgccctgcagagactgagacccggctggctggcccccctgttccagctgagagccctgcacctggaccacaacgagctggacgccctgggcagaggcgtgttcgtgaacgccagcggcctgagactgctggacctgagcagcaacaccctgagagccctgggcagacacgacctggacggcctgggcgccctggagaagctgctgctgttcaacaacagactggtgcacctggacgagcacgccttccacggcctgagagccctgagccacctgtacctgggctgcaacgagctggccagcttcagcttcgaccacctgcacggcctgagcgccacccacctgctgaccctggacctgagcagcaacagactgggccacatcagcgtgcccgagctggccgccctgcccgccttcctgaagaacggcctgtacctgcacaacaaccccctgccctgcgactgcagactgtaccacctgctgcagagatggcaccagagaggcctgagcgccgtgagagacttcgccagagagtacgtgtgcctggccttcaaggtgcccgccagcagagtgagattcttccagcacagcagagtgttcgagaactgcagcagcgcccccgccctgggcctggagagacccgaggagcacctgtacgccctggtgggcagaagcctgagactgtactgcaacaccagcgtgcccgccatgagaatcgcctgggtgagcccccagcaggagctgctgagagcccccggcagcagagacggcagcatcgccgtgctggccgacggcagcctggccatcggcaacgtgcaggagcagcacgccggcctgttcgtgtgcctggccaccggccccagactgcaccacaaccagacccacgagtacaacgtgagcgtgcacttccccagacccgagcccgaggccttcaacaccggcttcaccaccctgctgggctgcgccgtgggcctggtgctggtgctgctgtacctgttcgcccccccctgcagatgctgcagaagagcctgcagatgcagaagatggccccagacccccagccccctgcaggagctgagcgcccagagcagcgtgctgagcaccaccccccccgacgcccccagcagaaaggccagcgtgcacaagcacgtggtgttcctggagcccggcagaagaggcctgaacggcagagtgcagctggccgtggccgaggagttcgacctgtacaaccccggcggcctgcagctgaaggccggcagcgagagcgccagcagcatcggcagcgagggccccatgaccacctag

SEQ ID NO: 16275 - DNA, 1515 bp, Artificial Sequence; identical to SEQ ID NO: 16274
  Description of Artificial Sequence: Synthetic coding sequence

SEQ ID NO: 16276 - DNA, 1224 bp, Artificial Sequence
  Description of Artificial Sequence: Synthetic coding sequence
atgaccaccagcggcgccctgttccccagcctggtgcccggcagcagaggcgccagcaacaagtacctggtggagttcagagccggcaagatgagcctgaagggcaccaccgtgacccccgacaagagaaagggcctggtgtacatccagcagaccgacgacagcctgatccacttctgctggaaggacagaaccagcggcaacgtggaggacgacctgatcatcttccccgacgactgcgagttcaagagagtgccccagtgccccagcggcagagtgtacgtgctgaagttcaaggccggcagcaagagactgttcttctggatgcaggagcccaagaccgaccaggacgaggagcactgcagaaaggtgaacgagtacctgaacaacccccccatgcccggcgccctgggcgccagcggcagcagcggccacgagctgagcgccctgggcggcgagggcggcctgcagagcctgctgggcaacatgagccacagccagctgatgcagctgatcggccccgccggcctgggcggcctgggcggcctgggcgccctgaccggccccggcctggccagcctgctgggcagcagcggcccccccggcagcagcagcagcagcagcagcagaagccagagcgccgccgtgacccccagcagcaccaccagcagcaccagagccacccccgcccccagcgcccccgccgccgccagcgccaccagccccagccccgcccccagcagcggcaacggcgccagcaccgccgccagccccacccagcccatccagctgagcgacctgcagagcatcctggccaccatgaacgtgcccgccggccccgccggcggccagcaggtggacctggccagcgtgctgacccccgagatcatggcccccatcctggccaacgccgacgtgcaggagagactgctgccctacctgcccagcggcgagagcctgccccagaccgccgacgagatccagaacaccctgaccagcccccagttccagcaggccctgggcatgttcagcgccgccctggccagcggccagctgggccccctgatgtgccagttcggcctgcccgccgaggccgtggaggccgccaacaagggcgacgtggaggccttcgccaaggccatgcagaacaacgccaagcccgagcagaaggagggcgacaccaaggacaagaaggacgaggaggaggacatgagcctggactag

SEQ ID NO: 16277 - DNA, 954 bp, Artificial Sequence
  Description of Artificial Sequence: Synthetic coding sequence
atgaccaccagcggcgccctgttccccagcctggtgcccggcagcagaggcgccagcaacaagtacctggtggagttcagagccggcaagatgagcctgaagggcaccaccgtgacccccgacaagagaaagggcctggtgtacatccagcagaccgacgacagcctgatccacttctgctggaaggacagaaccagcggcaacgtggaggacgacctgatcatcttccccgacgactgcgagttcaagagagtgccccagtgccccagcggcagagtgtacgtgctgaagttcaaggccggcagcaagagactgttcttctggatgcaggagcccaagaccgaccaggacgaggagcactgcagaaaggtgaacgagtacctgaacaacccccccatgcccggcgccctgggcgccagcggcagcagcggccacgagctgagcgccctgggcgccggcggcctgggcgccctgaccggccccggcctggccagcctgctgggcagcagcggcccccccggcagcagcagcagcagcagcggcgccctgagcctgagaagcagcagaagccagagcgccgccgtgacccccagcagcaccaccagcagcaccagagccacccccgcccccagcgcccccgccgccgccagcgccaccagccccagccccgcccccagcagcggcaacggcgccagcaccgccgccagccccacccagcccatccagctgagcgacctgcagagcatcctggccaccatgaacgtgcccgccggccccgccggcggccagcaggtggacctggccagcgtgctgacccccgagatcatggcccccatcctggccaacgccgacgtgcaggagagactgctgccctacctgcccagcggcgagagcctgccccagaccgccgacgagatccagaacaccctgaccagcccccagttccagcagtag

SEQ ID NO: 16278 - DNA, 243 bp, Artificial Sequence
  Description of Artificial Sequence: Synthetic coding sequence
atgaagtaccccctgatgcccctggtgaacgacctgaccttcagcttcctggtgttctggttctgcctgcccgtgggcctgctgctgctgctgatcatctggctgagattcctgctgagccaggacagcgaggagaacgacagcagcgtgtgcctggactgggagccctggagcaagggccccgccgagttctgctggaagggcaccctgcacggccaggagaaggagagaccctgctggtag

SEQ ID NO: 16279 - DNA, 579 bp, Artificial Sequence
  Description of Artificial Sequence: Synthetic coding sequence
atgcccctggtgaacgacctgaccttcagcttcctggtgttctggttctgcctgcccgtgggcctgctgctgctgctgatcatctggctgagattcctgctgagccaggacagcgaggagaacgacagcagcgtgtgcctggactgggagccctggagcaagggccccgccgagttctgctggaagggcaccctgcacggccaggagaaggagagaccctgctgcctggtgttcctggagagcgccggccagtggcagtggcagaagtggatgggcgagacctgccagggcggcaagagaaccctggccaccgtggtgcccccctggaacccccagctgatcagcagcagcgacagacacgtgaaggccagcagaggccccagccccagccccgccagccagatgaccagcagccccgccggcagcagaagcagcctgggcggccacggcagcagcgagcaggcccacggcgagaagctggccaacctgatccagagaggcctgaaggccggcctgggcagaagagtgtgggtgcacatcaaggaggccagagtgttcccctaccccggcgacccctag

SEQ ID NO: 16280 - DNA, 1026 bp, Artificial Sequence
  Description of Artificial Sequence: Synthetic coding sequence
atgaccgacggcatcctgggcaaggccgccaccatggagatccccatccacggcaacggcgaggccagacagctgcccgaggacgacggcctggagcaggacctgcagcaggtgatggtgagcggccccaacctgaacgagaccagcatcgtgagcggcggctacggcggcagcggcgacggcctgatccccaccggcagcggcagacaccccagccacagcaccacccccagcggccccggcgacgaggtggccagaggcatcgccggcgagaagttcgacatcgtgaagaagtggggcatcaacacctacaagtgcaccaagcagctgctgagcgagagattcggcagaggcagcagaaccgtggacctggagctggagctgcagatcgagctgctgagagagaccaagagaaagtacgagagcgtgctgcagctgggcagagccctgaccgcccacctgtacagcctgctgcagacccagcacgccctgggcgacgccttcgccgacctgagccagaagagccccgagctgcaggaggagttcggctacaacgccgagacccagaagctgctgtgcaagaacggcgagaccctgctgggcgccgtgaacttcttcgtgagcagcatcaacaccctggtgaccaagaccatggaggacaccctgatgaccgtgaagcagtacgaggccgccagactggagtacgacgcctacagaaccgacctggaggagctgagcctgggccccagagacgccggcaccagaggcagactggagagcgcccaggccaccttccaggcccacagagacaagtacgagaagctgagaggcgacgtggccatcaagctgaagttcctggaggagaacaagatcaaggtgatgcacaagcagctgctgctgttccacaacgccgtgagcgcctacttcgccggcaaccagaagcagctggagcagaccctgcagcagttcaacatcaagctgagaccccccggcgccgagaagcccagctggctggaggagcagtag

SEQ ID NO: 16281 - DNA, 1026 bp, Artificial Sequence; identical to SEQ ID NO: 16280
  Description of Artificial Sequence: Synthetic coding sequence

SEQ ID NO: 16282 - DNA, 912 bp, Artificial Sequence
  Description of Artificial Sequence: Synthetic coding sequence
atggtgagcggccccaacctgaacgagaccagcatcgtgagcggcggctacggcggcagcggcgacggcctgatccccaccggcagcggcagacaccccagccacagcaccacccccagcggccccggcgacgaggtggccagaggcatcgccggcgagaagttcgacatcgtgaagaagtggggcatcaacacctacaagtgcaccaagcagctgctgagcgagagattcggcagaggcagcagaaccgtggacctggagctggagctgcagatcgagctgctgagagagaccaagagaaagtacgagagcgtgctgcagctgggcagagccctgaccgcccacctgtacagcctgctgcagacccagcacgccctgggcgacgccttcgccgacctgagccagaagagccccgagctgcaggaggagttcggctacaacgccgagacccagaagctgctgtgcaagaacggcgagaccctgctgggcgccgtgaacttcttcgtgagcagcatcaacaccctggtgaccaagaccatggaggacaccctgatgaccgtgaagcagtacgaggccgccagactggagtacgacgcctacagaaccgacctggaggagctgagcctgggccccagagacgccggcaccagaggcagactggagagcgcccaggccaccttccaggcccacagagacaagtacgagaagctgagaggcgacgtggccatcaagctgaagttcctggaggagaacaagatcaaggtgatgcacaagcagctgctgctgttccacaacgccgtgagcgcctacttcgccggcaaccagaagcagctggagcagaccctgcagcagttcaacatcaagctgagaccccccggcgccgagaagcccagctggctggaggagcagtag

SEQ ID NO: 16283 - DNA, 771 bp, Artificial Sequence
  Description of Artificial Sequence: Synthetic coding sequence
atgaagcccgccctgtgcctggtggccatgggcgccctggtgatggacagcagcccccagtgcaccaagcagctgctgagcgagagattcggcagaggcagcagaaccgtggacctggagctggagctgcagatcgagctgctgagagagaccaagagaaagtacgagagcgtgctgcagctgggcagagccctgaccgcccacctgtacagcctgctgcagacccagcacgccctgggcgacgccttcgccgacctgagccagaagagccccgagctgcaggaggagttcggctacaacgccgagacccagaagctgctgtgcaagaacggcgagaccctgctgggcgccgtgaacttcttcgtgagcagcatcaacaccctggtgaccaagaccatggaggacaccctgatgaccgtgaagcagtacgaggccgccagactggagtacgacgcctacagaaccgacctggaggagctgagcctgggccccagagacgccggcaccagaggcagactggagagcgcccaggccaccttccaggcccacagagacaagtacgagaagctgagaggcgacgtggccatcaagctgaagttcctggaggagaacaagatcaaggtgatgcacaagcagctgctgctgttccacaacgccgtgagcgcctacttcgccggcaaccagaagcagctggagcagaccctgcagcagttcaacatcaagctgagaccccccggcgccgagaagcccagctggctggaggagcagtag

SEQ ID NO: 16284 - DNA, 378 bp, Artificial Sequence
  Description of Artificial Sequence: Synthetic coding sequence
atgggcaacatcttcgagaagctgttcaagagcctgctgggcaagaagaagatgagaatcctgatcctgagcctggacaccgccggcaagaccaccatcctgtacaagctgaagctgggcgagaccgtgcccgccgtgcccaccgtgggcttctgcgtggagaccgtggagtacaagaacaacaccttcgccgtgtgggacgtgggcagccacttcaagatcagacccctgtggcagcacttcttccagaacaccaaggagctgagcgccagccagttcgcccagttcatcaagaagctgtgcggcgtgaccggcaccaacgacgaggccagccccggcagcctgaccagctaccccagccacctgctggacagatag

SEQ ID NO: 16285 - DNA, 534 bp, Artificial Sequence
  Description of Artificial Sequence: Synthetic coding sequence
atgggcaacatcttcgagaagctgttcaagagcctgctgggcaagaagaagatgagaatcctgatcctgagcctggacaccgccggcaagaccaccatcctgtacaagctgaagctgggcgagaccgtgcccgccgtgcccaccgtgggcttctgcgtggagaccgtggagtacaagaacaacaccttcgccgtgtgggacgtgggcagccacttcaagatcagacccctgtggcagcacttcttccagaacaccaagggcgccagaagccccggcagcacccaccagggcagcctggccagcggcgtgctgcccatcaagtgcagccacgtggagttcggcatgtggaagggcggcagaagccaccccttcctgccccacagcagcagatgcgccggcagcggcggccagctggacagcatcctgccccaccagagccccgcctggggcccctggggctgcaaggacctgagcagcggcttccccagcttcctgaccagcagcatcctgtggaagagcgccgtggtgaagtag

SEQ ID NO: 16286 - DNA, 612 bp, Artificial Sequence
  Description of Artificial Sequence: Synthetic coding sequence
atgggcaacatcttcgagaagctgttcaagagcctgctgggcaagaagaagatgagaatcctgatcctgagcctggacaccgccggcaagaccaccatcctgtacaagctgaagctgggcgagaccgtgcccgccgtgcccaccgtgggcttctgcgtggagaccgtggagtacaagaacaacaccttcgccgtgtgggacgtgggcagccacttcaagatcagacccctgtggcagcacttcttccagaacaccaagggcgccagaagccccggcagcacccaccagggcagcctggccagcggcgtgctgcccatcaagtgcagccacgtggagttcggcatgtggaagggcggcagaagccaccccttcctgccccacagcagcagatgcgccggcagcggcggccagctggacagcatcctgccccaccagagccccgcctggggcccctggggctgcaaggacctgagcagcggcttccccagcttcctgaccagcagcatcctgtggaagagcgccgtgagctaccagctgcccagcctgcacaacagcagcagaaactacgccggcagccccgcccagatgatgagacacctgctggaggcctag

SEQ ID NO: 16287 - DNA, 393 bp, Artificial Sequence
  Description of Artificial Sequence: Synthetic coding sequence
ggcgccagaagccccggcagcacccaccagggcagcctggccagcggcgtgctgcccatcaagtgcagccacgtggagttcggcatgtggaagggcggcagaagccaccccttcctgccccacagcagcagatgcgccggcagcggcggccagctggacagcatcctgccccaccagagccccgcctggggcccctggggctgcaaggacctgagcagcggcttccccagcttcctgaccagcagcatcctgtggaagagcgccgtggtgagagagccccacatcagcccccaccaggcccccccctacaagaccagcgactgcatcaccgccatcagcttccccgtgtgcaccatccaccaggagatcatgagaggccacagacacaagtag

SEQ ID NO: 16288 - DNA, 378 bp, Artificial Sequence; identical to SEQ ID NO: 16284
  Description of Artificial Sequence: Synthetic coding sequence

SEQ ID NO: 16289 - DNA, 378 bp, Artificial Sequence; identical to SEQ ID NO: 16284
  Description of Artificial Sequence: Synthetic coding sequence

SEQ ID NO: 16290 - DNA, 393 bp, Artificial Sequence
  Description of Artificial Sequence: Synthetic coding sequence
ggcgccagaagccccggcagcacccaccagggcagcctggccagcggcgtgctgcccatcaagtgcagccacgtggagttcggcatgtggaagggcggcagaagccaccccttcctgccccacagcagcagatgcgccggcagcggcggccagctggacagcatcctgccccaccagagccccgcctggggcccctggggctgcaaggacctgagcagcggcttccccagcttcctgaccagcagcatcctgtggaagagcgccgtggtgagagagccccacatcagcccccaccaggcccccccctacaagaccagcgactgcatcaccgccatcagcttccccgtgtgcaccatccaccaggagatcatgagaggccactggcacaagtag

SEQ ID NO: 16291 - DNA, 534 bp, Artificial Sequence; identical to SEQ ID NO: 16285
  Description of Artificial Sequence: Synthetic coding sequence

SEQ ID NO: 16292 - DNA, 612 bp, Artificial Sequence
  Description of Artificial Sequence: Synthetic coding sequence
atgggcaacatcttcgagaagctgttcaagagcctgctgggcaagaagaagatgagaatcctgatcctgagcctggacaccgccggcaagaccaccatcctgtacaagctgaagctgggcgagaccgtgcccgccgtgcccaccgtgggcttctgcgtggagaccgtggagtacaagaacaacaccttcgccgtgtgggacgtgggcagccacttcaagatcagacccctgtggcagcacttcttccagaacaccaagggcgccagaagccccggcagcacccaccagggcagcctggccagcggcgtgctgcccatcaagtgcagccacgtggagttcggcatgtggaagggcggcagaagccaccccttcctgccccacagcagcagatgcgccggcagcggcggccagctggacagcatcctgccccaccagagccccgcctggggcccctggggctgcaaggacctgagcagcggcttccccagcttcctgaccagcagcatcctgtggaagagcgccgtgagctaccagctgcccagcctgcacaacagcagcagaaactacgccggcagcctggcccagatgatgagacacctgctggaggcctag

SEQ ID NO: 16293 - DNA, 378 bp, Artificial Sequence; identical to SEQ ID NO: 16284
  Description of Artificial Sequence: Synthetic coding sequence

SEQ ID NO: 16294 - DNA, 534 bp, Artificial Sequence; identical to SEQ ID NO: 16285
  Description of Artificial Sequence: Synthetic coding sequence

SEQ ID NO: 16295 - DNA, 330 bp, Artificial Sequence
  Description of Artificial Sequence: Synthetic coding sequence
gccagaagccccggcagcacccaccagggcagcctggccagcggcgtgctgcccatcaagtgcagccacgtggagttcggcatgtggaagggcggcagaagccaccccttcctgccccacagcagcagatgcgccggcagcggcggccagctggacagcatcctgccccaccagagccccgcctggggcccctggggctgcaaggacctgagcagcggcttccccagcttcctgaccagcagcatcctgtggaagagcgccgtggtgagagagccccacatcagcccccaccaggcccccccctacaagaccagcgactgcatcacctag

SEQ ID NO: 16296 - DNA, 603 bp, Artificial Sequence
  Description of Artificial Sequence: Synthetic coding sequence
atgggcaacggcctgagcgaccagaccagcatcctgagcaacctgcccagcttccagagcttccacatcgtgatcctgggcctggactgcgccggcaagaccaccgtgctgtacagactgcagttcaacgagttcgtgaacaccgtgcccaccaagggcttcaacaccgagaagatcaaggtgaccctgggcaacagcaagaccgtgaccttccacttctgggacgtgggcggccaggagaagctgagacccctgtggaagagctacaccagatgcaccgacggcatcgtgttcgtggtggacagcgtggacgtggagagaatggaggaggccaagaccgagctgcacaagatcaccagaatcagcgagaaccagggcgtgcccgtgctgatcgtggccaacaagcaggacctgagaaacagcctgagcctgagcgagatcgagaagctgctggccatgggcgagctgagcagcagcaccccctggcacctgcagcccacctgcgccatcatcggcgacggcctgaaggagggcctggagaagctgcacgacatgatcatcaagagaagaaagatgctgagacagcagaagaagaagagatag

SEQ ID NO: 16297 - DNA, 603 bp, Artificial Sequence; identical to SEQ ID NO: 16296
  Description of Artificial Sequence: Synthetic coding sequence

SEQ ID NO: 16298 - DNA, 603 bp, Artificial Sequence; identical to SEQ ID NO: 16296
  Description of Artificial Sequence: Synthetic coding sequence

SEQ ID NO: 16299 - DNA, 603 bp, Artificial Sequence; identical to SEQ ID NO: 16296
  Description of Artificial Sequence: Synthetic coding sequence

SEQ ID NO: 16300 - DNA, 603 bp, Artificial Sequence; identical to SEQ ID NO: 16296
  Description of Artificial Sequence: Synthetic coding sequence

SEQ ID NO: 16301 - DNA, 156 bp, Artificial Sequence
  Description of Artificial Sequence: Synthetic coding sequence
atgggcaacggcctgagcgaccagaccagcatcctgagcaacctgcccagcttccagagcttccacatcgtgatcctgggcctggactgcgccggcaagaccaccgtgctgtacagactgcagttcaacgagttcgtgaacaccgtgcccacctag

SEQ ID NO: 16302 - DNA, 606 bp, Artificial Sequence
  Description of Artificial Sequence: Synthetic coding sequence
atgggcaacatcagcagcaacatcagcgccttccagagcctgcacatcgtgatgctgggcctggacagcgccggcaagaccaccgtgctgtacagactgaagttcaacgagttcgtgaacaccgtgcccaccatcggcttcaacaccgagaagatcaagctgagcaacggcaccgccaagggcatcagctgccacttctgggacgtgggcggccaggagaagctgagacccctgtggaagagctacagcagatgcaccgacggcatcatctacgtggtggacagcgtggacgtggacagactggaggaggccaagaccgagctgcacaaggtgaccaagttcgccgagaaccagggcacccccctgctggtgatcgccaacaagcaggacctgcccaagagcctgcccgtggccgagatcgagaagcagctggccctgcacgagctgatccccgccaccacctaccacgtgcagcccgcctgcgccatcatcggcgagggcctgaccgagggcatggacaagctgtacgagatgatcctgaagagaagaaagagcctgaagcagaagaagaagagaaccggcgacctgagaagctgcgaggtgtag

SEQ ID NO: 16303 - DNA, 579 bp, Artificial Sequence
  Description of Artificial Sequence: Synthetic coding sequence
atgggcaacatcagcagcaacatcagcgccttccagagcctgcacatcgtgatgctgggcctggacagcgccggcaagaccaccgtgctgtacagactgaagttcaacgagttcgtgaacaccgtgcccaccatcggcttcaacaccgagaagatcaagctgagcaacggcaccgccaagggcatcagctgccacttctgggacgtgggcggccaggagaagctgagacccctgtggaagagctacagcagatgcaccgacggcatcatctacgtggtggacagcgtggacgtggacagactggaggaggccaagaccgagctgcacaaggtgaccaagttcgccgagaaccagggcacccccctgctggtgatcgccaacaagcaggacctgcccaagagcctgcccgtggccgagatcgagaagcagctggccctgcacgagctgatccccgccaccacctaccacgtgcagcccgcctgcgccatcatcggcgagggcctgaccgagggcatggacaagctgtacgagatgatcctgaagagaagaaagagcctgaagcagaagaagaagagatag

SEQ ID NO: 16304 - DNA, 612 bp, Artificial Sequence
  Description of Artificial Sequence: Synthetic coding sequence
atggccgagggcgacaacagaagcaccaacctgctggccgccgagaccgccagcctggaggagcagctgcagggctggggcgaggtgatgctgatggccgacaaggtgctgagatgggagagagcctggttcccccccgccatcatgggcgtggtgagcctggtgttcctgatcatctactacctggaccccagcgtgctgagcggcgtgagctgcttcgtgatgttcctgtgcctggccgactacctggtgcccatcctggcccccagaatcttcggcagcaacaagtggaccaccgagcagcagcagagattccacgagatctgcagcaacctggtgaagaccagaagaagagccgtgggctggtggaagagactgttcaccctgaaggaggagaagcccaagatgtacttcatgaccatgatcgtgagcctggccgccgtggcctgggtgggccagcaggtgcacaacctgctgctgacctacctgatcgtgaccagcctgctgctgctgcccggcctgaaccagcacggcatcatcctgaagtacatcggcatggccaagagagagatcaacaagctgctgaagcagaaggagaagaagaacgagtag

SEQ ID NO: 16305 - DNA, 468 bp, Artificial Sequence
  Description of Artificial Sequence: Synthetic coding sequence
atgggcgtggtgagcctggtgttcctgatcatctactacctggaccccagcgtgctgagcggcgtgagctgcttcgtgatgttcctgtgcctggccgactacctggtgcccatcctggcccccagaatcttcggcagcaacaagtggaccaccgagcagcagcagagattccacgagatctgcagcaacctggtgaagaccagaagaagagccgtgggctggtggaagagactgttcaccctgaaggaggagaagcccaagatgtacttcatgaccatgatcgtgagcctggccgccgtggcctgggtgggccagcaggtgcacaacctgctgctgacctacctgatcgtgaccagcctgctgctgctgcccggcctgaaccagcacggcatcatcctgaagtacatcggcatggccaagagagagatcaacaagctgctgaagcagaaggagaagaagaacgagtag

SEQ ID NO: 16306 - DNA, 525 bp, Artificial Sequence
  Description of Artificial Sequence: Synthetic coding sequence
atgctgatggccgacaaggtgctgagatgggagagagcctggttcccccccgccatcatgggcgtggtgagcctggtgttcctgatcatctactacctggaccccagcgtgctgagcggcgtgagctgcttcgtgatgttcctgtgcctggccgactacctggtgcccatcctggcccccagaatcttcggcagcaacaagtggaccaccgagcagcagcagagattccacgagatctgcagcaacctggtgaagaccagaagaagagccgtgggctggtggaagagactgttcaccctgaaggaggagaagcccaagatgtacttcatgaccatgatcgtgagcctggccgccgtggcctgggtgggccagcaggtgcacaacctgctgctgacctacctgatcgtgaccagcctgctgctgctgcccggcctgaaccagcacggcatcatcctgaagtacatcggcatggccaagagagagatcaacaagctgctgaagcagaaggagaagaagaacgagtag

SEQ ID NO: 16307 - DNA, 561 bp, Artificial Sequence
  Description of Artificial Sequence: Synthetic coding sequence
atgatcgccctgttcaacaagctgctggactggttcaaggccctgttctggaaggaggagatggagctgaccctggtgggcctgcagtacagcggcaagaccaccttcgtgaacgtgatcgccagcggccagttcaacgaggacatgatccccaccgtgggcttcaacatgagaaagatcaccaagggcaacgtgaccatcaagctgtgggacatcggcggccagcccagattcagaagcatgtgggagagatactgcagaggcgtgagcgccatcgtgtacatggtggacgccgccgaccaggagaagatcgaggccagcaagaacgagctgcacaacctgctggacaagccccagctgcagggcatccccgtgctggtgctgggcaacaagagagacctgcccggcgccctggacgagaaggagctgatcgagaagatgaacctgagcgccatccaggacagagagatctgctgctacagcatcagctgcaaggagaaggacaacatcgacatcaccctgcagtggctgatccagcacagcaagagcagaagaagctag

SEQ ID NO: 16308 - DNA, 561 bp, Artificial Sequence
  Description of Artificial Sequence: Synthetic coding sequence
atgctggccctgatcagcagactgctggactggttcagaagcctgttctggaaggaggagatggagctgaccctggtgggcctgcagtacagcggcaagaccaccttcgtgaacgtgatcgccagcggccagttcagcgaggacatgatccccaccgtgggcttcaacatgagaaaggtgaccaagggcaacgtgaccatcaagatctgggacatcggcggccagcccagattcagaagcatgtgggagagatactgcagaggcgtgaacgccatcgtgtacatgatcgacgccgccgacagagagaagatcgaggccagcagaaacgagctgcacaacctgctggacaagccccagctgcagggcatccccgtgctggtgctgggcaacaagagagacctgcccaacgccctggacgagaagcagctgatcgagaagatgaacctgagcgccatccaggacagagagatctgctgctacagcatcagctgcaaggagaaggacaacatcgacatcaccctgcagtggctgatccagcacagcaagagcagaagaagctag

SEQ ID NO: 16309 - DNA, 492 bp, Artificial Sequence
  Description of Artificial Sequence: Synthetic coding sequence
atgctggccctgatcagcagactgctggactggttcagaagcctgttctggaaggaggagatggagctgaccctggtgggcctgcagtacagcggcaagaccaccttcgtgaacgtgatcgccagcggccagttcagcgaggacatgatccccaccgtgggcttcaacatgagaaaggtgaccaagggcaacgtgaccatcaagatctgggacatcggcggccagcccagattcagaagcatgtgggagagatactgcagaggcgtgaacgccatcgtgtacatgatcgacgccgccgacagagagaagatcgaggccagcagaaacgagctgcacaacctgctggacaagccccagctgcagggcatccccatcagccacttcagcggcctgttcagcatccagaacctggaggaggccgaggccagccccgaggtgttccagagcttcctggccatcatcctggagctgctgagcgtgcccctgaagtag

SEQ ID NO: 16310 - DNA, 717 bp, Artificial Sequence
  Description of Artificial Sequence: Synthetic coding sequence
atgatcagaagcgccagctgggtgtggctgctgccccccgccggcgtgagaccctgcagagccggcgcccccagaagcagatggagagtgagagccgaggccagaagctgcggcagcagacccagcagcagacccttcagcctgcccgccgccatcatgctggccctgatcagcagactgctggactggttcagaagcctgttctggaaggaggagatggagctgaccctggtgggcctgcagtacagcggcaagaccaccttcgtgaacgtgatcgccagcggccagttcagcgaggacatgatccccaccgtgggcttcaacatgagaaaggtgaccaagggcaacgtgaccatcaagatctgggacatcggcggccagcccagattcagaagcatgtgggagagatactgcagaggcgtgaacgccatcgtgtacatgatcgacgccgccgacagagagaagatcgaggccagcagaaacgagctgcacaacctgctggacaagccccagctgcagggcatccccgtgctggtgctgggcaacaagagagacctgcccaacgccctggacgagaagcagctgatcgagaagatgaacctgagcgccatccaggacagagagatctgctgctacagcatcagctgcaaggagaaggacaacatcgacatcaccctgcagtggctgatccagcacagcaagagcagaagaagctag

SEQ ID NO: 16311 - DNA, 681 bp, Artificial Sequence
  Description of Artificial Sequence: Synthetic coding sequence
atgagcttcgccgagagcggctggagaagcgccctgagaagaagaggccccggcacccccggccccgtggccagacccagctacagcagcttcacccagggcgacagctggggcgagggcgaggtggacgaggaggagggctgcgaccaggtggccagagacctgagagccgagttcagcgccggcgcctggagcgagcccagaaagagaagcgtgctgccccccgacggcaacggcagccccgtgctgcccgacaagagaaacggcatcttccccgccgccgccggcagcagagcccagcccagaagatggcccgtgcaggtgctgagcatcctgtgcagcctgctgttcgccatcctgctggccttcctgctggccatcgcctacctgatcgtgaaggagctgcacgccgagaacctgaagaacgaggacgacgtggacaccggcctgctgggcttctggaccctgctgatcatcagcctgaccgccggcttcagctgctgcagcttcagctggaccgtgacctacttcgacagcttcgagcccggcatgttcccccccacccccctgagccccgccagattcaagaagctgaccggccacagcttccacatgggctacagcatggccatcctgaacggcatcgtggccgccctgaccgtggcctggtgcctgatgtag

SEQ ID NO: 16312 - DNA, 3492 bp, Artificial Sequence
  Description of Artificial Sequence: Synthetic coding sequence
atgaacagagaggacagaaacgtgctgagaatgaaggagagagagagaagaaaccaggagatccagcagggcgaggacgccttcccccccagcagccccctgttcgccgagccctacaaggtgaccagcaaggaggacaagctgagcagcagaatccagagcatgctgggcaactacgacgagatgaaggacttcatcggcgacagaagcatccccaagctggtggccatccccaagcccaccgtgccccccagcgccgacgagaagagcaaccccaacttcttcgagcagagacacggcggcagccaccagagcagcaagtggacccccgtgggccccgcccccagcaccagccagagccagaagagaagcagcggcctgcagagcggccacagcagccagagaaccagcgccggcagcagcagcggcaccaacagcagcggccagagacacgacagagagagctacaacaacagcggcagcagcagcagaaagaagggccagcacggcagcgagcacagcaagagcagaagcagcagccccggcaagccccaggccgtgagcagcctgaacagcagccacagcagaagccacggcaacgaccaccacagcaaggagcaccagagaagcaagagccccagagaccccgacgccaactgggacagccccagcagagtgcccttcagcagcggccagcacagcacccagagcttcccccccagcctgatgagcaagagcaacagcatgctgcagaagcccaccgcctacgtgagacccatggacggccaggagagcatggagcccaagctgagcagcgagcactacagcagccagagccacggcaacagcatgaccgagctgaagcccagcagcaaggcccacctgaccaagctgaagatccccagccagcccctggacgccagcgccagcggcgacgtgagctgcgtggacgagatcctgaaggagatgacccacagctggcccccccccctgaccgccatccacaccccctgcaagaccgagcccagcaagttccccttccccaccaaggagagccagcagagcaacttcggcaccggcgagcagaagagatacaaccccagcaagaccagcaacggccaccagagcaagagcatgctgaaggacgacctgaagctgagcagcagcgaggacagcgacggcgagcaggactgcgacaagaccatgcccagaagcacccccggcagcaacagcgagcccagccaccacaacagcgagggcgccgacaacagcagagacgacagcagcagccacagcggcagcgagagcagcagcggcagcgacagcgagagcgagagcagcagcagcgacagcgaggccaacgagcccagccagagcgccagccccgagcccgagcccccccccaccaacaagtggcagctggacaactggctgaacaaggtgaacccccacaaggtgagccccgccagcagcgtggacagcaacatccccagcagccagggctacaagaaggagggcagagagcagggcaccggcaacagctacaccgacaccagcggccccaaggagaccagcagcgccacccccggcagagacagcaagaccatccagaagggcagcgagagcggcagaggcagacagaagagccccgcccagagcgacagcaccacccagagaagaaccgtgggcaagaagcagcccaagaaggccgagaaggccgccgccgaggagcccagaggcggcctgaagatcgagagcgagacccccgtggacctggccagcagcatgcccagcagcagacacaaggccgccaccaagggcagcagaaagcccaacatcaagaaggagagcaagagcagccccagacccaccgccgagaagaagaagtacaagagcaccagcaagagcagccagaagagcagagagatcatcgagaccgacaccagcagcagcgacagcgacgagagcgagagcctgccccccagcagccagacccccaagtaccccgagagcaacagaacccccgtgaagcccagcagcgtggaggaggaggacagcttcttcagacagagaatgttcagccccatggaggagaaggagctgctgagccccctgagcgagcccgacgacagataccccctgatcgtgaagatcgacctgaacctgctgaccagaatccccggcaagccctacaaggagaccgagccccccaagggcgagaagaagaacgtgcccgagaagcacaccagagaggcccagaagcaggccagcgagaaggtgagcaacaagggcaagagaaagcacaagaacgaggacgacaacagagccagcgagagcaagaagcccaagaccgaggacaagaacagcgccggccacaagcccagcagcaacagagagagcagcaagcagagcgccgccaaggagaaggacctgctgcccagccccgccggccccgtgcccagcaaggaccccaagaccgagcacggcagcagaaagagaaccatcagccagagcagcagcctgaagagcagcagcaacagcaacaaggagaccagcggcagcagcaagaacagcagcagcaccagcaagcagaagaagaccgagggcaagaccagcagcagcagcaaggaggtgaaggagaaggcccccagcagcagcagcaactgcccccccagcgcccccaccctggacagcagcaagcccagaagaaccaagctggtgttcgacgacagaaactacagcgccgaccactacctgcaggaggccaagaagctgaagcacaacgccgacgccctgagcgacagattcgagaaggccgtgtactacctggacgccgtggtgagcttcatcgagtgcggcaacgccctggagaagaacgcccaggagagcaagagccccttccccatgtacagcgagaccgtggacctgatcaagtacaccatgaagctgaagaactacctggcccccgacgccaccgccgccgacaagagactgaccgtgctgtgcctgagatgcgagagcctgctgtacctgagactgttcaagctgaagaaggagaacgccctgaagtacagcaagaccctgaccgagcacctgaagaacagctacaacaacagccaggcccccagccccggcctgggcagcaaggccgtgggcatgcccagccccgtgagccccaagctgagccccggcaacagcggcaactacagcagcggcgccagcagcgccagcgccagcggcagcagcgtgaccatcccccagaagatccaccagatggccgccagctacgtgcaggtgaccagcaacttcctgtacgccaccgagatctgggaccaggccgagcagctgagcaaggagcagaaggagttcttcgccgagctggacaaggtgatgggccccctgatcttcaacgccagcatcatgaccgacctggtgagatacaccagacagggcctgcactggctgagacaggacgccaagctgatcagctag

SEQ ID NO: 16313 - DNA, 447 bp, Artificial Sequence
  Description of Artificial Sequence: Synthetic coding sequence
atgaacagagaggacagaaacgtgctgagaatgaaggagagagagagaagaaaccaggagatccagcagggcgaggacgccttcccccccagcagccccctgttcgccgagccctacaaggtgaccagcaaggaggacaagctgagcagcagaatccagagcatgctgggcaactacgacgagatgaaggacttcatcggcgacagaagcatccccaagctggtggccatccccaagcccaccgtgccccccagcgccgacgagaagagcaaccccaacttcttcgagcagagacacggcggcagccaccagagcagcaagtggacccccgtgggccccgcccccagcaccagccagagccagaagagaagcagcggcctgcagagcggccacagcagccagagaaccagcgccggcagcagcagcggcaccaacagcagcggctag

SEQ ID NO: 16314 - DNA, 1059 bp, Artificial Sequence
  Description of Artificial Sequence: Synthetic coding sequence
atgctgagactgctggccagcggctgcgccagaggccccggccccggcgtgggcgccagacccgccgccggcctgttccaccccggcagaagacagagcagacaggccagcgacgcccccagaaaccagccccccagccccgagttcgtggccagacccgtgggcgtgtgcagcatgatgagactgcccgtgcagaccagccccgagggcctggacgccgccttcatcggcgtgcccctggacaccggcaccagcaacagacccggcgccagattcggccccagaagaatcagagaggagagcgtgatgctgggcaccgtgaaccccagcaccggcgccctgcccttccagagcctgatggtggccgacctgggcgacgtgaacgtgaacctgtacaacctgcaggacagctgcagaagaatccaggaggcctacgagaagatcgtggccgccggctgcatccccctgaccctgggcggcgaccacaccatcacctaccccatcctgcaggccatggccaagaagcacggccccgtgggcctgctgcacgtggacgcccacaccgacaccaccgacaaggccctgggcgagaagctgtaccacggcgcccccttcagaagatgcgtggacgagggcctgctggactgcaagagagtggtgcagatcggcatcagaggcagcagcaccaccctggacccctacagatacaacagaagccagggcttcagagtggtgctggccgaggactgctggatgaagagcctggtgcccctgatgggcgaggtgagacagcagatgggcggcaagcccatctacatcagcttcgacatcgacgccctggaccccgcctacgcccccggcaccggcacccccgagatcgccggcctgacccccagccaggccctggagatcatcagaggctgccagggcctgaacgtgatgggctgcgacctggtggaggtgagccccccctacgacctgagcggcaacaccgccctgctggccgccaacctgctgttcgagatgctgtgcgccctgcccaaggtgaccaccgtgtag

SEQ ID NO: 16315 - DNA, 1617 bp, Artificial Sequence
  Description of Artificial Sequence: Synthetic coding sequence
atggagagactgggcgagaaggccagcagactgctggagaagttcggcagaagaaagggcgagagcagcagaagcggcagcgacggcacccccggccccggcaagggcagactgagcggcctgggcggccccagaaagagcggccccagaggcgccaccggcggccccggcgacgagcccctggagcccgccagagagcagggcagcctggacgccgagagaaaccagagaggcagcttcgaggcccccagatacgagggcagcttccccgccggccccccccccaccagagccctgcccctgccccagagcctgccccccgacttcagactggagcccaccgcccccgccctgagccccagaagcagcttcgccagcagcagcgccagcgacgccagcaagcccagcagccccagaggcagcctgctgctggacggcgccggcgccggcggcgccggcggcagcagaccctgcagcaacagaaccagcggcatcagcatgggctacgaccagagacacggcagccccctgcccgccggcccctgcctgttcggcccccccctggccggcgcccccgccggctacagccccggcggcgtgcccagcgcctaccccgagctgcacgccgccctggacagactgtacgcccagagacccgccggcttcggctgccaggagagcagacacagctacccccccgccctgggcagccccggcgccctggccggcgccggcgtgggcgccgccggccccctggagagaagaggcgcccagcccggcagacacagcgtgaccggctacggcgactgcgccgtgggcgccagataccaggacgagctgaccgccctgctgagactgaccgtgggcaccggcggcagagaggccggcgccagaggcgagcccagcggcatcgagcccagcggcctggaggagccccccggccccttcgtgcccgaggccgccagagccagaatgagagagcccgaggccagagaggactacttcggcacctgcatcaagtgcaacaagggcatctacggccagagcaacgcctgccaggccctggacagcctgtaccacacccagtgcttcgtgtgctgcagctgcggcagaaccctgagatgcaaggccttctacagcgtgaacggcagcgtgtactgcgaggaggactacctgttcagcggcttccaggaggccgccgagaagtgctgcgtgtgcggccacctgatcctggagaagatcctgcaggccatgggcaagagctaccaccccggctgcttcagatgcatcgtgtgcaacaagtgcctggacggcatccccttcaccgtggacttcagcaaccaggtgtactgcgtgaccgactaccacaagaactacgcccccaagtgcgccgcctgcggccagcccatcctgcccagcgagggctgcgaggacatcgtgagagtgatcagcatggacagagactaccacttcgagtgctaccactgcgaggactgcagaatgcagctgagcgacgaggagggctgctgctgcttccccctggacggccacctgctgtgccacggctgccacatgcagagactgaacgccagacagccccccgccaactacatctag

SEQ ID NO: 16316 - DNA, 1617 bp, Artificial Sequence; identical to SEQ ID NO: 16315
  Description of Artificial Sequence: Synthetic coding sequence

SEQ ID NO: 16317 - DNA, 366 bp, Artificial Sequence
  Description of Artificial Sequence: Synthetic coding sequence
atgggcaagagctaccaccccggctgcttcagatgcatcgtgtgcaacaagtgcctggacggcatccccttcaccgtggacttcagcaaccaggtgtactgcgtgaccgactaccacaagaactacgcccccaagtgcgccgcctgcggccagcccatcctgcccagcgagggctgcgaggacatcgtgagagtgatcagcatggacagagactaccacttcgagtgctaccactgcgaggactgcagaatgcagctgagcgacgaggagggctgctgctgcttccccctggacggccacctgctgtgccacggctgccacatgcagagactgaacgccagacagccccccgccaactacatctag

SEQ ID NO: 16318 - DNA, 243 bp, Artificial Sequence
  Description of Artificial Sequence: Synthetic coding sequence
atgggcaagagctaccaccccggctgcttcagatgcatcgtgtgcaacaagtgcctggacggcatccccttcaccgtggacttcagcaaccaggtgtactgcgtgaccgactaccacaagaactacgcccccaagtgcgccgcctgcggccagcccatcctgcccagcgagggctgcgaggacatcgtgagagtgatcagcatggacagagactaccacttcgagtgctaccactgcgagtag

SEQ ID NO: 16319 - DNA, 198 bp, Artificial Sequence
  Description of Artificial Sequence: Synthetic coding sequence
atgggcaagagctaccaccccggctgcttcagatgcatcgtgtgcaacaagtgcctggacggcatccccttcaccgtggacttcagcaaccaggtgtactgcgtgaccgactaccacaagaactacgcccccaagtgcgccgcctgcggccagcccatcctgcccagcgagggctgcgaggacatcgtgagagtgtag

SEQ ID NO: 16320 - DNA, 243 bp, Artificial Sequence; identical to SEQ ID NO: 16318
  Description of Artificial Sequence: Synthetic coding sequence

SEQ ID NO: 16321 - DNA, 309 bp, Artificial Sequence
  Description of Artificial Sequence: Synthetic coding sequence
atggccaacacccagctggaccacctgcactacaccaccgagttcaccagaaacgacctgctgatcatctgcaagaagttcaacctgatgctgatggacgaggacatcatcagcctgctggccatcttcatcaagatgtgcctgtggctgtggaagcagttcctgaagagaggcagcaagtgcagcgagaccagcgagctgctggagaaggtgaagctgcagctggccttcaccgcctacaagtacgtggacatctgcttccccgagcagatggcctacagcagatacatcagatggtacatccactag

SEQ ID NO: 16322 - DNA, 1500 bp, Artificial Sequence
  Description of Artificial Sequence: Synthetic coding sequence
atgtgcgagctgtacagcaagagagacaccctgggcctgagaaagaagcacatcggccccagctgcaaggtgttcttcgccagcgaccccatcaagatcgtgagagcccagagacagtacatgttcgacgagaacggcgagcagtacctggactgcatcaacaacgtggcccacgtgggccactgccaccccggcgtggtgaaggccgccctgaagcagatggagctgctgaacaccaacagcagattcctgcacgacaacatcgtggagtacgccaagagactgagcgccaccctgcccgagaagctgagcgtgtgctacttcaccaacagcggcagcgaggccaacgacctggccctgagactggccagacagttcagaggccaccaggacgtgatcaccctggaccacgcctaccacggccacctgagcagcctgatcgagatcagcccctacaagttccagaagggcaaggacgtgaagaaggagttcgtgcacgtggcccccacccccgacacctacagaggcaagtacagagaggaccacgccgacagcgccagcgcctacgccgacgaggtgaagaagatcatcgaggacgcccacaacagcggcagaaagatcgccgccttcatcgccgagagcatgcagagctgcggcggccagatcatcccccccgccggctacttccagaaggtggccgagtacgtgcacggcgccggcggcgtgttcatcgccgacgaggtgcaggtgggcttcggcagagtgggcaagcacttctggagcttccagatgtacggcgaggacttcgtgcccgacatcgtgaccatgggcaagcccatgggcaacggccaccccgtggcctgcgtggtgaccaccaaggagatcgccgaggccttcagcagcagcggcatggagtacttcaacacctacggcggcaaccccgtgagctgcgccgtgggcctggccgtgctggacatcatcgagaacgaggacctgcagggcaacgccaagagagtgggcaactacctgaccgagctgctgaagaagcagaaggccaagcacaccctgatcggcgacatcagaggcatcggcctgttcatcggcatcgacctggtgaaggaccacctgaagagaacccccgccaccgccgaggcccagcacatcatctacaagatgaaggagaagagagtgctgctgagcgccgacggcccccacagaaacgtgctgaagatcaagccccccatgtgcttcaccgaggaggacgccaagttcatggtggaccagctggacagaatcctgaccgtgctggaggaggccatgggcaccaagaccgagagcgtgaccagcgagaacaccccctgcaagaccaagatgctgaaggaggcccacatcgagctgctgagagacagcaccaccgacagcaaggagaaccccagcagaaagagaaacggcatgtgcaccgacacccacagcctgctgagcaagagactgaagacctag

SEQ ID NO: 16323 - DNA, 1482 bp, Artificial Sequence
  Description of Artificial Sequence: Synthetic coding sequence
atgtgcgagctgtacagcaagagagacaccctgggcctgagaaagaagcacatcggccccagctgcaaggtgttcttcgccagcgaccccatcaagatcgtgagagcccagagacagtacatgttcgacgagaacggcgagcagtacctggactgcatcaacaacgtggcccacggcgtggtgaaggccgccctgaagcagatggagctgctgaacaccaacagcagattcctgcacgacaacatcgtggagtacgccaagagactgagcgccaccctgcccgagaagctgagcgtgtgctacttcaccaacagcggcagcgaggccaacgacctggccctgagactggccagacagttcagaggccaccaggacgtgatcaccctggaccacgcctaccacggccacctgagcagcctgatcgagatcagcccctacaagttccagaagggcaaggacgtgaagaaggagttcgtgcacgtggcccccacccccgacacctacagaggcaagtacagagaggaccacgccgacagcgccagcgcctacgccgacgaggtgaagaagatcatcgaggacgcccacaacagcggcagaaagatcgccgccttcatcgccgagagcatgcagagctgcggcggccagatcatcccccccgccggctacttccagaaggtggccgagtacgtgcacggcgccggcggcgtgttcatcgccgacgaggtgcaggtgggcttcggcagagtgggcaagcacttctggagcttccagatgtacggcgaggacttcgtgcccgacatcgtgaccatgggcaagcccatgggcaacggccaccccgtggcctgcgtggtgaccaccaaggagatcgccgaggccttcagcagcagcggcatggagtacttcaacacctacggcggcaaccccgtgagctgcgccgtgggcctggccgtgctggacatcatcgagaacgaggacctgcagggcaacgccaagagagtgggcaactacctgaccgagctgctgaagaagcagaaggccaagcacaccctgatcggcgacatcagaggcatcggcctgttcatcggcatcgacctggtgaaggaccacctgaagagaacccccgccaccgccgaggcccagcacatcatctacaagatgaaggagaagagagtgctgctgagcgccgacggcccccacagaaacgtgctgaagatcaagccccccatgtgcttcaccgaggaggacgccaagttcatggtggaccagctggacagaatcctgaccgtgctggaggaggccatgggcaccaagaccgagagcgtgaccagcgagaacaccccctgcaagaccaagatgctgaaggaggcccacatcgagctgctgagagacagcaccaccgacagcaaggagaaccccagcagaaagagaaacggcatgtgcaccgacacccacagcctgctgagcaagagactgaagacctag

SEQ ID NO: 16324 - DNA, 1326 bp, Artificial Sequence
  Description of Artificial Sequence: Synthetic coding sequence
atgggccactgccaccccggcgtggtgaaggccgccctgaagcagatggagctgctgaacaccaacagcagattcctgcacgacaacatcgtggagtacgccaagagactgagcgccaccctgcccgagaagctgagcgtgtgctacttcaccaacagcggcagcgaggccaacgacctggccctgagactggccagacagttcagaggccaccaggacgtgatcaccctggaccacgcctaccacggccacctgagcagcctgatcgagatcagcccctacaagttccagaagggcaaggacgtgaagaaggagttcgtgcacgtggcccccacccccgacacctacagaggcaagtacagagaggaccacgccgacagcgccagcgcctacgccgacgaggtgaagaagatcatcgaggacgcccacaacagcggcagaaagatcgccgccttcatcgccgagagcatgcagagctgcggcggccagatcatcccccccgccggctacttccagaaggtggccgagtacgtgcacggcgccggcggcgtgttcatcgccgacgaggtgcaggtgggcttcggcagagtgggcaagcacttctggagcttccagatgtacggcgaggacttcgtgcccgacatcgtgaccatgggcaagcccatgggcaacggccaccccgtggcctgcgtggtgaccaccaaggagatcgccgaggccttcagcagcagcggcatggagtacttcaacacctacggcggcaaccccgtgagctgcgccgtgggcctggccgtgctggacatcatcgagaacgaggacctgcagggcaacgccaagagagtgggcaactacctgaccgagctgctgaagaagcagaaggccaagcacaccctgatcggcgacatcagaggcatcggcctgttcatcggcatcgacctggtgaaggaccacctgaagagaacccccgccaccgccgaggcccagcacatcatctacaagatgaaggagaagagagtgctgctgagcgccgacggcccccacagaaacgtgctgaagatcaagccccccatgtgcttcaccgaggaggacgccaagttcatggtggaccagctggacagaatcctgaccgtgctggaggaggccatgggcaccaagaccgagagcgtgaccagcgagaacaccccctgcaagaccaagatgctgaaggaggcccacatcgagctgctgagagacagcaccaccgacagcaaggagaaccccagcagaaagagaaacggcatgtgcaccgacacccacagcctgctgagcaagagactgaagacctag

SEQ ID NO: 16325 - DNA, 1353 bp, Artificial Sequence
  Description of Artificial Sequence: Synthetic coding sequence
atggccgccgaccagagacccaaggccgacaccctggccctgagacagagactgatcagcagcagctgcagactgttcttccccgaggaccccgtgaagatcgtgagagcccagggccagtacatgtacgacgagcagggcgccgagtacatcgactgcatcagcaacgtggcccacgtgggccactgccaccccctggtggtgcaggccgcccacgagcagaaccaggtgctgaacaccaacagcagatacctgcacgacaacatcgtggactacgcccagagactgagcgagaccctgcccgagcagctgtgcgtgttctacttcctgaacagcggcagcgaggccaacgacctggccctgagactggccagacactacaccggccaccaggacgtggtggtgctggaccacgcctaccacggccacctgagcagcctgatcgacatcagcccctacaagttcagaaacctggacggccagaaggagtgggtgcacgtggcccccctgcccgacacctacagaggcccctacagagaggaccaccccaaccccgccatggcctacgccaacgaggtgaagagagtggtgagcagcgcccaggagaagggcagaaagatcgccgccttcttcgccgagagcctgcccagcgtgggcggccagatcatcccccccgccggctacttcagccaggtggccgagcacatcagaaaggccggcggcgtgttcgtggccgacgagatccaggtgggcttcggcagagtgggcaagcacttctgggccttccagctgcagggcaaggacttcgtgcccgacatcgtgaccatgggcaagagcatcggcaacggccaccccgtggcctgcgtggccgccacccagcccgtggccagagccttcgaggccaccggcgtggagtacttcaacaccttcggcggcagccccgtgagctgcgccgtgggcctggccgtgctgaacgtgctggagaaggagcagctgcaggaccacgccaccagcgtgggcagcttcctgatgcagctgctgggccagcagaagatcaagcaccccatcgtgggcgacgtgagaggcgtgggcctgttcatcggcgtggacctgatcaaggacgaggccaccagaacccccgccaccgaggaggccgcctacctggtgagcagactgaaggagaactacgtgctgctgagcaccgacggccccggcagaaacatcctgaagttcaagccccccatgtgcttcagcctggacaacgccagacaggtggtggccaagctggacgccatcctgaccgacatggaggagaaggtgagaagctgcgagaccctgagactgcagccctag

SEQ ID NO: 16326 - DNA, 519 bp, Artificial Sequence
  Description of Artificial Sequence: Synthetic coding sequence
atgatctacagctgctgcatcttcgtgtactgcatgttcgagtgcttcaagatcaagaacagcgtgaactaccacctgctgttcaccctggtgctgttcagcctgatcgtgaccaccgtgtacctgaaggtgaaggagcccatcttccaccaggtgatgtacggcatgctggtgttcaccctggtgctgagaagcatctacatcgtgacctgggtgtacccctggctgagaggcctgggctacaccagcctgggcatcttcctgctgggcttcctgttctggaacatcgacaacatcttctgcgagagcctgagaaacttcagaaagaaggtgccccccatcatcggcatcaccacccagttccacgcctggtggcacatcctgaccggcctgggcagctacctgcacatcctgttcagcctgtacaccagaaccctgtacctgagatacagacccaaggtgaagttcctgttcggcatctggcccgtgatcctgttcgagcccctgagaaagcactag

SEQ ID NO: 16327 - DNA, 804 bp, Artificial Sequence
  Description of Artificial Sequence: Synthetic coding sequence
atggcccccgccgccgacagagagggctactggggccccaccaccagcaccctggactggtgcgaggagaactacagcgtgacctggtacatcgccgagttctggaacaccgtgagcaacctgatcatgatcatcccccccatgttcggcgccgtgcagagcgtgagagacggcctggagaagagatacatcgccagctacctggccctgaccgtggtgggcatgggcagctggtgcttccacatgaccctgaagtacgagatgcagctgctggacgagctgcccatgatctacagctgctgcatcttcgtgtactgcatgttcgagtgcttcaagatcaagaacagcgtgaactaccacctgctgttcaccctggtgctgttcagcctgatcgtgaccaccgtgtacctgaaggtgaaggagcccatcttccaccaggtgatgtacggcatgctggtgttcaccctggtgctgagaagcatctacatcgtgacctgggtgtacccctggctgagaggcctgggctacaccagcctgggcatcttcctgctgggcttcctgttctggaacatcgacaacatcttctgcgagagcctgagaaacttcagaaagaaggtgccccccatcatcggcatcaccacccagttccacgcctggtggcacatcctgaccggcctgggcagctacctgcacatcctgttcagcctgtacaccagaaccctgtacctgagatacagacccaaggtgaagttcctgttcggcatctggcccgtgatcctgttcgagcccctgagaaagcactag

SEQ ID NO: 16328 - DNA, 693 bp, Artificial Sequence
  Description of Artificial Sequence: Synthetic coding sequence
atggcccccgccgccgacagagagggctactggggccccaccaccagcaccctggactggtgcgaggagaactacagcgtgacctggtacatcgccgagttcctggtgggcatgggcagctggtgcttccacatgaccctgaagtacgagatgcagctgctggacgagctgcccatgatctacagctgctgcatcttcgtgtactgcatgttcgagtgcttcaagatcaagaacagcgtgaactaccacctgctgttcaccctggtgctgttcagcctgatcgtgaccaccgtgtacctgaaggtgaaggagcccatcttccaccaggtgatgtacggcatgctggtgttcaccctggtgctgagaagcatctacatcgtgacctgggtgtacccctggctgagaggcctgggctacaccagcctgggcatcttcctgctgggcttcctgttctggaacatcgacaacatcttctgcgagagcctgagaaacttcagaaagaaggtgccccccatcatcggcatcaccacccagttccacgcctggtggcacatcctgaccggcctgggcagctacctgcacatcctgttcagcctgtacaccagaaccctgtacctgagatacagacccaaggtgaagttcctgttcggcatctggcccgtgatcctgttcgagcccctgagaaagcactag

SEQ ID NO: 16329 - DNA, 678 bp, Artificial Sequence
  Description of Artificial Sequence: Synthetic coding sequence
atgatcatcccccccatgttcggcgccgtgcagagcgtgagagacggcctggagaagagatacatcgccagctacctggccctgaccgtggtgggcatgggcagctggtgcttccacatgaccctgaagtacgagatgcagctgctggacgagctgcccatgatctacagctgctgcatcttcgtgtactgcatgttcgagtgcttcaagatcaagaacagcgtgaactaccacctgctgttcaccctggtgctgttcagcctgatcgtgaccaccgtgtacctgaaggtgaaggagcccatcttccaccaggtgatgtacggcatgctggtgttcaccctggtgctgagaagcatctacatcgtgacctgggtgtacccctggctgagaggcctgggctacaccagcctgggcatcttcctgctgggcttcctgttctggaacatcgacaacatcttctgcgagagcctgagaaacttcagaaagaaggtgccccccatcatcggcatcaccacccagttccacgcctggtggcacatcctgaccggcctgggcagctacctgcacatcctgttcagcctgtacaccagaaccctgtacctgagatacagacccaaggtgaagttcctgttcggcatctggcccgtgatcctgttcgagcccctgagaaagcactag

SEQ ID NO: 16330 - DNA, 405 bp, Artificial Sequence
  Description of Artificial Sequence: Synthetic coding sequence
atggcccagagcagactgatcggcaccagcaccagccaggtgatgtacggcatgctggtgttcaccctggtgctgagaagcatctacatcgtgacctgggtgtacccctggctgagaggcctgggctacaccagcctgggcatcttcctgctgggcttcctgttctggaacatcgacaacatcttctgcgagagcctgagaaacttcagaaagaaggtgccccccatcatcggcatcaccacccagttccacgcctggtggcacatcctgaccggcctgggcagctacctgcacatcctgttcagcctgtacaccagaaccctgtacctgagatacagacccaaggtgaagttcctgttcggcatctggcccgtgatcctgttcgagcccctgagaaagcactag

SEQ ID NO: 16331 - DNA, 453 bp, Artificial Sequence
  Description of Artificial Sequence: Synthetic coding sequence
atgagcggcgagctgagcaacagattccagggcggcaaggccttcggcctgctgaaggccagacaggagagaagactggccgagatcaacagagagttcctgtgcgaccagaagtacagcgacgaggagaacctgcccgagaagctgaccgccttcaaggagaagtacatggagttcgacctgaacaacgagggcgagatcgacctgatgagcctgaagagaatgatggagaagctgggcgtgcccaagacccacctggagatgaagaagatgatcagcgaggtgaccggcggcgtgagcgacaccatcagctacagagacttcgtgaacatgatgctgggcaagagaagcgccgtgctgaagctggtgatgatgttcgagggcaaggccaacgagagcagccccaagcccgtgggccccccccccgagagagacatcgccagcctgccctag

SEQ ID NO: 16332 - DNA, 309 bp, Artificial Sequence
  Description of Artificial Sequence: Synthetic coding sequence
atgagcggcgagctgagcaacagattccagggcggcaaggccttcggcctgctgaaggccagacaggagagaagactggccgagatcaacagagagttcctgtgcgaccagaagtacagcgacgaggagaacctgcccgagaagctgaccgccttcaaggagaagtacatggagttcgacctgaacaacgagggcgagatcgacctgatgagcctgaagagaatgatggagaagctgggcgtgcccaagacccacctggagatgaagaagatgatcagcgaggtgaccggcggcagccacgacgtgtag

SEQ ID NO: 16333 - DNA, 285 bp, Artificial Sequence
  Description of Artificial Sequence: Synthetic coding sequence
atggagttcgacctgaacaacgagggcgagatcgacctgatgagcctgaagagaatgatggagaagctgggcgtgcccaagacccacctggagatgaagaagatgatcagcgaggtgaccggcggcgtgagcgacaccatcagctacagagacttcgtgaacatgatgctgggcaagagaagcgccgtgctgaagctggtgatgatgttcgagggcaaggccaacgagagcagccccaagcccgtgggccccccccccgagagagacatcgccagcctgccctag

SEQ ID NO: 16334 - DNA, 429 bp, Artificial Sequence
  Description of Artificial Sequence: Synthetic coding sequence
atgagcggcgagctgagcaacagattccagggcggcaaggccttcggcctgctgaaggccagacaggagagaagactggccgagatcaacagagagttcctgtgcgaccagaagtacagcgacgaggagaacctgcccgagaagctgaccgccttcaaggagaagtacatggagttcgacctgatgagcctgaagagaatgatggagaagctgggcgtgcccaagacccacctggagatgaagaagatgatcagcgaggtgaccggcggcgtgagcgacaccatcagctacagagacttcgtgaacatgatgctgggcaagagaagcgccgtgctgaagctggtgatgatgttcgagggcaaggccaacgagagcagccccaagcccgtgggccccccccccgagagagacatcgccagcctgccctag

SEQ ID NO: 16335 - DNA, 531 bp, Artificial Sequence
  Description of Artificial Sequence: Synthetic coding sequence
atgagcggcgagctgagcaacagattccagggcggcaaggccttcggcctgctgaaggccagacaggagagaagactggccgagatcaacagatactgcgccggcagagagccccagctgcagagaatcagctgcagccagcacagctgcctgctggccctgctgttccaggagttcctgtgcgaccagaagtacagcgacgaggagaacctgcccgagaagctgaccgccttcaaggagaagtacatggagttcgacctgaacaacgagggcgagatcgacctgatgagcctgaagagaatgatggagaagctgggcgtgcccaagacccacctggagatgaagaagatgatcagcgaggtgaccggcggcgtgagcgacaccatcagctacagagacttcgtgaacatgatgctgggcaagagaagcgccgtgctgaagctggtgatgatgttcgagggcaaggccaacgagagcagccccaagcccgtgggccccccccccgagagagacatcgccagcctgccctag

SEQ ID NO: 16336 - DNA, 468 bp, Artificial Sequence
  Description of Artificial Sequence: Synthetic coding sequence
atggccagcaagatggtgatcagcgcccaccccaagatcctgctgcagctgatccagaaggacaagcccggcggccccggcgccagagtgagacagaaggtgctggaggagttcctgtgcgaccagaagtacagcgacgaggagaacctgcccgagaagctgaccgccttcaaggagaagtacatggagttcgacctgaacaacgagggcgagatcgacctgatgagcctgaagagaatgatggagaagctgggcgtgcccaagacccacctggagatgaagaagatgatcagcgaggtgaccggcggcgtgagcgacaccatcagctacagagacttcgtgaacatgatgctgggcaagagaagcgccgtgctgaagctggtgatgatgttcgagggcaaggccaacgagagcagccccaagcccgtgggccccccccccgagagagacatcgccagcctgccctag

SEQ ID NO: 16337 - DNA, 1023 bp, Artificial Sequence
  Description of Artificial Sequence: Synthetic coding sequence
atgagaaaggagctgcagctgagcctgagcgtgaccctgctgctggtgtgcggcttcctgtaccagttcaccctgaagagcagctgcctgttctgcctgcccagcttcaagagccaccagggcctggaggccctgctgagccacagaagaggcatcgtgttcctggagaccagcgagagaatggagcccccccacctggtgagctgcagcgtggagagcgccgccaagatctaccccgagtggcccgtggtgttcttcatgaagggcctgaccgacagcacccccatgcccagcaacagcacctaccccgccttcagcttcctgagcgccatcgacaacgtgttcctgttccccctggacatgaagagactgctggaggacacccccctgttcagctggtacaaccagatcaacgccagcgccgagagaaactggctgcacatcagcagcgacgccagcagactggccatcatctggaagtacggcggcatctacatggacaccgacgtgatcagcatcagacccatccccgaggagaacttcctggccgcccaggccagcagatacagcagcaacggcatcttcggcttcctgccccaccaccccttcctgtgggagtgcatggagaacttcgtggagcactacaacagcgccatctggggcaaccagggccccgagctgatgaccagaatgctgagagtgtggtgcaagctggaggacttccaggaggtgagcgacctgagatgcctgaacatcagcttcctgcacccccagagattctaccccatcagctacagagagtggagaagatactacgaggtgtgggacaccgagcccagcttcaacgtgagctacgccctgcacctgtggaaccacatgaaccaggagggcagagccgtgatcagaggcagcaacaccctggtggagaacctgtacagaaagcactgccccagaacctacagagacctgatcaagggccccgagggcagcgtgaccggcgagctgggccccggcaacaagtag

SEQ ID NO: 16338 - DNA, 1518 bp, Artificial Sequence
  Description of Artificial Sequence: Synthetic coding sequence
atggagcagaccgagaagagcaaggtgtacgccgagaacggcctgctggagaagatcaagctgtgcctgagcaagaagcccctgcccagccccaccgagagaaagaagttcgaccacgacttcgccatcagcaccagcttccacggcatccacaacatcgtgcagaacagaagcaagatcagaagagtgctgtggctggtggtggtgctgggcagcgtgagcctggtgacctggcagatctacatcagactgctgaactacttcacctggcccaccaccaccagcatcgaggtgcagtacgtggagaagatggagttccccgccgtgaccttctgcaacctgaacagattccagaccgacgccgtggccaagttcggcgtgatcttcttcctgtggcacatcgtgagcaaggtgctgcacctgcaggagatcaccgccaacagcaccggcagcagagaggccaccgacttcgccgccagccaccagaacttcagcatcgtggagttcatcagaaacaagggcttctacctgaacaacagcaccctgctggactgcgagttcttcggcaagccctgcagccccaaggacttcgcccacgtgttcaccgagtacggcaactgcttcaccttcaaccacggcgagaccctgcaggccaagagaaaggtgagcgtgagcggcagaggcctgagcctgctgttcaacgtgaaccaggaggccttcaccgacaaccccgccctgggcttcgtggacgccggcatcatcttcgtgatccacagccccaagaaggtgccccagttcgacggcctgggcctgctgagccccgtgggcatgcacgccagagtgaccatcagacaggtgaagaccgtgcaccaggagtacccctggggcgagtgcaaccccaacatcaagctgcagaacttcagcagctacagcaccagcggctgcctgaaggagtgcaaggcccagcacatcaagaagcagtgcggctgcgtgcccttcctgctgcccggctacggcatcgagtgcgacctgcagaagtacttcagctgcgtgagccccgtgctggaccacatcgagttcaaggacctgtgcaccgtgggcacccacaacagcagctgccccgtgagctgcgaggagatcgagtaccccgccaccatcagctacagcagcttccccagccagaaggccctgaagtacctgagcaagaagctgaaccagagcagaaagtacatcagagagaacctggtgaagatcgagatcaactacagcgacctgaactacaagatcacccagcagcagaaggccgtgagcgtgagcgagctgctggccgacctgggcggccagctgggcctgttctgcggcgccagcctgatcaccatcatcgagatcatcgagtacctgttcaccaacttctactggatctgcatcttcttcctgctgaagatcagcgagatgacccagtggaccccccccccccagaaccacctgggcaacaagaacagaatcgaggagtgctag

SEQ ID NO: 16339 - DNA, 2973 bp, Artificial Sequence
  Description of Artificial Sequence: Synthetic coding sequence
atgggcccccccagcagcagcggcttctacgtgagcagagccgtggccctgctgctggccggcctggtggccgccctgctgctggccctggccgtgctggccgccctgtacggccactgcgagagagtgccccccagcgagctgcccggcctgagagacctggaggccgagagcagcccccccctgagacagaagcccacccccacccccaagcccagcagcgccagagagctggccgtgaccaccacccccagcaactggagaccccccggcccctgggaccagctgagactgcccccctggctggtgcccctgcactacgacctggagctgtggccccagctgagacccgacgagctgcccgccggcagcctgcccttcaccggcagagtgaacatcaccgtgagatgcaccgtggccaccagcagactgctgctgcacagcctgttccaggactgcgagagagccgaggtgagaggccccctgagccccggcaccggcaacgccaccgtgggcagagtgcccgtggacgacgtgtggttcgccctggacaccgagtacatggtgctggagctgagcgagcccctgaagcccggcagcagctacgagctgcagctgagcttcagcggcctggtgaaggaggacctgagagagggcctgttcctgaacgtgtacaccgaccagggcgagagaagagccctgctggccagccagctggagcccaccttcgccagatacgtgttcccctgcttcgacgagcccgccctgaaggccaccttcaacatcaccatgatccaccaccccagctacgtggccctgagcaacatgcccaagctgggccagagcgagaaggaggacgtgaacggcagcaagtggaccgtgaccaccttcagcaccaccccccacatgcccacctacctggtggccttcgtgatctgcgactacgaccacgtgaacagaaccgagagaggcaaggagatcagaatctgggccagaaaggacgccatcgccaacggcagcgccgacttcgccctgaacatcaccggccccatcttcagcttcctggaggacctgttcaacatcagctacagcctgcccaagaccgacatcatcgccctgcccagcttcgacaaccacgccatggagaactggggcctgatgatcttcgacgagagcggcctgctgctggagcccaaggaccagctgaccgagaagaagaccctgatcagctacgtggtgagccacgagatcggccaccagtggttcggcaacctggtgaccatgaactggtggaacaacatctggctgaacgagggcttcgccagctacttcgagttcgaggtgatcaactacttcaaccccaagctgcccagaaacgagatcttcttcagcaacatcctgcacaacatcctgagagaggaccacgccctggtgaccagagccgtggccatgaaggtggagaacttcaagaccagcgagatccaggagctgttcgacatcttcacctacagcaagggcgccagcatggccagaatgctgagctgcttcctgaacgagcacctgttcgtgagcgccctgaagagctacctgaagaccttcagctacagcaacgccgagcaggacgacctgtggagacacttccagatggccatcgacgaccagagcaccgtgatcctgcccgccaccatcaagaacatcatggacagctggacccaccagagcggcttccccgtgatcaccctgaacgtgagcaccggcgtgatgaagcaggagcccttctacctggagaacatcaagaacagaaccctgctgaccagcaacgacacctggatcgtgcccatcctgtggatcaagaacggcaccacccagcccctggtgtggctggaccagagcagcaaggtgttccccgagatgcaggtgagcgacagcgaccacgactgggtgatcctgaacctgaacatgaccggctactacagagtgaactacgacaagctgggctggaagaagctgaaccagcagctggagaaggaccccaaggccatccccgtgatccacagactgcagctgatcgacgacgccttcagcctgagcaagaacaactacatcgagatcgagaccgccctggagctgaccaagtacctggccgaggaggacgagatcatcgtgtggcacaccgtgctggtgaacctggtgaccagagacctggtgagcgaggtgaacatctacgacatctacagcctgctgaagagatacctgctgaagagactgaacctgatctggaacatctacagcaccatcatcagagagaacgtgctggccctgcaggacgactacctggccctgatcagcctggagaagctgttcgtgaccgcctgctggctgggcctggaggactgcctgcagctgagcaaggagctgttcgccaagtgggtggaccaccccgagaacgagatcccctaccccatcaaggacgtggtgctgtgctacggcatcgccctgggcagcgacaaggagtgggacatcctgctgaacacctacaccaacaccaccaacaaggaggagaagatccagctggcctacgccatgagctgcagcaaggacccctggatcctgaacagatacatggagtacgccatcagcaccagccccttcaccagcaacgagaccaacatcatcgaggtggtggccagcagcgaggtgggcagatacgtggccaaggacttcctggtgaacaactggcaggccgtgagcaagagatacggcacccagagcctgatcaacctgatctacaccatcggcagaaccgtgaccaccgacctgcagatcgtggagctgcagcagttcttcagcaacatgctggaggagcaccagagaatcagagtgcacgccaacctgcagaccatcaagaacgagaacctgaagaacaagaagctgagcgccagaatcgccgcctggctgagaagaaacacctag

SEQ ID NO: 16340 - DNA, 2940 bp, Artificial Sequence
  Description of Artificial Sequence: Synthetic coding sequence
atgggcccccccagcagcagcggcttctacgtgagcagagccgtggccctgctgctggccggcctggtggccgccctgctgctggccctggccgtgctggccgccctgtacggccactgcgagagagtgccccccagcgagctgcccggcctgagagacctggaggccgagagcagcccccccctgagacagaagcccacccccacccccaagcccagcagcgccagagagctggccgtgaccaccacccccagcaactggagaccccccggcccctgggaccagctgagactgcccccctggctggtgcccctgcactacgacctggagctgtggccccagctgagacccgacgagctgcccgccggcagcctgcccttcaccggcagagtgaacatcaccgtgagatgcaccgtggccaccagcagactgctgctgcacagcctgttcctgagccccggcaccggcaacgccaccgtgggcagagtgcccgtggacgacgtgtggttcgccctggacaccgagtacatggtgctggagctgagcgagcccctgaagcccggcagcagctacgagctgcagctgagcttcagcggcctggtgaaggaggacctgagagagggcctgttcctgaacgtgtacaccgaccagggcgagagaagagccctgctggccagccagctggagcccaccttcgccagatacgtgttcccctgcttcgacgagcccgccctgaaggccaccttcaacatcaccatgatccaccaccccagctacgtggccctgagcaacatgcccaagctgggccagagcgagaaggaggacgtgaacggcagcaagtggaccgtgaccaccttcagcaccaccccccacatgcccacctacctggtggccttcgtgatctgcgactacgaccacgtgaacagaaccgagagaggcaaggagatcagaatctgggccagaaaggacgccatcgccaacggcagcgccgacttcgccctgaacatcaccggccccatcttcagcttcctggaggacctgttcaacatcagctacagcctgcccaagaccgacatcatcgccctgcccagcttcgacaaccacgccatggagaactggggcctgatgatcttcgacgagagcggcctgctgctggagcccaaggaccagctgaccgagaagaagaccctgatcagctacgtggtgagccacgagatcggccaccagtggttcggcaacctggtgaccatgaactggtggaacaacatctggctgaacgagggcttcgccagctacttcgagttcgaggtgatcaactacttcaaccccaagctgcccagaaacgagatcttcttcagcaacatcctgcacaacatcctgagagaggaccacgccctggtgaccagagccgtggccatgaaggtggagaacttcaagaccagcgagatccaggagctgttcgacatcttcacctacagcaagggcgccagcatggccagaatgctgagctgcttcctgaacgagcacctgttcgtgagcgccctgaagagctacctgaagaccttcagctacagcaacgccgagcaggacgacctgtggagacacttccagatggccatcgacgaccagagcaccgtgatcctgcccgccaccatcaagaacatcatggacagctggacccaccagagcggcttccccgtgatcaccctgaacgtgagcaccggcgtgatgaagcaggagcccttctacctggagaacatcaagaacagaaccctgctgaccagcaacgacacctggatcgtgcccatcctgtggatcaagaacggcaccacccagcccctggtgtggctggaccagagcagcaaggtgttccccgagatgcaggtgagcgacagcgaccacgactgggtgatcctgaacctgaacatgaccggctactacagagtgaactacgacaagctgggctggaagaagctgaaccagcagctggagaaggaccccaaggccatccccgtgatccacagactgcagctgatcgacgacgccttcagcctgagcaagaacaactacatcgagatcgagaccgccctggagctgaccaagtacctggccgaggaggacgagatcatcgtgtggcacaccgtgctggtgaacctggtgaccagagacctggtgagcgaggtgaacatctacgacatctacagcctgctgaagagatacctgctgaagagactgaacctgatctggaacatctacagcaccatcatcagagagaacgtgctggccctgcaggacgactacctggccctgatcagcctggagaagctgttcgtgaccgcctgctggctgggcctggaggactgcctgcagctgagcaaggagctgttcgccaagtgggtggaccaccccgagaacgagatcccctaccccatcaaggacgtggtgctgtgctacggcatcgccctgggcagcgacaaggagtgggacatcctgctgaacacctacaccaacaccaccaacaaggaggagaagatccagctggcctacgccatgagctgcagcaaggacccctggatcctgaacagatacatggagtacgccatcagcaccagccccttcaccagcaacgagaccaacatcatcgaggtggtggccagcagcgaggtgggcagatacgtggccaaggacttcctggtgaacaactggcaggccgtgagcaagagatacggcacccagagcctgatcaacctgatctacaccatcggcagaaccgtgaccaccgacctgcagatcgtggagctgcagcagttcttcagcaacatgctggaggagcaccagagaatcagagtgcacgccaacctgcagaccatcaagaacgagaacctgaagaacaagaagctgagcgccagaatcgccgcctggctgagaagaaacacctag

SEQ ID NO: 16341 - DNA, 681 bp, Artificial Sequence
  Description of Artificial Sequence: Synthetic coding sequence
atgaaggtggagaacttcaagaccagcgagatccaggagctgttcgacatcttcacctacagcaagggcgccagcatggccagaatgctgagctgcttcctgaacgagcacctgttcgtgagcgccctgaagagctacctgaagaccttcagctacagcaacgccgagcaggacgacctgtggagacacttccagatggccatcgacgaccagagcaccgtgatcctgcccgccaccatcaagaacatcatggacagctggacccaccagagcggcttccccgtgatcaccctgaacgtgagcaccggcgtgatgaagcaggagcccttctacctggagaacatcaagaacagaaccctgctgaccagcaacgacacctggatcgtgcccatcctgtggatcaagaacggcaccacccagcccctggtgtggctggaccagagcagcaaggtgttccccgagatgcaggtgagcgacagcgaccacgactgggtgatcctgaacctgaacatgaccggctactacagagtgaactacgacaagctgggctggaagaagctgaaccagcagctggagaaggaccccaaggccatccccgtgatccacagactgcagctgatcgacgacgccttcagcctgagcaacctgcaggacttcggccacctgaaggtgcccaactag

SEQ ID NO: 16342 - DNA, 519 bp, Artificial Sequence
  Description of Artificial Sequence: Synthetic coding sequence
atgggcgagagcagcgaggacatcgaccagatgttcagcaccctgctgggcgagatggacctgctgacccagagcctgggcgtggacaccctgcccccccccgaccccaacccccccagagccgagttcaactacagcgtgggcttcaaggacctgaacgagagcctgaacgccctggaggaccaggacctggacgccctgatggccgacctggtggccgacatcagcgaggccgagcagagaaccatccaggcccagaaggagagcctgcagaaccagcaccacagcgccagcctgcaggccagcatcttcagcggcgccgccagcctgggctacggcaccaacgtggccgccaccggcatcagccagtacgaggacgacctgccccccccccccgccgaccccgtgctggacctgcccctgcccccccccccccccgagcccctgagccaggtgagcatgtgggaccagagatggcaggaccaccagcccctgctgcccatcaccgacgtgccctag

SEQ ID NO: 16343 - DNA, 2001 bp, Artificial Sequence
  Description of Artificial Sequence: Synthetic coding sequence
atgggcgagagcagcgaggacatcgaccagatgttcagcaccctgctgggcgagatggacctgctgacccagagcctgggcgtggacaccctgcccccccccgaccccaacccccccagagccgagttcaactacagcgtgggcttcaaggacctgaacgagagcctgaacgccctggaggaccaggacctggacgccctgatggccgacctggtggccgacatcagcgaggccgagcagagaaccatccaggcccagaaggagagcctgcagaaccagcaccacagcgccagcctgcaggccagcatcttcagcggcgccgccagcctgggctacggcaccaacgtggccgccaccggcatcagccagtacgaggacgacctgccccccccccccgccgaccccgtgctggacctgcccctgcccccccccccccccgagcccctgagccaggaggaggaggaggcccaggccaaggccgacaagatcaagctggccctggagaagctgaaggaggccaaggtgaagaagctggtggtgaaggtgcacatgaacgacaacagcaccaagagcctgatggtggacgagagacagctggccagagacgtgctggacaacctgttcgagaagacccactgcgactgcaacgtggactggtgcctgtacgagatctaccccgagctgcagatcgagagattcttcgaggaccacgagaacgtggtggaggtgctgagcgactggaccagagacaccgagaacaagatcctgttcctggagaaggaggagaagtacgccgtgttcaagaacccccagaacttctacctggacaacagaggcaagaaggagagcaaggagaccaacgagaagatgaacgccaagaacaaggagagcctgctggaggagagcttctgcggcaccagcatcatcgtgcccgagctggagggcgccctgtacctgaaggaggacggcaagaagagctggaagagaagatacttcctgctgagagccagcggcatctactacgtgcccaagggcaagaccaagaccagcagagacctggcctgcttcatccagttcgagaacgtgaacatctactacggcacccagcacaagatgaagtacaaggcccccaccgactactgcttcgtgctgaagcacccccagatccagaaggagagccagtacatcaagtacctgtgctgcgacgacaccagaaccctgaaccagtgggtgatgggcatcagaatcgccaagtacggcaagaccctgtacgacaactaccagagagccgtggccaaggccggcctggccagcagatggaccaacctgggcaccgtgaacgccgccgcccccgcccagcccagcaccggccccaagaccggcaccacccagcccaacggccagatcccccaggccacccacagcgtgagcgccgtgctgcaggaggcccagagacacgccgagaccagcaaggacaagaagcccgccctgggcaaccaccacgaccccgccgtgcccagagccccccacgcccccaagagcagcctgcccccccccccccccgtgagaagaagcagcgacaccagcggcagccccgccacccccctgaaggccaagggcaccggcggcggcggcctgcccgccccccccgacgacttcctgccccccccccccccccccccccccctggacgaccccgagctgcccccccccccccccgacttcatggagcccccccccgacttcgtgcccccccccccccccagctacgccggcatcgccggcagcgagctgccccccccccccccccccccccccgcccccgcccccgcccccgtgcccgacagcgccagacccccccccgccgtggccaagagaccccccgtgccccccaagagacaggagaaccccggccaccccggcggcgccggcggcggcgagcaggacttcatgagcgacctgatgaaggccctgcagaagaagagaggcaacgtgagctag

SEQ ID NO: 16344 - DNA, 1908 bp, Artificial Sequence
  Description of Artificial Sequence: Synthetic coding sequence
atgggcgagagcagcgaggacatcgaccagatgttcagcaccctgctgggcgagatggacctgctgacccagagcctgggcgtggacaccctgcccccccccgaccccaacccccccagagccgagttcaactacagcgtgggcttcaaggacctgaacgagagcctgaacgccctggaggaccaggacctggacgccctgatggccgacctggtggccgacatcagcgaggccgagcagagaaccatccaggcccagaaggagagcctgcagaaccagcaccacagcgccagcctgcaggccagcatcttcagcggcgccgccagcctgggctacggcaccaacgtggccgccaccggcatcagccagtacgaggacgacctgccccccccccccgccgaccccgtgctggacctgcccctgcccccccccccccccgagcccctgagccaggaggaggaggaggcccaggccaaggccgacaagatcaagctggccctggagaagctgaaggaggccaaggtgaagaagctggtggtgaaggtgcacatgaacgacaacagcaccaagagcctgatggtggacgagagacagctggccagagacgtgctggacaacctgttcgagaagacccactgcgactgcaacgtggactggtgcctgtacgagatctaccccgagctgcagatcgagagattcttcgaggaccacgagaacgtggtggaggtgctgagcgactggaccagagacaccgagaacaagatcctgttcctggagaaggaggagaagtacgccgtgttcaagaacccccagaacttctacctggacaacagaggcaagaaggagagcaaggagaccaacgagaagatgaacgccaagaacaaggagagcctgctggaggagagcttctgcggcaccagcatcatcgtgcccgagctggagggcgccctgtacctgaaggaggacggcaagaagagctggaagagaagatacttcctgctgagagccagcggcatctactacgtgcccaagggcaagaccaagaccagcagagacctggcctgcttcatccagttcgagaacgtgaacatctactacggcacccagcacaagatgaagtacaaggcccccaccgactactgcttcgtgctgaagcacccccagatccagaaggagagccagtacatcaagtacctgtgctgcgacgacaccagaaccctgaaccagtgggtgatgggcatcagaatcgccaagtacggcaagaccctgtacgacaactaccagagagccgtggccaaggccggcctggccagcagatggaccaacctgggcaccgtgaacgccgccgcccccgcccagcccagcaccggccccaagaccggcaccacccagcccaacggccagatcccccaggccacccacagcgtgagcgccgtgctgcaggaggcccagagacacgccgagaccagcaaggacaagaagcccgccctgggcaaccaccacgaccccgccgtgcccagagccccccacgcccccaagagcagcctgcccccccccccccccgtgagaagaagcagcgacaccagcggcagccccgccacccccctgaaggccaagggcaccggcggcggcggcctgcccgccgccagagccagagccagacccagacccagactgagacaggccgcccccagaggcggccaggaggccagctgcgccccccaggaggccagagagcccagagcccccagaagaagcagaagaagaggcgccagattccacgtgagaccccacgagagcttcgccaaggaggagagacagagagtgctgggcaccggcatgatgagcgtgcccgagggcgaggccagcctgacccccagcgccggcttcgccagcagactgccctag

SEQ ID NO: 16345 - DNA, 738 bp, Artificial Sequence
  Description of Artificial Sequence: Synthetic coding sequence
atggccctggtgccctgccaggtgctgagaatggccatcctgctgagctactgcagcatcctgtgcaactacaaggccatcgagatgcccagccaccagacctacggcggcagctggaagttcctgaccttcatcgacctggtgatccaggccgtgttcttcggcatctgcgtgctgaccgacctgagcagcctgctgaccagaggcagcggcaaccaggagcaggagagacagctgaagaagctgatcagcctgagagactggatgctggccgtgctggccttccccgtgggcgtgttcgtggtggccgtgttctggatcatctacgcctacgacagagagatgatctaccccaagctgctggacaacttcatccccggctggctgaaccacggcatgcacaccaccgtgctgcccttcatcctgatcgagatgagaaccagccaccaccagtaccccagcagaagcagcggcctgaccgccatctgcaccttcagcgtgggctacatcctgtgggtgtgctgggtgcaccacgtgaccggcatgtgggtgtaccccttcctggagcacatcggccccggcgccagaatcatcttcttcggcagcaccaccatcctgatgaacttcctgtacctgctgggcgaggtgctgaacaactacatctgggacacccagaagaagccccccagctggcaggacatgaagatcaagttcatgtacctgggccccagcagctag

SEQ ID NO: 16346 - DNA, 561 bp, Artificial Sequence
  Description of Artificial Sequence: Synthetic coding sequence
atggccctggtgccctgccaggtgctgagaatggccatcctgctgagctactgcagcatcctgtgcaactacaaggccatcgagatgcccagccaccagacctacggcggcagctggaagttcctgaccttcatcgacctgttcgtggtggccgtgttctggatcatctacgcctacgacagagagatgatctaccccaagctgctggacaacttcatccccggctggctgaaccacggcatgcacaccaccgtgctgcccttcatcctgatcgagatgagaaccagccaccaccagtaccccagcagaagcagcggcctgaccgccatctgcaccttcagcgtgggctacatcctgtgggtgtgctgggtgcaccacgtgaccggcatgtgggtgtaccccttcctggagcacatcggccccggcgccagaatcatcttcttcggcagcaccaccatcctgatgaacttcctgtacctgctgggcgaggtgctgaacaactacatctgggacacccagaagagcatggaggaggagaaggagaagcccaagctggagtag

SEQ ID NO: 16347 - DNA, 717 bp, Artificial Sequence
  Description of Artificial Sequence: Synthetic coding sequence
atggccctggtgccctgccaggtgctgagaatggccatcctgctgagctactgcagcatcctgtgcaactacaaggccatcgagatgcccagccaccagacctacggcggcagctggaagttcctgaccttcatcgacctggtgatccaggccgtgttcttcggcatctgcgtgctgaccgacctgagcagcctgctgaccagaggcagcggcaaccaggagcaggagagacagctgaagaagctgatcagcctgagagactggatgctggccgtgctggccttccccgtgggcgtgttcgtggtggccgtgttctggatcatctacgcctacgacagagagatgatctaccccaagctgctggacaacttcatccccggctggctgaaccacggcatgcacaccaccgtgctgcccttcatcctgatcgagatgagaaccagccaccaccagtaccccagcagaagcagcggcctgaccgccatctgcaccttcagcgtgggctacatcctgtgggtgtgctgggtgcaccacgtgaccggcatgtgggtgtaccccttcctggagcacatcggccccggcgccagaatcatcttcttcggcagcaccaccatcctgatgaacttcctgtacctgctgggcgaggtgctgaacaactacatctgggacacccagaagagcatggaggaggagaaggagaagcccaagctggagtag

SEQ ID NO: 16348 - DNA, 144 bp, Artificial Sequence
  Description of Artificial Sequence: Synthetic coding sequence
atggccctggtgccctgccaggtgctgagaatggccatcctgctgagctactgcagcatcctgtgcaactacaaggccatcgagatgcccagccaccagacctacggcggcagctggaagttcctgaccttcatcgacctgtag

SEQ ID NO: 16349 - DNA, 405 bp, Artificial Sequence
  Description of Artificial Sequence: Synthetic coding sequence
atggccctggtgccctgccaggtgctgagaatggccatcctgctgagctactgcagcatcctgtgcaactacaaggccatcgagatgcccagccaccagacctacggcggcagctggaagttcctgaccttcatcgacctggtgatccaggccgtgttcttcggcatctgcgtgctgaccgacctgagcagcctgctgaccagaggcagcggcaaccaggagcaggagagacagctgaagaagctgatcagcctgagagactggatgctggccgtgctggccttccccgtgggcgtgttcgtggtggccgtgttctggatcatctacgcctacgacagagagatgatctaccccaagctgctggacaacttcatccccggctggctgaaccacggcatgctgtag

SEQ ID NO: 16350 - DNA, 579 bp, Artificial Sequence
  Description of Artificial Sequence: Synthetic coding sequence
atgaccaaggtgctgagaatggccatcctgctgagctactgcagcatcctgtgcaactacaaggccatcgagatgcccagccaccagacctacggcggcagctggaagttcctgaccttcatcgacctggtgatccaggccgtgttcttcggcatctgcgtgctgaccgacctgagcagcctgctgaccagaggcagcggcaaccaggagcaggagagacagctgaagaagctgatcagcctgagagactggatgctggccgtgctggccttccccgtgggcgtgttcgtggtggccgtgttctggatcatctacgcctacgacagagagatgatctaccccaagctgctggacaacttcatccccggctggctgaaccacggcatgcacaccaccgtgctgcccttcatcctgatcgagatgagaaccagccaccaccagtaccccagcagaagcagcggcctgaccgccatctgcaccttcagcgtgggctacatcctgtgggtgtgctgggtgcaccacgtgaccggcatgtgggtgtaccccttcctggagcacatcggccccggcgccagatag

SEQ ID NO: 16351 - DNA, 705 bp, Artificial Sequence
  Description of Artificial Sequence: Synthetic coding sequence
atgaccaaggtgctgagaatggccatcctgctgagctactgcagcatcctgtgcaactacaaggccatcgagatgcccagccaccagacctacggcggcagctggaagttcctgaccttcatcgacctggtgatccaggccgtgttcttcggcatctgcgtgctgaccgacctgagcagcctgctgaccagaggcagcggcaaccaggagcaggagagacagctgaagaagctgatcagcctgagagactggatgctggccgtgctggccttccccgtgggcgtgttcgtggtggccgtgttctggatcatctacgcctacgacagagagatgatctaccccaagctgctggacaacttcatccccggctggctgaaccacggcatgcacaccaccgtgctgcccttcatcctgatcgagatgagaaccagccaccaccagtaccccagcagaagcagcggcctgaccgccatctgcaccttcagcgtgggctacatcctgtgggtgtgctgggtgcaccacgtgaccggcatgtgggtgtaccccttcctggagcacatcggccccggcgccagaatcatcttcttcggcagcaccaccatcctgatgaacttcctgtacctgctgggcgaggtgctgaacaactacatctgggacacccagaagagcatggaggaggagaaggagaagcccaagctggagtag

SEQ ID NO: 16352 - DNA, 375 bp, Artificial Sequence
  Description of Artificial Sequence: Synthetic coding sequence
atggccctggtgccctgccaggtgctgagaatggccatcctgctgagctactgcagcatcctgtgcaactacaaggccatcgagatgcccagccaccagacctacggcggcagctggaagttcctgaccttcatcgacctgttcgtggtggccgtgttctggatcatctacgcctacgacagagagatgatctaccccaagctgctggacaacttcatccccggctggctgaaccacggcatgcacaccaccgtgctgcccttcatcctgatcgagatgagaaccagccaccaccagtaccccagcagaagcagcggcctgaccgccatctgcaccttcagcgtgggctacatcctgtgggtgtgctgggtgtag

SEQ ID NO: 16353 - DNA, 417 bp, Artificial Sequence
  Description of Artificial Sequence: Synthetic coding sequence
atgctggccgtgctggccttccccgtgggcgtgttcgtggtggccgtgttctggatcatctacgcctacgacagagagatgatctaccccaagctgctggacaacttcatccccggctggctgaaccacggcatgcacaccaccgtgctgcccttcatcctgatcgagatgagaaccagccaccaccagtaccccagcagaagcagcggcctgaccgccatctgcaccttcagcgtgggctacatcctgtgggtgtgctgggtgcaccacgtgaccggcatgtgggtgtaccccttcctggagcacatcggccccggcgccagaatcatcttcttcggcagcaccaccatcctgatgaacttcctgtacctgctgggcgaggtgctgaacaactacatctgggacacccagaagtag

SEQ ID NO: 16354 - DNA, 1305 bp, Artificial Sequence
  Description of Artificial Sequence: Synthetic coding sequence
atggagagcgagagcgagagcggcgccgccgccgacaccccccccctggagaccctgagcttccacggcgacgaggagatcatcgaggtggtggagctggaccccggcccccccgaccccgacgacctggcccaggagatggaggacgtggacttcgaggaggaggaggaggaggagggcaacgaggagggctgggtgctggagccccaggagggcgtggtgggcagcatggagggccccgacgacagcgaggtgaccttcgccctgcacagcgccagcgtgttctgcgtgagcctggaccccaagaccaacaccctggccgtgaccggcggcgaggacgacaaggccttcgtgtggagactgagcgacggcgagctgctgttcgagtgcgccggccacaaggacagcgtgacctgcgccggcttcagccacgacagcaccctggtggccaccggcgacatgagcggcctgctgaaggtgtggcaggtggacaccaaggaggaggtgtggagcttcgaggccggcgacctggagtggatggagtggcaccccagagcccccgtgctgctggccggcaccgccgacggcaacacctggatgtggaaggtgcccaacggcgactgcaagaccttccagggccccaactgccccgccacctgcggcagagtgctgcccgacggcaagagagccgtggtgggctacgaggacggcaccatcagaatctgggacctgaagcagggcagccccatccacgtgctgaagggcaccgagggccaccagggccccctgacctgcgtggccgccaaccaggacggcagcctgatcctgaccggcagcgtggactgccaggccaagctggtgagcgccaccaccggcaaggtggtgggcgtgttcagacccgagaccgtggccagccagcccagcctgggcgagggcgaggagagcgagagcaacagcgtggagagcctgggcttctgcagcgtgatgcccctggccgccgtgggctacctggacggcaccctggccatctacgacctggccacccagaccctgagacaccagtgccagcaccagagcggcatcgtgcagctgctgtgggaggccggcaccgccgtggtgtacacctgcagcctggacggcatcgtgagactgtgggacgccagaaccggcagactgctgaccgactacagaggccacaccgccgagatcctggacttcgccctgagcaaggacgccagcctggtggtgaccaccagcggcgaccacaaggccaaggtgttctgcgtgcagagacccgacagatag

SEQ ID NO: 16355 - DNA, 2721 bp, Artificial Sequence
  Description of Artificial Sequence: Synthetic coding sequence
atgtggagagccaagctgagaagaggcacctgcgagcccgccgtgaaggtggaggaccccctgtgcaacttccacagccccaacttcctgagaatcagcgaggtggagatgagaggcagcgaggacgccgccgccggcaccgtgctgcagagactgatccaggagcagctgagatacggcacccccaccgagaacatgaacctgctggccatccagcaccaggccaccggcagcgccggccccgcccaccccaccaacaacttcagcagcaccgagaacctgacccaggaggacccccagatggtgtaccagagcgccagacaggagccccagggccaggagcaccaggtggacaacaccgtgatggagaagcaggtgagaagcacccagccccagcagaacaacgaggagctgcccacctacgaggaggccaaggcccagagccagttcttcagaggccagcagcagcagcagcagcagcagggcgccgtgggccacggctactacatggccggcggcaccagccagaagagcagaaccgagggcagacccaccgtgaacagagccaacagcggccaggcccacaaggacgaggccctgaaggagctgaagcagggccacgtgagaagcctgagcgagagaatcatgcagctgagcctggagagaaacggcgccaagcagcacctgcccggcagcggcaacggcaagggcttcaaggtgggcggcggccccagccccgcccagcccgccggcaaggtgctggaccccagaggccccccccccgagtaccccttcaagaccaagcagatgatgagccccgtgagcaagacccaggagcacggcctgttctacggcgaccagcaccccggcatgctgcacgagatggtgaagccctaccccgccccccagcccgtgagaaccgacgtggccgtgctgagataccagcccccccccgagtacggcgtgaccagcagaccctgccagctgcccttccccagcaccatgcagcagcacagccccatgagcagccagaccagcagcgccagcggccccctgcacagcgtgagcctgcccctgcccctgcccatggccctgggcgccccccagcccccccccgccgccagccccagccagcagctgggccccgacgccttcgccatcgtggagagagcccagcagatggtggagatcctgaccgaggagaacagagtgctgcaccaggagctgcagggctactacgacaacgccgacaagctgcacaagttcgagaaggagctgcagagaatcagcgaggcctacgagagcctggtgaagagcaccaccaagagagagagcctggacaaggccatgagaaacaagctggagggcgagatcagaagactgcacgacttcaacagagacctgagagacagactggagaccgccaacagacagctgagcagcagagagtacgagggccacgaggacaaggccgccgagggccactacgccagccagaacaaggagttcctgaaggagaaggagaagctggagatggagctggccgccgtgagaaccgccagcgaggaccacagaagacacatcgagatcctggaccaggccctgagcaacgcccaggccagagtgatcaagctggaggaggagctgagagagaagcaggcctacgtggagaaggtggagaagctgcagcaggccctgacccagctgcagagcgcctgcgagaagagagagcagatggagagaagactgagaacctggctggagagagagctggacgccctgagaacccagcagaagcacggcaacggccagcccgccaacatgcccgagtacaacgcccccgccctgctggagctggtgagagagaaggaggagagaatcctggccctggaggccgacatgaccaagtgggagcagaagtacctggaggagagcaccatcagacacttcgccatgaacgccgccgccaccgccgccgccgagagagacaccaccatcatcaaccacagcagaaacggcagctacggcgagagcagcctggaggcccacatctggcaggaggaggaggaggtggtgcaggccaacagaagatgccaggacatggagtacaccatcaagaacctgcacgccaagatcatcgagaaggacgccatgatcaaggtgctgcagcagagaagcagaaaggacgccggcaagaccgacagcagcagcctgagacccgccagaagcgtgcccagcatcgccgccgccaccggcacccacagcagacagaccagcctgaccagcagccagctggccgaggagaagaaggaggagaagacctggaagggcagcatcggcctgctgctgggcaaggagcaccacgagcacgccagcgcccccctgctgccccccccccccaccagcgccctgagcagcatcgccagcaccaccgccgccagcagcgcccacgccaagaccggcagcaaggacagcagcacccagaccgacaagagcgccgagctgttctggcccagcatggccagcctgcccagcagaggcagactgagcaccacccccgcccacagccccgtgctgaagcaccccgccgccaagggcaccgccgagaagctggagaacagccccggccacggcaagagccccgaccacagaggcagagtgagcagcctgctgcacaagcccgagttccccgacggcgagatgatggaggtgctgatctag

SEQ ID NO: 16356 - DNA, 1632 bp, Artificial Sequence
  Description of Artificial Sequence: Synthetic coding sequence
atgtggagagccaagctgagaagaggcacctgcgagcccgccgtgaagggcagccccagcgcctgctacagccccagcagccccgtgcaggtgctggaggacagcacctacttcagccccgacttccagctgtacagcggcagacacgagaccagcgccctgaccgtggaggccaccagcagcatcagagagaaggtggtggaggaccccctgtgcaacttccacagccccaacttcctgagaatcagcgaggtggagatgagaggcagcgaggacgccgccgccggcaccgtgctgcagagactgatccaggagcagctgagatacggcacccccaccgagaacatgaacctgctggccatccagcaccaggccaccggcagcgccggccccgcccaccccaccaacaacttcagcagcaccgagaacctgacccaggaggacccccagatggtgtaccagagcgccagacaggagccccagggccaggagcaccaggtggacaacaccgtgatggagaagcaggtgagaagcacccagccccagcagaacaacgaggagctgcccacctacgaggaggccaaggcccagagccagttcttcagaggccagcagcagcagcagcagcagcagggcgccgtgggccacggctactacatggccggcggcaccagccagaagagcagaaccgagggcagacccaccgtgaacagagccaacagcggccaggcccacaaggacgaggccctgaaggagctgaagcagggccacgtgagaagcctgagcgagagaatcatgcagctgagcctggagagaaacggcgccaagcagcacctgcccggcagcggcaacggcaagggcttcaaggtgggcggcggccccagccccgcccagcccgccggcaaggtgctggaccccagaggccccccccccgagtaccccttcaagaccaagcagatgatgagccccgtgagcaagacccaggagcacggcctgttctacggcgaccagcaccccggcatgctgcacgagatggtgaagccctaccccgccccccagcccgtgagaaccgacgtggccgtgctgagataccagcccccccccgagtacggcgtgaccagcagaccctgccagctgcccttccccagcaccatgcagcagcacagccccatgaacttcagaaccagcctgaccagcagccagctggccgaggagaagaaggaggagaagacctggaagggcagcatcggcctgctgctgggcaaggagcaccacgagcacgccagcgcccccctgctgccccccccccccaccagcgccctgagcagcatcgccagcaccaccgccgccagcagcgcccacgccaagaccggcagcaaggacagcagcacccagaccgacaagagcgccgagctgttctggcccagcatggccagcctgcccagcagaggcagactgagcaccacccccgcccacagccccgtgctgaagcaccccgccgccaagggcaccgccgagaagctggagaacagccccggccacggcaagagccccgaccacagaggcagagtgagcagcctgctgcacaagcccgagttccccgacggcgagatgatggaggtgctgatctag

SEQ ID NO: 16357 - DNA, 2871 bp, Artificial Sequence
  Description of Artificial Sequence: Synthetic coding sequence
atgtggagagccaagctgagaagaggcacctgcgagcccgccgtgaagggcagccccagcgcctgctacagccccagcagccccgtgcaggtgctggaggacagcacctacttcagccccgacttccagctgtacagcggcagacacgagaccagcgccctgaccgtggaggccaccagcagcatcagagagaaggtggtggaggaccccctgtgcaacttccacagccccaacttcctgagaatcagcgaggtggagatgagaggcagcgaggacgccgccgccggcaccgtgctgcagagactgatccaggagcagctgagatacggcacccccaccgagaacatgaacctgctggccatccagcaccaggccaccggcagcgccggccccgcccaccccaccaacaacttcagcagcaccgagaacctgacccaggaggacccccagatggtgtaccagagcgccagacaggagccccagggccaggagcaccaggtggacaacaccgtgatggagaagcaggtgagaagcacccagccccagcagaacaacgaggagctgcccacctacgaggaggccaaggcccagagccagttcttcagaggccagcagcagcagcagcagcagcagggcgccgtgggccacggctactacatggccggcggcaccagccagaagagcagaaccgagggcagacccaccgtgaacagagccaacagcggccaggcccacaaggacgaggccctgaaggagctgaagcagggccacgtgagaagcctgagcgagagaatcatgcagctgagcctggagagaaacggcgccaagcagcacctgcccggcagcggcaacggcaagggcttcaaggtgggcggcggccccagccccgcccagcccgccggcaaggtgctggaccccagaggccccccccccgagtaccccttcaagaccaagcagatgatgagccccgtgagcaagacccaggagcacggcctgttctacggcgaccagcaccccggcatgctgcacgagatggtgaagccctaccccgccccccagcccgtgagaaccgacgtggccgtgctgagataccagcccccccccgagtacggcgtgaccagcagaccctgccagctgcccttccccagcaccatgcagcagcacagccccatgagcagccagaccagcagcgccagcggccccctgcacagcgtgagcctgcccctgcccctgcccatggccctgggcgccccccagcccccccccgccgccagccccagccagcagctgggccccgacgccttcgccatcgtggagagagcccagcagatggtggagatcctgaccgaggagaacagagtgctgcaccaggagctgcagggctactacgacaacgccgacaagctgcacaagttcgagaaggagctgcagagaatcagcgaggcctacgagagcctggtgaagagcaccaccaagagagagagcctggacaaggccatgagaaacaagctggagggcgagatcagaagactgcacgacttcaacagagacctgagagacagactggagaccgccaacagacagctgagcagcagagagtacgagggccacgaggacaaggccgccgagggccactacgccagccagaacaaggagttcctgaaggagaaggagaagctggagatggagctggccgccgtgagaaccgccagcgaggaccacagaagacacatcgagatcctggaccaggccctgagcaacgcccaggccagagtgatcaagctggaggaggagctgagagagaagcaggcctacgtggagaaggtggagaagctgcagcaggccctgacccagctgcagagcgcctgcgagaagagagagcagatggagagaagactgagaacctggctggagagagagctggacgccctgagaacccagcagaagcacggcaacggccagcccgccaacatgcccgagtacaacgcccccgccctgctggagctggtgagagagaaggaggagagaatcctggccctggaggccgacatgaccaagtgggagcagaagtacctggaggagagcaccatcagacacttcgccatgaacgccgccgccaccgccgccgccgagagagacaccaccatcatcaaccacagcagaaacggcagctacggcgagagcagcctggaggcccacatctggcaggaggaggaggaggtggtgcaggccaacagaagatgccaggacatggagtacaccatcaagaacctgcacgccaagatcatcgagaaggacgccatgatcaaggtgctgcagcagagaagcagaaaggacgccggcaagaccgacagcagcagcctgagacccgccagaagcgtgcccagcatcgccgccgccaccggcacccacagcagacagaccagcctgaccagcagccagctggccgaggagaagaaggaggagaagacctggaagggcagcatcggcctgctgctgggcaaggagcaccacgagcacgccagcgcccccctgctgccccccccccccaccagcgccctgagcagcatcgccagcaccaccgccgccagcagcgcccacgccaagaccggcagcaaggacagcagcacccagaccgacaagagcgccgagctgttctggcccagcatggccagcctgcccagcagaggcagactgagcaccacccccgcccacagccccgtgctgaagcaccccgccgccaagggcaccgccgagaagctggagaacagccccggccacggcaagagccccgaccacagaggcagagtgagcagcctgctgcacaagcccgagttccccgacggcgagatgatggaggtgctgatctag

SEQ ID NO: 16358 - DNA, 1836 bp, Artificial Sequence
  Description of Artificial Sequence: Synthetic coding sequence
accagccacgacagactgatgtggagagccaagctgagaagaggcacctgcgagcccgccgtgaagggcagccccagcgcctgctacagccccagcagccccgtgcaggtgctggaggacagcacctacttcagccccgacttccagctgtacagcggcagacacgagaccagcgccctgaccgtggaggccaccagcagcatcagagagaaggtggtggaggaccccctgtgcaacttccacagccccaacttcctgagaatcagcgaggtggagatgagaggcagcgaggacgccgccgccggcaccgtgctgcagagactgatccaggagcagctgagatacggcacccccaccgagaacatgaacctgctggccatccagcaccaggccaccggcagcgccggccccgcccaccccaccaacaacttcagcagcaccgagaacctgacccaggaggacccccagatggtgtaccagagcgccagacaggagccccagggccaggagcaccaggtggacaacaccgtgatggagaagcaggtgagaagcacccagccccagcagaacaacgaggagctgcccacctacgaggaggccaaggcccagagccagttcttcagaggccagcagcagcagcagcagcagcagggcgccgtgggccacggctactacatggccggcggcaccagccagaagagcagaaccgagggcagacccaccgtgaacagagccaacagcggccaggcccacaaggacgaggccctgaaggagctgaagcagggccacgtgagaagcctgagcgagagaatcatgcagctgagcctggagagaaacggcgccaagcagcacctgcccggcagcggcaacggcaagggcttcaaggtgggcggcggccccagccccgcccagcccgccggcaaggtgctggaccccagaggccccccccccgagtaccccttcaagaccaagcagatgatgagccccgtgagcaagacccaggagcacggcctgttctacggcgaccagcaccccggcatgctgcacgagatggtgaagccctaccccgccccccagcccgtgagaaccgacgtggccgtgctgagataccagcccccccccgagtacggcgtgaccagcagaccctgccagctgcccttccccagcaccatgcagcagcacagccccatgagcagccagaccagcagcgccagcggccccctgcacagcgtgagcctgcccctgcccctgcccatggccctgggcgccccccagcccccccccgccgccagccccagccagcagctgggccccgacgccttcgccatcgtggagagagcccagcagatggtggagatcctgaccgaggagaacagagtgctgcaccaggagctgcagggctactacgacaacgccgacaagctgcacaagttcgagaaggagctgcagagaatcagcgaggcctacgagagcctggtgaagagcaccaccaagagagagagcctggacaaggccatgagaaacaagctggagggcgagatcagaagactgcacgacttcaacagagacctgagagacagactggagaccgccaacagacagctgagcagcagagagtacgagggccacgaggacaaggccgccgagggccactacgccagccagaacaaggagttcctgaaggagaaggagaagctggagatggagctggccgccgtgagaaccgccagcgaggaccacagaagacacatcgagatcctggaccaggccctgagcaacgcccaggccagacaccaggccggcagaggcgtgaccagagaggccagcatctgctag

SEQ ID NO: 16359 - DNA, 2343 bp, Artificial Sequence
  Description of Artificial Sequence: Synthetic coding sequence
atgagaaccctggaggacagcagcggcaccgtgctgcacagactgatccaggagcagctgagatacggcaacctgaccgagaccagaaccctgctggccatccagcagcaggccctgagaggcggcgccggcaccggcggcaccggcagcccccaggccagcctggagatcctggcccccgaggacagccaggtgctgcagcaggccaccagacaggagccccagggccaggagcaccagggcggcgagaaccacctggccgagaacaccctgtacagactgtgcccccagcccagcaagggcgaggagctgcccacctacgaggaggccaaggcccacagccagtactacgccgcccagcaggccggcaccagaccccacgccggcgacagagaccccagaggcgcccccggcggcagcagaagacaggacgaggccctgagagagctgagacacggccacgtgagaagcctgagcgagagactgctgcagctgagcctggagagaaacggcgccagagcccccagccacatgagcagcagccacagcttcccccagctggccagaaaccagcagggcccccccctgagaggcccccccgccgagggccccgagagcagaggcccccccccccagtacccccacgtggtgctggcccacgagaccaccaccgccgtgaccgaccccagatacagagccagaggcagcccccacttccagcacgccgaggtgagaatcctgcaggcccaggtgccccccgtgttcctgcagcagcagcagcagtaccagtacctgcagcagagccaggagcaccccccccccccccaccccgccgccctgggccacggccccctgagcagcctgagcccccccgccgtggagggccccgtgagcgcccaggccagcagcgccaccagcggcagcgcccacctggcccagatggaggccgtgctgagagagaacgccagactgcagagagacaacgagagactgcagagagagctggagagcagcgccgagaaggccggcagaatcgagaagctggagagcgagatccagagactgagcgaggcccacgagagcctgaccagagccagcagcaagagagaggccctggagaagaccatgagaaacaagatggacagcgagatgagaagactgcaggacttcaacagagacctgagagagagactggagagcgccaacagaagactggccagcaagacccaggaggcccaggccggcagccaggacatggtggccaagctgctggcccagagctacgagcagcagcaggagcaggagaagctggagagagagatggccctgctgagaggcgccatcgaggaccagagaagaagagccgagctgctggagcaggccctgggcaacgcccagggcagagccgccagagccgaggaggagctgagaaagaagcaggcctacgtggagaaggtggagagactgcagcaggccctgggccagctgcaggccgcctgcgagaagagagagcagctggagctgagactgagaaccagactggagcaggagctgaaggccctgagagcccagcagagacaggccggcgcccccggcggcagcagcggcagcggcggcagccccgagctgagcgccctgagactgagcgagcagctgagagagaaggaggagcagatcctggccctggaggccgacatgaccaagtgggagcagaagtacctggaggagagagccatgagacagttcgccatggacgccgccgccaccgccgccgcccagagagacaccaccctgatcagacacagcccccagcccagccccagcagcagcttcaacgagggcctgctgaccggcggccacagacaccaggagatggagagcagactgaaggtgctgcacgcccagatcctggagaaggacgccgtgatcaaggtgctgcagcagagaagcagaagagaccccggcaaggccatccagggcagcctgagacccgccaagagcgtgcccagcgtgttcgccgccgccgccgccggcacccagggctggcagggcctgagcagcagcgagagacagaccgccgacgcccccgccagactgaccaccgccgacagagcccccaccgaggagcccgtggtgaccgccccccccgccgcccacgccaagcacggcagcagagacggcagcacccagaccgagggcccccccgacagcaccagcacctgcctgccccccgagcccgacagcctgctgggctgcagcagcagccagagagccgccagcctggacagcgtggccaccagcagagtgcaggacctgagcgacatggtggagatcctgatctag

SEQ ID NO: 16360 - DNA, 2340 bp, Artificial Sequence
  Description of Artificial Sequence: Synthetic coding sequence
atgagaaccctggaggacagcagcggcaccgtgctgcacagactgatccaggagcagctgagatacggcaacctgaccgagaccagaaccctgctggccatccagcagcaggccctgagaggcggcgccggcaccggcggcaccggcagcccccaggccagcctggagatcctggcccccgaggacagccaggtgctgcagcaggccaccagacaggagccccagggccaggagcaccagggcggcgagaaccacctggccgagaacaccctgtacagactgtgcccccagcccagcaagggcgaggagctgcccacctacgaggaggccaaggcccacagccagtactacgccgcccagcaggccggcaccagaccccacgccggcgacagagaccccagaggcgcccccggcggcagcagaagacaggacgaggccctgagagagctgagacacggccacgtgagaagcctgagcgagagactgctgcagctgagcctggagagaaacggcgccagagcccccagccacatgagcagcagccacagcttcccccagctggccagaaaccagcagggcccccccctgagaggcccccccgccgagggccccgagagcagaggcccccccccccagtacccccacgtggtgctggcccacgagaccaccaccgccgtgaccgaccccagatacagagccagaggcagcccccacttccagcacgccgaggtgagaatcctgcaggcccaggtgccccccgtgttcctgcagcagcagcagcagtaccagtacctgcagcagagccaggagcaccccccccccccccaccccgccgccctgggccacggccccctgagcagcctgagcccccccgccgtggagggccccgtgagcgcccaggccagcagcgccaccagcggcagcgcccacctggcccagatggaggccgtgctgagagagaacgccagactgcagagagacaacgagagactgcagagagagctggagagcagcgccgagaaggccggcagaatcgagaagctggagagcgagatccagagactgagcgaggcccacgagagcctgaccagagccagcagcaagagagaggccctggagaagaccatgagaaacaagatggacagcgagatgagaagactgcaggacttcaacagagacctgagagagagactggagagcgccaacagaagactggccagcaagacccaggaggcccaggccggcagccaggacatggtggccaagctgctggcccagagctacgagcagcagcaggagcaggagaagctggagagagagatggccctgctgagaggcgccatcgaggaccagagaagaagagccgagctgctggagcaggccctgggcaacgcccagggcagagccgccagagccgaggaggagctgagaaagaagcaggcctacgtggagaaggtggagagactgcagcaggccctgggccagctgcaggccgcctgcgagaagagagagcagctggagctgagactgagaaccagactggagcaggagctgaaggccctgagagcccagcagagacaggccggcgcccccggcggcagcagcggcagcggcggcagccccgagctgagcgccctgagactgagcgagcagctgagagagaaggaggagcagatcctggccctggaggccgacatgaccaagtgggagcagaagtacctggaggagagagccatgagacagttcgccatggacgccgccgccaccgccgccgcccagagagacaccaccctgatcagacacagcccccagcccagccccagcagcagcttcaacgagggcctgctgaccggcggccacagacaccaggagatggagagcagactgaaggtgctgcacgcccagatcctggagaaggacgccgtgatcaaggtgctgcagcagagaagcagaagagaccccggcaaggccatccagggcagcctgagacccgccaagagcgtgcccagcgtgttcgccgccgccgccgccggcacccagggctggcagggcctgagcagcagcgagagacagaccgccgacgcccccgccagactgaccaccgacagagcccccaccgaggagcccgtggtgaccgccccccccgccgcccacgccaagcacggcagcagagacggcagcacccagaccgagggcccccccgacagcaccagcacctgcctgccccccgagcccgacagcctgctgggctgcagcagcagccagagagccgccagcctggacagcgtggccaccagcagagtgcaggacctgagcgacatggtggagatcctgatctag

SEQ ID NO: 16361 - DNA, 102 bp, Artificial Sequence
  Description of Artificial Sequence: Synthetic coding sequence
atgagaaccctggaggacagcagcggcaccgtgctgcacagactgatccaggagcagctgagatacggcaacctgaccgagaccagaaccctgctggcctag

SEQ ID NO: 16362 - DNA, 456 bp, Artificial Sequence
  Description of Artificial Sequence: Synthetic coding sequence
atgagaaccctggaggacagcagcggcaccgtgctgcacagactgatccaggagcagctgagatacggcaacctgaccgagaccagaaccctgctggccatccagcagcaggccctgagaggcggcgccggcaccggcggcaccggcagcccccaggccagcctggagatcctggcccccgaggacagccaggtgctgcagcaggccaccagacaggagccccagggccaggagcaccagggcggcgagaaccacctggccgagaacaccctgtacagactgtgcccccagcccagcaagggcgaggagctgcccacctacgaggaggccaaggcccacagccagtactacgccgcccagcaggccggcaccagaccccacgccggcgacagagaccccagaggcgcccccggcggcagcagaagacaggacgaggccctgagagagctgagatag

SEQ ID NO: 16363 - DNA, 435 bp, Artificial Sequence
  Description of Artificial Sequence: Synthetic coding sequence
atgagaaccctggaggacagcagcggcaccgtgctgcacagactgatccaggagcagctgagatacggcaacctgaccgagaccagaaccctgctggccatccagcagcaggccctgagaggcggcgccggcaccggcggcaccggcagcccccaggccagcctggagatcctggcccccgaggacagccaggtgctgcagcaggccaccagacaggagccccagggccaggagcaccagggcggcgagaaccacctggccgagaacaccctgtacagactgtgcccccagcccagcaagggcgaggagctgcccacctacgaggaggccaaggcccacagccagtactacgccgcccagcaggccggcaccagaccccacgccggcgacagagaccccagaggcgcccccggcggcagcagaagacaggactag

SEQ ID NO: 16364 - DNA, 384 bp, Artificial Sequence
  Description of Artificial Sequence: Synthetic coding sequence
atgagaaccctggaggacagcagcggcaccgtgctgcacagactgatccaggagcagctgagatacggcaacctgaccgagaccagaaccctgctggccatccagcagcaggccctgagaggcggcgccggcaccggcggcaccggcagcccccaggccagcctggagatcctggcccccgaggacagccaggtgctgcagcaggccaccagacaggagccccagggccaggagcaccagggcggcgagaaccacctggccgagaacaccctgtacagactgtgcccccagcccagcaagggcgaggagctgcccacctacgaggaggccaaggcccacagccagtactacgccgcccagcaggccggcaccagaccccactag

SEQ ID NO: 16365 - DNA, 597 bp, Artificial Sequence
  Description of Artificial Sequence: Synthetic coding sequence
atgagaaccctggaggacagcagcggcaccgtgctgcacagactgatccaggagcagctgagatacggcaacctgaccgagaccagaaccctgctggccatccagcagcaggccctgagaggcggcgccggcaccggcggcaccggcagcccccaggccagcctggagatcctggcccccgaggacagccaggtgctgcagcaggccaccagacaggagccccagggccaggagcaccagggcggcgagaaccacctggccgagaacaccctgtacagactgtgcccccagcccagcaagggcgaggagctgcccacctacgaggaggccaaggcccacagccagtactacgccgcccagcaggccggcaccagaccccacgccggcgacagagaccccagaggcgcccccggcggcagcagaagacaggacgaggccctgagagagctgagacacggccacgtgagaagcctgagcgagagactgctgcagctgagcctggagagaaacggcgccagagcccccagccacatgagcagcagccacagcttcccccagctggccagaaaccagcagggcccccccctgagaggctag

SEQ ID NO: 16366 - DNA, 2334 bp, Artificial Sequence
  Description of Artificial Sequence: Synthetic coding sequence
atgagaaccctggaggacagcagcggcaccgtgctgcacagactgatccaggagcagctgagatacggcaacctgaccgagaccagaaccctgctggccatccagcagcaggccctgagaggcggcgccggcaccggcggcaccggcagcccccaggccagcctggagatcctggcccccgaggacagccaggtgctgcagcaggccaccagacaggagccccagggccaggagcaccagggcggcgagaaccacctggccgagaacaccctgtacagactgtgcccccagcccagcaagggcgaggagctgcccacctacgaggaggccaaggcccacagccagtactacgccgcccagcaggccggcaccagaccccacgccggcgacagagaccccagaggcgcccccggcggcagcagaagacaggacgaggccctgagagagctgagacacggccacgtgagaagcctgagcgagagactgctgcagctgagcctggagagaaacggcgccagagcccccagccacatgagcagcagccacagcttcccccagctggccagaaaccagcagggcccccccctgagaggcccccccgccgagggccccgagagcagaggcccccccccccagtacccccacgtggtgctggcccacgagaccaccaccgccgtgaccgaccccagatacagagccagaggcagcccccacttccagcacgccgaggtgagaatcctgcaggcccaggtgccccccgtgttcctgcagcagcagcagcagtaccagtacctgcagcagagccaggagcaccccccccccccccaccccgccgccctgggccacggccccctgagcagcctgagcccccccgccgtggagggccccgtgagcgcccaggccagcagcgccaccagcggcagcgcccacctggcccagatggaggccgtgctgagagagaacgccagactgcagagagacaacgagagactgcagagagagctggagagcagcgccgagaaggccggcagaatcgagaagctggagagcgagatccagagactgagcgaggcccacgagagcctgaccagagccagcagcaagagagaggccctggagaagaccatgagaaacaagatggacagcgagatgagaagactgcaggacttcaacagagacctgagagagagactggagagcgccaacagaagactggccagcaagacccaggaggcccaggccggcagccaggacatggtggccaagctgctggcccagagctacgagcagcagcaggagcaggagaagctggagagagagatggccctgctgagaggcgccatcgaggaccagagaagaagagccgagctgctggagcaggccctgggcaacgcccagggcagagccgccagagccgaggaggagctgagaaagaagcaggcctacgtggagaaggtggagagactgcagcaggccctgggccagctgcaggccgcctgcgagaagagagagcagctggagctgagactgagaaccagactggagcaggagctgaaggccctgagagcccagcaggccggcgcccccggcggcagcagcggcagcggcggcagccccgagctgagcgccctgagactgagcgagcagctgagagagaaggaggagcagatcctggccctggaggccgacatgaccaagtgggagcagaagtacctggaggagagagccatgagacagttcgccatggacgccgccgccaccgccgccgcccagagagacaccaccctgatcagacacagcccccagcccagccccagcagcagcttcaacgagggcctgctgaccggcggccacagacaccaggagatggagagcagactgaaggtgctgcacgcccagatcctggagaaggacgccgtgatcaaggtgctgcagcagagaagcagaagagaccccggcaaggccatccagggcagcctgagacccgccaagagcgtgcccagcgtgttcgccgccgccgccgccggcacccagggctggcagggcctgagcagcagcgagagacagaccgccgacgcccccgccagactgaccaccgacagagcccccaccgaggagcccgtggtgaccgccccccccgccgcccacgccaagcacggcagcagagacggcagcacccagaccgagggcccccccgacagcaccagcacctgcctgccccccgagcccgacagcctgctgggctgcagcagcagccagagagccgccagcctggacagcgtggccaccagcagagtgcaggacctgagcgacatggtggagatcctgatctag

SEQ ID NO: 16367 - DNA, 2514 bp, Artificial Sequence
  Description of Artificial Sequence: Synthetic coding sequence
atgaccggcagaaaggccagcggcggcaccccctgcaccctgagaaagggcgcccccatcatcaccctgggcaagaactggaccgagagactggccgccggcgacagcgtgggctgcagcggcgccagatgccacagacccctgagcagacagctgtgcgccagccagagaagcatgagaaccctggaggacagcagcggcaccgtgctgcacagactgatccaggagcagctgagatacggcaacctgaccgagaccagaaccctgctggccatccagcagcaggccctgagaggcggcgccggcaccggcggcaccggcagcccccaggccagcctggagatcctggcccccgaggacagccaggtgctgcagcaggccaccagacaggagccccagggccaggagcaccagggcggcgagaaccacctggccgagaacaccctgtacagactgtgcccccagcccagcaagggcgaggagctgcccacctacgaggaggccaaggcccacagccagtactacgccgcccagcaggccggcaccagaccccacgccggcgacagagaccccagaggcgcccccggcggcagcagaagacaggacgaggccctgagagagctgagacacggccacgtgagaagcctgagcgagagactgctgcagctgagcctggagagaaacggcgccagagcccccagccacatgagcagcagccacagcttcccccagctggccagaaaccagcagggcccccccctgagaggcccccccgccgagggccccgagagcagaggcccccccccccagtacccccacgtggtgctggcccacgagaccaccaccgccgtgaccgaccccagatacagagccagaggcagcccccacttccagcacgccgaggtgagaatcctgcaggcccaggtgccccccgtgttcctgcagcagcagcagcagtaccagtacctgcagcagagccaggagcaccccccccccccccaccccgccgccctgggccacggccccctgagcagcctgagcccccccgccgtggagggccccgtgagcgcccaggccagcagcgccaccagcggcagcgcccacctggcccagatggaggccgtgctgagagagaacgccagactgcagagagacaacgagagactgcagagagagctggagagcagcgccgagaaggccggcagaatcgagaagctggagagcgagatccagagactgagcgaggcccacgagagcctgaccagagccagcagcaagagagaggccctggagaagaccatgagaaacaagatggacagcgagatgagaagactgcaggacttcaacagagacctgagagagagactggagagcgccaacagaagactggccagcaagacccaggaggcccaggccggcagccaggacatggtggccaagctgctggcccagagctacgagcagcagcaggagcaggagaagctggagagagagatggccctgctgagaggcgccatcgaggaccagagaagaagagccgagctgctggagcaggccctgggcaacgcccagggcagagccgccagagccgaggaggagctgagaaagaagcaggcctacgtggagaaggtggagagactgcagcaggccctgggccagctgcaggccgcctgcgagaagagagagcagctggagctgagactgagaaccagactggagcaggagctgaaggccctgagagcccagcagagacaggccggcgcccccggcggcagcagcggcagcggcggcagccccgagctgagcgccctgagactgagcgagcagctgagagagaaggaggagcagatcctggccctggaggccgacatgaccaagtgggagcagaagtacctggaggagagagccatgagacagttcgccatggacgccgccgccaccgccgccgcccagagagacaccaccctgatcagacacagcccccagcccagccccagcagcagcttcaacgagggcctgctgaccggcggccacagacaccaggagatggagagcagactgaaggtgctgcacgcccagatcctggagaaggacgccgtgatcaaggtgctgcagcagagaagcagaagagaccccggcaaggccatccagggcagcctgagacccgccaagagcgtgcccagcgtgttcgccgccgccgccgccggcacccagggctggcagggcctgagcagcagcgagagacagaccgccgacgcccccgccagactgaccaccgacagagcccccaccgaggagcccgtggtgaccgccccccccgccgcccacgccaagcacggcagcagagacggcagcacccagaccgagggcccccccgacagcaccagcacctgcctgccccccgagcccgacagcctgctgggctgcagcagcagccagagagccgccagcctggacagcgtggccaccagcagagtgcaggacctgagcgacatggtggagatcctgatctag

SEQ ID NO: 16368 - DNA, 372 bp, Artificial Sequence
  Description of Artificial Sequence: Synthetic coding sequence
atgagaaccctggaggacagcagcggcaccgtgctgcacagactgatccaggagcagctgagatacggcaacctgaccgagaccagaaccctgctggccatccagcagcaggccctgagaggcggcgccggcaccggcggcaccggcagcccccaggccagcctggagatcctggcccccgaggacagccaggtgctgcagcaggccaccagacaggagccccagggccaggagcaccagggcggcgagaaccacctggccgagaacaccctgtacagactgtgcccccagcccagcaagggcgaggagctgcccacctacgaggaggccaaggcccacagccagtactacgccgcccagcaggccggctag

SEQ ID NO: 16369 - DNA, 480 bp, Artificial Sequence
  Description of Artificial Sequence: Synthetic coding sequence
atggagctgcccgccgtgaacctgaaggtgatcctgctgggccactggctgctgaccacctggggctgcatcgtgttcagcggcagctacgcctgggccaacttcaccatcctggccctgggcgtgtgggccgtggcccagagagacagcatcgacgccatcagcatgttcctgggcggcctgctggccaccatcttcctggacatcgtgcacatcagcatcttctaccccagagtgagcctgaccgacaccggcagattcggcgtgggcatggccatcctgagcctgctgctgaagcccctgagctgctgcttcgtgtaccacatgtacagagagagaggcggcgagctgctggtgcacaccggcttcctgggcagcagccaggacagaagcgcctaccagaccatcgacagcgccgaggcccccgccgaccccttcgccgtgcccgagggcagaagccaggacgccagaggctactag

SEQ ID NO: 16370 - DNA, 459 bp, Artificial Sequence
  Description of Artificial Sequence: Synthetic coding sequence
atggagctgcccgccgtgaacctgaaggtgatcctgctgggccactggctgctgaccacctggggctgcatcgtgttcagcggcagctacgcctgggccaacttcaccatcctggccctgggcgtgtgggccgtggcccagagagacagcatcgacgccatcagcatgttcctgggcggcctgctggccaccatcttcctggacatcgtgcacatcagcatcttctaccccagagtgagcctgaccgacaccggcagattcggcgtgggcatggccatcctgagcctgctgctgaagcccctgagctgctgcttcgtgtaccacatgtacagagagagaggcggcttcctgggcagcagccaggacagaagcgcctaccagaccatcgacagcgccgaggcccccgccgaccccttcgccgtgcccgagggcagaagccaggacgccagaggctactag

SEQ ID NO: 16371 - DNA, 336 bp, Artificial Sequence
  Description of Artificial Sequence: Synthetic coding sequence
atggagctgcccgccgtgaacctgaagggcctgcactgcatcctgagactgctgtgcctgggccagctgcaccaccccggcctgggcagagtgggctgcggcagcgccggcctgcacagaagacacaagcacgtgagcggctggctggccggccaccacctgcccggccacagagcccaccagcacctgctgcccgccggccagccccacggccacggccccctgtggagaggccacggccacccccagctggccgcccaggccgccctgctgctgctgagactgccccacgtgcccggcgccagaggcttcccctgggtgttcagcggcccctag

SEQ ID NO: 16372 - DNA, 444 bp, Artificial Sequence
  Description of Artificial Sequence: Synthetic coding sequence
atggagctgcccgccgtgaacctgaaggtgatcctgctgggccactggctgctgaccacctgcttctggagacacttcagcgccaagcccagactggagaccatcgagctgacctgcgccctgtgcaagctgagaagcgccgcccacagagccaccgccggcctgcactgcatcctgagactgctgtgcctgggccagctgcaccaccccggcctgggcagagtgggctgcggcagcgccggcctgcacagaagacacaagcacgtgagcggctggctggccggccaccacctgcccggccacagagcccaccagcacctgctgcccgccggccagccccacggccacggccccctgtggagaggccacggccacccccagctggccgcccaggccgccctgctgctgctgagactgccccacgtgcccggcgccagaggctag

SEQ ID NO: 16373 - DNA, 468 bp, Artificial Sequence
  Description of Artificial Sequence: Synthetic coding sequence
atggagctgcccgccgtgaacctgaaggtgatcctgctgggccactggctgctgaccacctgcttctggagacacttcagcgccaagcccagactggagaccatcgagctgacctgcgccctgtgcaagctgagaagcgccgcccacagagccaccgccggcctgcactgcatcctgagactgctgtgcctgggccagctgcaccaccccggcctgggcagagtgggctgcggcagcgccggcctgcacagaagacacaagcacgtgagcggctggctggccggccaccacctgcccggccacagagcccaccagcacctgctgcccgccggccagccccacggccacggccccctgtggagaggccacggccacccccagctggccgcccaggccgccctgctgctgctgagactgccccacgtgcccggcgccagaggcttcccctgggtgttcagcggcccctag

SEQ ID NO: 16374 - DNA, 2406 bp, Artificial Sequence
  Description of Artificial Sequence: Synthetic coding sequence
atgaagtacgccgagaacatcatgctgaagctgaccttcagcaccacccagatccagcagtacgagaacgtgttcatcttcgagaccggctactggctgaccaacgccatcaagtacaaccaggactacctggacatctgcacctaccagagactgcagcagagactgtacctgcagaagaagatcatccagaagcacttcgagaagaagaaggacatcagaagaggcatcggctacctgaagctgatctgcttcctgatccccttcctgctgagcctgaagaagaagatgaaggtgccctacctgagcagcctgctgcagcccttcagcgacgacaaggtgaagaccgagagagagctgccccccttcatctacggcagagacttcaagtgccagaacttccactacaaggagaaccagtacttccacgtgcacggcggcatcgagttcgacatcagcacccccagcatcgagaacgccctggaggacttccagaagaacctggagaagatcagagactgcgccgccaacaccttcatcgaggacagcggctacaaggagtactacagcatccccgtgatggagttccacggcaagagctactacgtgatctacttcgagctggagaccttctaccagcagctgtacaagacccagtggtggggcgccatcaacgagatcgtgaacaacctgagactgaagagactgcccctgaccgacgcccagctgcacgagcagttcaagaagaagctgggcttcaagagagccatgaagtgcaagagcatccccttcggcatgaagagcgccgtggagagaggcctgagcgccgtgttccacaccttcagcagaaagaccagcagcagcaccatcaacgtgagcgacgaggccggctacaccatcttccaccacgccgccctgcacaacagagtgagcatcatctgccagctgtgcaacgccaacttcaaggtgaaccagagaagattcgtgaccttcagccagggccccacccccctgcacctggccgcccaggcctgcagcctggagaccaccgtgtgcctgctgtgcagcaaggccgactacaccctgagcgagaagagaggctggatgcccatccacttcgccgccttctacgacaacgtgtgcatcatcatcgccctgtgcagaaaggaccccagcctgctggaggccgaggccaccgccgagaaccagtgcacccccctgctgctggccgccaccagcggcgccctggacaccatccagtacctgttcagcatcggcgccaactggagaaagaccgacatcaagggcaacaacatcatccacctgagcgtgctgaccttccacaccgaggtgctgaagtacatcatcaagctgaacatccccgagctgcccgtgtggaagaccctggtggagatgctgcagtgcgagagctacaagagaagaatgatggccgtgatgagcctggaggtgatctgcctggccaacgaccagtactggagatgcatcctggacgccggcaccatccccgccctgatcaacctgctgaagagcagcaagatcaagctgcagtgcaagaccgtgggcctgctgagcaacatcagcacccacaagagcgccgtgcacgccctggtggaggccggcggcatccccagcctgatcaacctgctggtgtgcgacgagcccgaggtgcacagcagatgcgccgtgatcctgtacgacatcgcccagtgcgagaacaaggacgtgatcgccaagtacaacggcatccccagcctgatcaacctgctgaacctgaacatcgagaacgtgctggtgaacgtgatgaactgcatcagagtgctgtgcatcggcaacgagaacaaccagagagccgtgagagagcacaagggcctgccctacctgatcagattcctgagcagcgacagcggcctgttcaacctgttcctgaacagcttcgaggacgtgctgaaggccgtgagcagcgccgccatcgccgaggtgggcagagacaacaaggagatccaggacgccatcgccatggagggcgccatcccccccctggtggccctgttcaagggcaagcagatcagcgtgcagatgaagggcgccatggccgtggagagcctggccagccacaacgccctgatccagaaggccttcctggagaagagcctgaccaagtacctgctgaagctgctgaaggccttccagatcgacgtgaaggagcagggcgccgtggccctgtgggccctggccggccagaccctgaagcagcagaagtacatggccgagcagatcggctacagcttcatcatcaacatgctgctgagccccagcgccaagatgcagtacgtgggctacctgctgaagagcagactgtgcatcaacaccttctgcctgcagtag

SEQ ID NO: 16375 - DNA, 4305 bp, Artificial Sequence
  Description of Artificial Sequence: Synthetic coding sequence
atgctgagactgcccaagaagggcctgcccagattcgagcaggtgcaggacgaggacacctacctggagaacctggccatccagagaaacgccagcgccttcttcgagaagtacgacagaagcgagatccaggagctgctgaccaccgccctggtgagctggctgagcgccaaggaggacgtgagaagccaggtggacctgccctgcggcatcatgagccagatgaacaacgtgggcttcagcaccgccatcctgctgacccccgtggaccccaccgccctgctggactacagagaggtgcaccagatgatcagagagctggccatcggcatctactgcctgaaccagatccccagcatcagcctggaggccaactacgaccagagcagcagctgccagctgccccccgcctactacgacaccagaatcggccagatcctgatcaacatcgactacatgctgaaggccctgtggcacggcatctacatgcccaaggagaagagagccagattcagcgagctgtggagagccatcatggacatcgaccccgacggcaagccccagaccaacaaggacatcttcagcgagttcagcagcgccggcctgaccgacatcaccaaggaccccgacttcaacgagatctacgacgaggacgtgaacgaggaccccacctacgaccccaacagccccgaggagaccgccgtgttcatgaagtacgccgagaacatcatgctgaagctgaccttcagcaccacccagatccagcagtacgagaacgtgttcatcttcgagaccggctactggctgaccaacgccatcaagtacaaccaggactacctggacatctgcacctaccagagactgcagcagagactgtacctgcagaagaagatcatccagaagcacttcgagaagaagaaggacatcagaagaggcatcggctacctgaagctgatctgcttcctgatccccttcctgctgagcctgaagaagaagatgaaggtgccctacctgagcagcctgctgcagcccttcagcgacgacaaggtgaagaccgagagagagctgccccccttcatctacggcagagacttcaagtgccagaacttccactacaaggagaaccagtacttccacgtgcacggcggcatcgagttcgacatcagcacccccagcatcgagaacgccctggaggacttccagaagaacctggagaagatcagagactgcgccgccaacaccttcatcgaggacagcggctacaaggagtactacagcatccccgtgatggagttccacggcaagagctactacgtgatctacttcgagctggagaccttctaccagcagctgtacaagacccagtggtggggcgccatcaacgagatcgtgaacaacctgagactgaagagactgcccctgaccgacgcccagctgcacgagcagttcaagaagaagctgggcttcaagagagccatgaagtgcaagagcatccccttcggcatgaagagcgccgtggagagaggcctgagcgccgtgttccacaccttcagcagaaagaccagcagcagcaccatcaacgtgagcgacgaggccggctacaccatcttccaccacgccgccctgcacaacagagtgagcatcatctgccagctgtgcaacgccaacttcaaggtgaaccagagaagattcgtgaccttcagccagggccccacccccctgcacctggccgcccaggcctgcagcctggagaccaccgtgtgcctgctgtgcagcaaggccgactacaccctgagcgagaagagaggctggatgcccatccacttcgccgccttctacgacaacgtgtgcatcatcatcgccctgtgcagaaaggaccccagcctgctggaggccgaggccaccgccgagaaccagtgcacccccctgctgctggccgccaccagcggcgccctggacaccatccagtacctgttcagcatcggcgccaactggagaaagaccgacatcaagggcaacaacatcatccacctgagcgtgctgaccttccacaccgaggtgctgaagtacatcatcaagctgaacatccccgagctgcccgtgtggaagaccctggtggagatgctgcagtgcgagagctacaagagaagaatgatggccgtgatgagcctggaggtgatctgcctggccaacgaccagtactggagatgcatcctggacgccggcaccatccccgccctgatcaacctgctgaagagcagcaagatcaagctgcagtgcaagaccgtgggcctgctgagcaacatcagcacccacaagagcgccgtgcacgccctggtggaggccggcggcatccccagcctgatcaacctgctggtgtgcgacgagcccgaggtgcacagcagatgcgccgtgatcctgtacgacatcgcccagtgcgagaacaaggacgtgatcgccaagtacaacggcatccccagcctgatcaacctgctgaacctgaacatcgagaacgtgctggtgaacgtgatgaactgcatcagagtgctgtgcatcggcaacgagaacaaccagagagccgtgagagagcacaagggcctgccctacctgatcagattcctgagcagcgacagcgacgtgctgaaggccgtgagcagcgccgccatcgccgaggtgggcagagacaacaaggagatccaggacgccatcgccatggagggcgccatcccccccctggtggccctgttcaagggcaagcagatcagcgtgcagatgaagggcgccatggccgtggagagcctggccagccacaacgccctgatccagaaggccttcctggagaagagcctgaccaagtacctgctgaagctgctgaaggccttccagatcgacgtgaaggagcagggcgccgtggccctgtgggccctggccggccagaccctgaagcagcagaagtacatggccgagcagatcggctacagcttcatcatcaacatgctgctgagccccagcgccaagatgcagtacgtgggcggcgaggccgtgatcgccctgagcaaggacagcagaatgcaccagaaccagatctgcgagggcaacggcatcgcccccctggtgagactgctgagaatcagcaccatcgccgagggcaccctgctgagcgtgatcagagccgtgggcagcatctgcatcggcgtggcccacaccagcaaccccgtgagccagcagctggtggtggacgagaacgccttccccgtgctgatccagctgctgagaaaccaccccagccccaacatcaaggtggaggtggccttcagcctggcctgcatcgtgctgggcaacgacgtgctgcagaaggacctgcacgagaacgagggcttcgagtacgccgacgtgctgtacctgctgcacagcaccgagaaggacatctgcctgagagccggctacgccctgaccctgttcgccttcaacaacagattccagcagtacctgatcctggagagcggcatcatgaccatcagcatcttcgagagattcctggagagcaccgtggagaccgagaaggccatggccgccttccagatcgtggtgctggccaaggtgatcagagacatggaccacatcaccctgagcgccagaggcgtgaccatcctggtggacagcctgtacagcgtgcagaccagcaccatcgtgctgaccggcaacctgatcgccagcctggcccacagcagagccggcatccccgaggccttcaccaccctgggcaccatccagagactgtgctaccacctgtacagcggcatcgaggaggtgagagccgcctgcagcagcgccctgggctacctgacctacaacgccaacgccttcagaatcctgctgaaggagtgcagaaacaagcccaaccagttcatcagaatcaagaacaacatcagcagagacgccagcatcaaccccgccttcctgaaggagttccagatgcagcagaccctggtgggcctgcccagcctgagcctggagaagaacggcggccccagcatcatccccatcttcaagagaggcaaggagcacagaagaaagctgaagcccaagatccagcccaaggacagcctgaccctgctgccccccgtgaccaacttcatgggcctgttcaaggccaccaagaagaccaaggacagccacaacatcttcagcttcagcagcaccatcaccagcgacatcaccaacgtgagcagacccagaatcgtgtgcctgaaccagctgggcaagcacgtgcagaaggccaaccccgagcccgccgagggctag

SEQ ID NO: 16376 - DNA, 1080 bp, Artificial Sequence
  Description of Artificial Sequence: Synthetic coding sequence
atgaagggcgccatggccgtggagagcctggccagccacaacgccctgatccagaaggccttcctggagaagagcctgaccaagtacctgctgaagctgctgaaggccttccagatcgacgtgaaggagcagggcgccgtggccctgtgggccctggccggccagaccctgaagcagcagaagtacatggccgagcagatcggctacagcttcatcatcaacatgctgctgagccccagcgccaagatgcagtacgtgggcggcgaggccgtgatcgccctgagcaaggacagcagaatgcaccagaaccagatctgcgagggcaacggcatcgcccccctggtgagactgctgagaatcagcaccatcgccgagggcaccctgctgagcgtgatcagagccgtgggcagcatctgcatcggcgtggcccacaccagcaaccccgtgagccagcagctggtggtggacgagaacgccttccccgtgctgatccagctgctgagaaaccaccccagccccaacatcaaggtggaggtggccttcagcctggcctgcatcgtgctgggcaacgacgtgctgcagaaggacctgcacgagaacgagggcttcgagtacgccgacgtgctgtacctgctgcacagcaccgagaaggacatctgcctgagagccggctacgccctgaccctgttcgccttcaacaacagattccagcagtacctgatcctggagagcggcatcatgaccatcagcatcttcgagagattcctggagagcaccgtggagaccgagaaggccatggccgccttccagatcgtggtgctggccaaggtgatcagagacatggaccacatcaccctgagcgccagaggcgtgaccatcctggtggacagcctgtacagcgtgcagaccagcaccatcgtgctgaccggcaacctgatcgccagcctggcccacagcagagccggcatccccgaggccttcaccaccctgggcaccatccagagactgtgctaccacctgtacagcggcatcgaggagagcggcgaggagtggagaaccatccacaacagctacctgtag

SEQ ID NO: 16377 - DNA, 4092 bp, Artificial Sequence
  Description of Artificial Sequence: Synthetic coding sequence
atgagccagatgaacaacgtgggcttcagcaccgccatcctgctgacccccgtggaccccaccgccctgctggactacagagaggtgcaccagatgatcagagagctggccatcggcatctactgcctgaaccagatccccagcatcagcctggaggccaactacgaccagagcagcagctgccagctgccccccgcctactacgacaccagaatcggccagatcctgatcaacatcgactacatgctgaaggccctgtggcacggcatctacatgcccaaggagaagagagccagattcagcgagctgtggagagccatcatggacatcgaccccgacggcaagccccagaccaacaaggacatcttcagcgagttcagcagcgccggcctgaccgacatcaccaaggaccccgacttcaacgagatctacgacgaggacgtgaacgaggaccccacctacgaccccaacagccccgaggagaccgccgtgttcatgaagtacgccgagaacatcatgctgaagctgaccttcagcaccacccagatccagcagtacgagaacgtgttcatcttcgagaccggctactggctgaccaacgccatcaagtacaaccaggactacctggacatctgcacctaccagagactgcagcagagactgtacctgcagaagaagatcatccagaagcacttcgagaagaagaaggacatcagaagaggcatcggctacctgaagctgatctgcttcctgatccccttcctgctgagcctgaagaagaagatgaaggtgccctacctgagcagcctgctgcagcccttcagcgacgacaaggtgaagaccgagagagagctgccccccttcatctacggcagagacttcaagtgccagaacttccactacaaggagaaccagtacttccacgtgcacggcggcatcgagttcgacatcagcacccccagcatcgagaacgccctggaggacttccagaagaacctggagaagatcagagactgcgccgccaacaccttcatcgaggacagcggctacaaggagtactacagcatccccgtgatggagttccacggcaagagctactacgtgatctacttcgagctggagaccttctaccagcagctgtacaagacccagtggtggggcgccatcaacgagatcgtgaacaacctgagactgaagagactgcccctgaccgacgcccagctgcacgagcagttcaagaagaagctgggcttcaagagagccatgaagtgcaagagcatccccttcggcatgaagagcgccgtggagagaggcctgagcgccgtgttccacaccttcagcagaaagaccagcagcagcaccatcaacgtgagcgacgaggccggctacaccatcttccaccacgccgccctgcacaacagagtgagcatcatctgccagctgtgcaacgccaacttcaaggtgaaccagagaagattcgtgaccttcagccagggccccacccccctgcacctggccgcccaggcctgcagcctggagaccaccgtgtgcctgctgtgcagcaaggccgactacaccctgagcgagaagagaggctggatgcccatccacttcgccgccttctacgacaacgtgtgcatcatcatcgccctgtgcagaaaggaccccagcctgctggaggccgaggccaccgccgagaaccagtgcacccccctgctgctggccgccaccagcggcgccctggacaccatccagtacctgttcagcatcggcgccaactggagaaagaccgacatcaagggcaacaacatcatccacctgagcgtgctgaccttccacaccgaggtgctgaagtacatcatcaagctgaacatccccgagctgcccgtgtggaagaccctggtggagatgctgcagtgcgagagctacaagagaagaatgatggccgtgatgagcctggaggtgatctgcctggccaacgaccagtactggagatgcatcctggacgccggcaccatccccgccctgatcaacctgctgaagagcagcaagatcaagctgcagtgcaagaccgtgggcctgctgagcaacatcagcacccacaagagcgccgtgcacgccctggtggaggccggcggcatccccagcctgatcaacctgctggtgtgcgacgagcccgaggtgcacagcagatgcgccgtgatcctgtacgacatcgcccagtgcgagaacaaggacgtgatcgccaagtacaacggcatccccagcctgatcaacctgctgaacctgaacatcgagaacgtgctggtgaacgtgatgaactgcatcagagtgctgtgcatcggcaacgagaacaaccagagagccgtgagagagcacaagggcctgccctacctgatcagattcctgagcagcgacagcgacgtgctgaaggccgtgagcagcgccgccatcgccgaggtgggcagagacaacaaggagatccaggacgccatcgccatggagggcgccatcccccccctggtggccctgttcaagggcaagcagatcagcgtgcagatgaagggcgccatggccgtggagagcctggccagccacaacgccctgatccagaaggccttcctggagaagagcctgaccaagtacctgctgaagctgctgaaggccttccagatcgacgtgaaggagcagggcgccgtggccctgtgggccctggccggccagaccctgaagcagcagaagtacatggccgagcagatcggctacagcttcatcatcaacatgctgctgagccccagcgccaagatgcagtacgtgggcggcgaggccgtgatcgccctgagcaaggacagcagaatgcaccagaaccagatctgcgagggcaacggcatcgcccccctggtgagactgctgagaatcagcaccatcgccgagggcaccctgctgagcgtgatcagagccgtgggcagcatctgcatcggcgtggcccacaccagcaaccccgtgagccagcagctggtggtggacgagaacgccttccccgtgctgatccagctgctgagaaaccaccccagccccaacatcaaggtggaggtggccttcagcctggcctgcatcgtgctgggcaacgacgtgctgcagaaggacctgcacgagaacgagggcttcgagtacgccgacgtgctgtacctgctgcacagcaccgagaaggacatctgcctgagagccggctacgccctgaccctgttcgccttcaacaacagattccagcagtacctgatcctggagagcggcatcatgaccatcagcatcttcgagagattcctggagagcaccgtggagaccgagaaggccatggccgccttccagatcgtggtgctggccaaggtgatcagagacatggaccacatcaccctgagcgccagaggcgtgaccatcctggtggacagcctgtacagcgtgcagaccagcaccatcgtgctgaccggcaacctgatcgccagcctggcccacagcagagccggcatccccgaggccttcaccaccctgggcaccatccagagactgtgctaccacctgtacagcggcatcgaggaggtgagagccgcctgcagcagcgccctgggctacctgacctacaacgccaacgccttcagaatcctgctgaaggagtgcagaaacaagcccaaccagttcatcagaatcaagaacaacatcagcagagacgccagcatcaaccccgccttcctgaaggagttccagatgcagcagaccctggtgggcctgcccagcctgagcctggagaagaacggcggccccagcatcatccccatcttcaagagaggcaaggagcacagaagaaagctgaagcccaagatccagcccaaggacagcctgaccctgctgccccccgtgaccaacttcatgggcctgttcaaggccaccaagaagaccaaggacagccacaacatcttcagcttcagcagcaccatcaccagcgacatcaccaacgtgagcagacccagaatcgtgtgcctgaaccagctgggcaagcacgtgcagaaggccaaccccgagcccgccgagggctag

SEQ ID NO: 16378 - DNA, 3243 bp, Artificial Sequence
  Description of Artificial Sequence: Synthetic coding sequence
atgctgagactgcccaagaagggcctgcccagattcgagcaggtgcaggacgaggacacctacctggagaacctggccatccagagaaacgccagcgccttcttcgagaagtacgacagaagcgagatccaggagctgctgaccaccgccctggtgagctggctgagcgccaaggaggacgtgagaagccaggtggacctgccctgcggcatcatgagccagatgaacaacgtgggcttcagcaccgccatcctgctgacccccgtggaccccaccgccctgctggactacagagaggtgcaccagatgatcagagagctggccatcggcatctactgcctgaaccagatccccagcatcagcctggaggccaactacgaccagagcagcagctgccagctgccccccgcctactacgacaccagaatcggccagatcctgatcaacatcgactacatgctgaaggccctgtggcacggcatctacatgcccaaggagaagagagccagattcagcgagctgtggagagccatcatggacatcgaccccgacggcaagccccagaccaacaaggacatcttcagcgagttcagcagcgccggcctgaccgacatcaccaaggaccccgacttcaacgagatctacgacgaggacgtgaacgaggaccccacctacgaccccaacagccccgaggagaccgccgtgttcatgaagtacgccgagaacatcatgctgaagctgaccttcagcaccacccagatccagcagtacgagaacgtgttcatcttcgagaccggctactggctgaccaacgccatcaagtacaaccaggactacctggacatctgcacctaccagagactgcagcagagactgtacctgcagaagaagatcatccagaagcacttcgagaagaagaaggacatcagaagaggcatcggctacctgaagctgatctgcttcctgatccccttcctgctgagcctgaagaagaagatgaaggtgccctacctgagcagcctgctgcagcccttcagcgacgacaaggtgaagaccgagagagagctgccccccttcatctacggcagagacttcaagtgccagaacttccactacaaggagaaccagtacttccacgtgcacggcggcatcgagttcgacatcagcacccccagcatcgagaacgccctggaggacttccagaagaacctggagaagatcagagactgcgccgccaacaccttcatcgaggacagcggctacaaggagtactacagcatccccgtgatggagttccacggcaagagctactacgtgatctacttcgagctggagaccttctaccagcagctgtacaagacccagtggtggggcgccatcaacgagatcgtgaacaacctgagactgaagagactgcccctgaccgacgcccagctgcacgagcagttcaagaagaagctgggcttcaagagagccatgaagtgcaagagcatccccttcggcatgaagagcgccgtggagagaggcctgagcgccgtgttccacaccttcagcagaaagaccagcagcagcaccatcaacgtgagcgacgaggccggctacaccatcttccaccacgccgccctgcacaacagagtgagcatcatctgccagctgtgcaacgccaacttcaaggtgaaccagagaagattcgtgaccttcagccagggccccacccccctgcacctggccgcccaggcctgcagcctggagaccaccgtgtgcctgctgtgcagcaaggccgactacaccctgagcgagaagagaggctggatgcccatccacttcgccgccttctacgacaacgtgtgcatcatcatcgccctgtgcagaaaggaccccagcctgctggaggccgaggccaccgccgagaaccagtgcacccccctgctgctggccgccaccagcggcgccctggacaccatccagtacctgttcagcatcggcgccaactggagaaagaccgacatcaagggcaacaacatcatccacctgagcgtgctgaccttccacaccgaggtgctgaagtacatcatcaagctgaacatccccgagctgcccgtgtggaagaccctggtggagatgctgcagtgcgagagctacaagagaagaatgatggccgtgatgagcctggaggtgatctgcctggccaacgaccagtactggagatgcatcctggacgccggcaccatccccgccctgatcaacctgctgaagagcagcaagatcaagctgcagtgcaagaccgtgggcctgctgagcaacatcagcacccacaagagcgccgtgcacgccctggtggaggccggcggcatccccagcctgatcaacctgctggtgtgcgacgagcccgaggtgcacagcagatgcgccgtgatcctgtacgacatcgcccagtgcgagaacaaggacgtgatcgccaagtacaacggcatccccagcctgatcaacctgctgaacctgaacatcgagaacgtgctggtgaacgtgatgaactgcatcagagtgctgtgcatcggcaacgagaacaaccagagagccgtgagagagcacaagggcctgccctacctgatcagattcctgagcagcgacagcgacgtgctgaaggccgtgagcagcgccgccatcgccgaggtgggcagagacaacaaggagatccaggacgccatcgccatggagggcgccatcccccccctggtggccctgttcaagggcaagcagatcagcgtgcagatgaagggcgccatggccgtggagagcctggccagccacaacgccctgatccagaaggccttcctggagaagagcctgaccaagtacctgctgaagctgctgaaggccttccagatcgacgtgaaggagcagggcgccgtggccctgtgggccctggccggccagaccctgaagcagcagaagtacatggccgagcagatcggctacagcttcatcatcaacatgctgctgagccccagcgccaagatgcagtacgtgggcggcgaggccgtgatcgccctgagcaaggacagcagaatgcaccagaaccagatctgcgagggcaacggcatcgcccccctggtgagactgctgagaatcagcaccatcgccgagggcaccctgctgagcgtgatcagagccgtgggcagcatctgcatcggctacctgctgaagagcagactgtgcatcaacaccttctgcctgcagtag

SEQ ID NO: 16379 - DNA, 4305 bp, Artificial Sequence; identical to SEQ ID NO: 16375
  Description of Artificial Sequence: Synthetic coding sequence

SEQ ID NO: 16380 - DNA, 3513 bp, Artificial Sequence
  Description of Artificial Sequence: Synthetic coding sequence
atggccgaggaggaggtggccaagctggagaagcacctgatgctgctgagacaggagtacgtgaagctgcagaagaagctggccgagaccgagaagagatgcgccctgctggccgcccaggccaacaaggagagcagcagcgagagcttcatcagcagactgctggccatcgtggccgacctgtacgagcaggagcagtacagcgacctgaagatcaaggtgggcgacagacacatcagcgcccacaagttcgtgctggccgccagaagcgacagctggagcctggccaacctgagcagcaccaaggagctggacctgagcgacgccaaccccgaggtgaccatgaccatgctgagatggatctacaccgacgagctggagttcagagaggacgacgtgttcctgaccgagctgatgaagctggccaacagattccagctgcagctgctgagagagagatgcgagaagggcgtgatgagcctggtgaacgtgagaaactgcatcagattctaccagaccgccgaggagctgaacgccagcaccctgatgaactactgcgccgagatcatcgccagccactgggacgacctgagaaaggaggacttcagcagcatgagcgcccagctgctgtacaagatgatcaagagcaagaccgagtaccccctgcacaaggccatcaaggtggagagagaggacgtggtgttcctgtacctgatcgagatggacagccagctgcccggcaagctgaacgaggccgaccacaacggcgacctggccctggacctggccctgagcagaagactggagagcatcgccaccaccctggtgagccacaaggccgacgtggacatggtggacaagagcggctggagcctgctgcacaagggcatccagagaggcgacctgttcgccgccaccttcctgatcaagaacggcgccttcgtgaacgccgccaccctgggcgcccaggagacccccctgcacctggtggccctgtacagcagcaagaagcacagcgccgacgtgatgagcgagatggcccagatcgccgaggccctgctgcaggccggcgccaaccccaacatgcaggacagcaagggcagaacccccctgcacgtgagcatcatggccggcaacgagtacgtgttcagccagctgctgcagtgcaagcagctggacctggagctgaaggaccacgagggcagcaccgccctgtggctggccgtgcagcacatcaccgtgagcagcgaccagagcgtgaaccccttcgaggacgtgcccgtggtgaacggcaccagcttcgacgagaacagcttcgccgccagactgatccagagaggcagccacaccgacgcccccgacaccgccaccggcaactgcctgctgcagagagccgccggcgccggcaacgaggccgccgccctgttcctggccaccaacggcgcccacgtgaaccacagaaacaagtggggcgagacccccctgcacaccgcctgcagacacggcctggccaacctgaccgccgagctgctgcagcagggcgccaaccccaacctgcagaccgaggaggccctgcccctgcccaaggaggccgccagcctgaccagcctggccgacagcgtgcacctgcagacccccctgcacatggccatcgcctacaaccaccccgacgtggtgagcgtgatcctggagcagaaggccaacgccctgcacgccaccaacaacctgcagatcatccccgacttcagcctgaaggacagcagagaccagaccgtgctgggcctggccctgtggaccggcatgcacaccatcgccgcccagctgctgggcagcggcgccgccatcaacgacaccatgagcgacggccagaccctgctgcacatggccatccagagacaggacagcaagagcgccctgttcctgctggagcaccaggccgacatcaacgtgagcagaacccaggacggcgagaccgccctgcagctggccatcagaaaccagctgcccctggtggtggacgccatctgcaccagaggcgccgacatgagcgtgcccgacgagaagggcaacccccccctgtggctggccctggccaacaacctggaggacatcgccagcaccctggtgagacacggctgcgacgccacctgctggggccccggccccggcggctgcctgcagaccctgctgcacagagccatcgacgagaacaacgagcccaccgcctgcttcctgatcagaagcggctgcgacgtgaacagccccagacagcccggcgccaacggcgagggcgaggaggaggccagagacggccagacccccctgcacctggccgccagctggggcctggaggagaccgtgcagtgcctgctggagttcggcgccaacgtgaacgcccaggacgccgagggcagaacccccatccacgtggccatcagcagccagcacggcgtgatcatccagctgctggtgagccaccccgacatccacctgaacgtgagagacagacagggcctgacccccttcgcctgcgccatgaccttcaagaacaacaagagcgccgaggccatcctgaagagagagagcggcgccgccgagcaggtggacaacaagggcagaaacttcctgcacgtggccgtgcagaacagcgacatcgagagcgtgctgttcctgatcagcgtgcacgccaacgtgaacagcagagtgcaggacgccagcaagctgacccccctgcacctggccgtgcaggccggcagcgagatcatcgtgagaaacctgctgctggccggcgccaaggtgaacgagctgaccaagcacagacagaccgccctgcacctggccgcccagcaggacctgcccaccatctgcagcgtgctgctggagaacggcgtggacttcgccgccgtggacgagaacggcaacaacgccctgcacctggccgtgatgcacggcagactgaacaacatcagagtgctgctgaccgagtgcaccgtggacgccgaggccttcaacctgagaggccagagccccctgcacatcctgggccagtacggcaaggagaacgccgccgccatcttcgacctgttcctggagtgcatgcccggctaccccctggacaagcccgacgccgacggcagcaccgtgctgctgctggcctacatgaagggcaacgccaacctgtgcagagccatcgtgagaagcggcgccagactgggcgtgaacaacaaccagggcgtgaacatcttcaactaccaggtggccaccaagcagctgctgttcagactgctggacatgctgagcaaggagcccccctggtgcgacggcagctactgctacgagtgcaccgccagattcggcgtgaccaccagaaagcaccactgcagacactgcggcagactgctgtgccacaagtgcagcaccaaggagatccccatcatcaagttcgacctgaacaagcccgtgagagtgtgcaacatctgcttcgacgtgctgaccctgggcggcgtgagctag

SEQ ID NO: 16381 - DNA, 1464 bp, Artificial Sequence
  Description of Artificial Sequence: Synthetic coding sequence
atggccgaggaggaggtggccaagctggagaagcacctgatgctgctgagacaggagtacgtgaagctgcagaagaagctggccgagaccgagaagagatgcgccctgctggccgcccaggccaacaaggagagcagcagcgagagcttcatcagcagactgctggccatcgtggccgacctgtacgagcaggagcagtacagcgacctgaagatcaaggtgggcgacagacacatcagcgcccacaagttcgtgctggccgccagaagcgacagctggagcctggccaacctgagcagcaccaaggagctggacctgagcgacgccaaccccgaggtgaccatgaccatgctgagatggatctacaccgacgagctggagttcagagaggacgacgtgttcctgaccgagctgatgaagctggccaacagattccagctgcagctgctgagagagagatgcgagaagggcgtgatgagcctggtgaacgtgagaaactgcatcagattctaccagaccgccgaggagctgaacgccagcaccctgatgaactactgcgccgagatcatcgccagccactgggacgacctgagaaaggaggacttcagcagcatgagcgcccagctgctgtacaagatgatcaagagcaagaccgagtaccccctgcacaaggccatcaaggtggagagagaggacgtggtgttcctgtacctgatcgagatggacagccagctgcccggcaagctgaacgaggccgaccacaacggcgacctggccctggacctggccctgagcagaagactggagagcatcgccaccaccctggtgagccacaaggccgacgtggacatggtggacaagagcggctggagcctgctgcacaagggcatccagagaggcgacctgttcgccgccaccttcctgatcaagaacggcgccttcgtgaacgccgccaccctgggcgcccaggagacccccctgcacctggtggccctgtacagcagcaagaagcacagcgccgacgtgatgagcgagatggcccagatcgccgaggccctgctgcaggccggcgccaaccccaacatgcaggacagcaagggcagaacccccctgcacgtgagcatcatggccggcaacgagtacgtgttcagccagctgctgcagtgcaagcagctggacctggagctgaaggaccacgagggcagcaccgccctgtggctggccgtgcagcacatcaccgtgagcagcgaccagagcgtgaaccccttcgaggacgtgcccgtggtgaacggcaccagcttcgacgagaacagcttcgccgccagactgatccagagaggcagccacaccgacgcccccgacaccgccaccggcaaggccagagccagcagaagaggcgacgccggcgtgtgcagaagacaggagatggcctgcaagtgcctgcaccccaagttcagaaactag

SEQ ID NO: 16382 - DNA, 3336 bp, Artificial Sequence
  Description of Artificial Sequence: Synthetic coding sequence
atgagcagctgcagaagaagctggagaagacagagaagcgccgccctgagctggctgagaagacagaccagaagagccgccgccagccccagcagcgccgtgtgctggcccagctggcagaccagcaccagcagaagcagcaccgacgccaaccccgaggtgaccatgaccatgctgagatggatctacaccgacgagctggagttcagagaggacgacgtgttcctgaccgagctgatgaagctggccaacagattccagctgcagctgctgagagagagatgcgagaagggcgtgatgagcctggtgaacgtgagaaactgcatcagattctaccagaccgccgaggagctgaacgccagcaccctgatgaactactgcgccgagatcatcgccagccactgggacgacctgagaaaggaggacttcagcagcatgagcgcccagctgctgtacaagatgatcaagagcaagaccgagtaccccctgcacaaggccatcaaggtggagagagaggacgtggtgttcctgtacctgatcgagatggacagccagctgcccggcaagctgaacgaggccgaccacaacggcgacctggccctggacctggccctgagcagaagactggagagcatcgccaccaccctggtgagccacaaggccgacgtggacatggtggacaagagcggctggagcctgctgcacaagggcatccagagaggcgacctgttcgccgccaccttcctgatcaagaacggcgccttcgtgaacgccgccaccctgggcgcccaggagacccccctgcacctggtggccctgtacagcagcaagaagcacagcgccgacgtgatgagcgagatggcccagatcgccgaggccctgctgcaggccggcgccaaccccaacatgcaggacagcaagggcagaacccccctgcacgtgagcatcatggccggcaacgagtacgtgttcagccagctgctgcagtgcaagcagctggacctggagctgaaggaccacgagggcagcaccgccctgtggctggccgtgcagcacatcaccgtgagcagcgaccagagcgtgaaccccttcgaggacgtgcccgtggtgaacggcaccagcttcgacgagaacagcttcgccgccagactgatccagagaggcagccacaccgacgcccccgacaccgccaccggcaactgcctgctgcagagagccgccggcgccggcaacgaggccgccgccctgttcctggccaccaacggcgcccacgtgaaccacagaaacaagtggggcgagacccccctgcacaccgcctgcagacacggcctggccaacctgaccgccgagctgctgcagcagggcgccaaccccaacctgcagaccgaggaggccctgcccctgcccaaggaggccgccagcctgaccagcctggccgacagcgtgcacctgcagacccccctgcacatggccatcgcctacaaccaccccgacgtggtgagcgtgatcctggagcagaaggccaacgccctgcacgccaccaacaacctgcagatcatccccgacttcagcctgaaggacagcagagaccagaccgtgctgggcctggccctgtggaccggcatgcacaccatcgccgcccagctgctgggcagcggcgccgccatcaacgacaccatgagcgacggccagaccctgctgcacatggccatccagagacaggacagcaagagcgccctgttcctgctggagcaccaggccgacatcaacgtgagcagaacccaggacggcgagaccgccctgcagctggccatcagaaaccagctgcccctggtggtggacgccatctgcaccagaggcgccgacatgagcgtgcccgacgagaagggcaacccccccctgtggctggccctggccaacaacctggaggacatcgccagcaccctggtgagacacggctgcgacgccacctgctggggccccggccccggcggctgcctgcagaccctgctgcacagagccatcgacgagaacaacgagcccaccgcctgcttcctgatcagaagcggctgcgacgtgaacagccccagacagcccggcgccaacggcgagggcgaggaggaggccagagacggccagacccccctgcacctggccgccagctggggcctggaggagaccgtgcagtgcctgctggagttcggcgccaacgtgaacgcccaggacgccgagggcagaacccccatccacgtggccatcagcagccagcacggcgtgatcatccagctgctggtgagccaccccgacatccacctgaacgtgagagacagacagggcctgacccccttcgcctgcgccatgaccttcaagaacaacaagagcgccgaggccatcctgaagagagagagcggcgccgccgagcaggtggacaacaagggcagaaacttcctgcacgtggccgtgcagaacagcgacatcgagagcgtgctgttcctgatcagcgtgcacgccaacgtgaacagcagagtgcaggacgccagcaagctgacccccctgcacctggccgtgcaggccggcagcgagatcatcgtgagaaacctgctgctggccggcgccaaggtgaacgagctgaccaagcacagacagaccgccctgcacctggccgcccagcaggacctgcccaccatctgcagcgtgctgctggagaacggcgtggacttcgccgccgtggacgagaacggcaacaacgccctgcacctggccgtgatgcacggcagactgaacaacatcagagtgctgctgaccgagtgcaccgtggacgccgaggccttcaacctgagaggccagagccccctgcacatcctgggccagtacggcaaggagaacgccgccgccatcttcgacctgttcctggagtgcatgcccggctaccccctggacaagcccgacgccgacggcagcaccgtgctgctgctggcctacatgaagggcaacgccaacctgtgcagagccatcgtgagaagcggcgccagactgggcgtgaacaacaaccagggcgtgaacatcttcaactaccaggtggccaccaagcagctgctgttcagactgctggacatgctgagcaaggagcccccctggtgcgacggcagctactgctacgagtgcaccgccagattcggcgtgaccaccagaaagcaccactgcagacactgcggcagactgctgtgccacaagtgcagcaccaaggagatccccatcatcaagttcgacctgaacaagcccgtgagagtgtgcaacatctgcttcgacgtgctgaccctgggcggcgtgagctag

SEQ ID NO: 16383 - DNA, 3513 bp, Artificial Sequence; identical to SEQ ID NO: 16380
  Description of Artificial Sequence: Synthetic coding sequence

SEQ ID NO: 16384 - DNA, 2472 bp, Artificial Sequence
  Description of Artificial Sequence: Synthetic coding sequence
atgaagctgttcggcttcggcagcagaagaggccagaccgcccagggcagcatcgaccacgtgtacaccggcagcggctacagaatcagagacagcgagctgcagaagatccacagagccgccgtgaagggcgacgccgccgaggtggagagatgcctggccagaagaagcggcgacctggacgccctggacaagcagcacagaaccgccctgcacctggcctgcaccagcggccacgtgcaggtggtgaccctgctggtgaacagaaagtgccagatcgacgtgtgcgacaaggagaacagaacccccctgatccaggccgtgcactgccaggaggaggcctgcgccgtgatcctgctggagcacggcgccaaccccaacctgaaggacatctacggcaacaccgccctgcactacgccgtgtacagcgagagcaccagcctggccgagaagctgctgagccacggcgcccacatcgaggccctggacaaggacaacaacacccccctgctgttcgccatcatctgcaagaaggagaagatggtggagttcctgctgaagaagaaggccagcagccacgccgtggacagactgagaagaagcgccctgatgctggccgtgtactacgacagccccggcatcgtgaacatcctgctgaagcagaacatcgacgtgttcgcccaggacatgtgcggcagagacgccgaggactacgccatcagccaccacctgaccaagatccagcagcagatcctggagcacaagaagaagatcctgaagaaggagaagagcgacgtgggcagcagcgacgagagcgccgtgagcatcttccacgagctgagagtggacagcctgcccgccagcgacgacaaggacctgaacgtggccaccaagcagtgcgtgcccgagaaggtgagcgagcccctgcccggcagcagccacgagaagggcaacagaatcgtgaacggccagggcgagggcccccccgccaagcaccccagcctgaagcccagcaccgaggtggaggaccccgccgtgaagggcgccgtgcagagaaagaacgtgcagaccctgagagccgagcaggccctgcccgtggccagcgaggaggagcaggagagacacgagagaagcgagaagaagcagccccaggtgaaggagggcaacaacaccaacaagagcgagaagatccagctgagcgagaacatctgcgacagcaccagcagcgccgccgccggcagactgacccagcagagaaagatcggcaagacctacccccagcagttccccaagaagctgaaggaggagcacgacagatgcaccctgaagcaggagaacgaggagaagaccaacgtgaacatgctgtacaagaagaacagagaggagctggagagaaaggagaagcagtacaagaaggaggtggaggccaagcagctggagcccaccgtgcagagcctggagatgaagagcaagaccgccagaaacacccccaactgggacttccacaaccacgaggagatgaagggcctgatggacgagaactgcatcctgaaggccgacatcgccatcctgagacaggagatctgcaccatgaagaacgacaacctggagaaggagaacaagtacctgaaggacatcaagatcgtgaaggagaccaacgccgccctggagaagtacatcaagctgaacgaggagatgatcaccgagaccgccttcagataccagcaggagctgaacgacctgaaggccgagaacaccagactgaacgccgagctgctgaaggagaaggagagcaagaagagactggaggccgacatcgagagctaccagagcagactggccgccgccatcagcaagcacagcgagagcgtgaagaccgagagaaacctgaagctggccctggagagaaccagagacgtgagcgtgcaggtggagatgagcagcgccatcagcaaggtgaaggccgagaacgagttcctgaccgagcagctgagcgagacccagatcaagttcaacgccctgaaggacaagttcagaaagaccagagacagcctgagaaagaagagcctggccctggagaccgtgcagaacgacctgagccagacccagcagcagacccaggagatgaaggagatgtaccagaacgccgaggccaaggtgaacaacagcaccggcaagtggaactgcgtggaggagagaatctgccacctgcagagagagaacgcctggctggtgcagcagctggacgacgtgcaccagaaggaggaccacaaggagatcgtgaccaacatccagagaggcttcatcgagagcggcaagaaggacctggtgctggaggagaagagcaagaagctgatgaacgagtgcgaccacctgaaggagagcctgttccagtacgagagagagaagaccgagggcgtggtgagcatcaaggaggacaagtacttccagaccagcagaaagaccatctag

SEQ ID NO: 16385 - DNA, 1359 bp, Artificial Sequence
  Description of Artificial Sequence: Synthetic coding sequence
atgaaggtgcagcccagcgtgacctgcgtggccagctggggcggcatcgtgcacctggaggccttcggcgaccccgtgatcgtgctgagaggcgcctgggccgtgcccagagtggactgcctgatcgacaccctgagaacccccaacgccagctgcatgagaaagggcacccacctgctggtgccctgcctggaggaggaggagctggccctgcacagaagaagactggacatgagcgaggccctgccctgccccggcaaggagacccccacccccggctgcagactgggcgccctgtactgggcctgcgtgcacaacgaccccacccagctgcaggccatcctggacggcggcgtgagccccgaggaggccacccaggtggacagcaacggcagaaccggcctgatggtggcctgctaccacggcttccagagcgtggtggccctgctgagccactgccccttcctggacgtgaaccagcaggacaagggcggcgacaccgccctgatgctggccgcccaggccggccacgtgcccctggtgagcctgctgctgaactactacgtgggcctggacctggagagaagagaccagagaggcctgaccgccctgatgaaggccgccatgagaaacagatgcgccgacctgaccgccgtggaccccgtgagaggcaagaccgccctggagtgggccgtgctgaccgacagcttcgacaccgtgtggagaatcagacagctgctgagaagaccccaggtggagcagctgagccagcactacaagcccgagtggcccgccctgagcggcctggtggcccaggcccaggcccaggcccaggtggcccccagcctgctggagagactgcaggccaccctgagcctgcccttcgcccccagcccccaggagggcggcgtgctggaccacctggtgaccgccaccaccagcctggccagccccttcgtgaccaccgcctgccacaccctgtgccccgaccacccccccagcctgggcaccagaagcaagagcgtgcccgagctgctgggcaccgccccccccccccccctggtgccccagagcccccccggcagcccccagagaagcccctgggtgttcgtgccctaccagagcccccagggcatcctgagcaagtgcctgcagtggctgcagcccagagacagcaccagccccagaccccaggtgcccaagatcctgctgagcaaggccagcagcagcagccaccagtgccagcccaagcccagccccagcggccaccagagcctggccctgcccctgtggagataccaggagctgagaatcgagaagagaaagcaggaggaggaggccagaatggcccagaagtag

SEQ ID NO: 16386 - DNA, 687 bp, Artificial Sequence
  Description of Artificial Sequence: Synthetic coding sequence
atgagctacgtgttcgtgaacgacagcagccagaccaacgtgcccctgctgcaggcctgcatcgacggcgacttcaactacagcaagagactgctggagagcggcttcgaccccaacatcagagacagcagaggcagaaccggcctgcacctggccgccgccagaggcaacgtggacatctgccagctgctgcacaagttcggcgccgacctgctggccaccgactaccagggcaacaccgccctgcacctgtgcggccacgtggacaccatccagttcctggtgagcaacggcctgaagatcgacatctgcaaccaccagggcgccacccccctggtgctggccaagagaagaggcgtgaacaaggacgtgatcagactgctggagagcctggaggagcaggaggtgaagggcttcaacagaggcacccacagcaagctggagaccatgcagaccgccgagagcgagagcgccatggagagccacagcctgctgaaccccaacctgcagcagggcgagggcgtgctgagcagcttcagaaccacctggcaggagttcgtggaggacctgggcttctggagagtgctgctgctgatcttcgtgatcgccctgctgagcctgggcatcgcctactacgtgagcggcgtgctgcccttcgtggagaaccagcccgagctggtgcactag

SEQ ID NO: 16387 - DNA, 588 bp, Artificial Sequence
  Description of Artificial Sequence: Synthetic coding sequence
atgagctacgtgttcgtgaacgacagcagccagaccaacgtgcccctgctgcaggcctgcatcgacggcgacttcaactacagcaagagactgctggagagcggcttcgaccccaacatcagagacagcagaggcagaaccggcctgcacctggccgccgccagaggcaacgtggacatctgccagctgctgcacaagttcggcgccgacctgctggccaccgactaccagggcaacaccgccctgcacctgtgcggccacgtggacaccatccagttcctggtgagcaacggcctgaagatcgacatctgcaaccaccagggcgccacccccctggtgctggccaagagaagaggcgtgaacaaggacgtgatcagactgctggagagcctggaggagcaggaggtgaagggcttcaacagaggcacccacagcaagctggagaccatgcagaccgccgagagcgagagcgccatggagagccacagcctgctgaaccccaacctgcagcagggcgagggcgtgctgagcagcttcagaaccacctggcaggagttcgtggaggacctgggcttctggagagtgtag

SEQ ID NO: 16388 - DNA, 687 bp, Artificial Sequence; identical to SEQ ID NO: 16386
  Description of Artificial Sequence: Synthetic coding sequence

SEQ ID NO: 16389 - DNA, 687 bp, Artificial Sequence; identical to SEQ ID NO: 16386
  Description of Artificial Sequence: Synthetic coding sequence

SEQ ID NO: 16390 - DNA, 699 bp, Artificial Sequence
  Description of Artificial Sequence: Synthetic coding sequence
atgagctacgtgttcgtgaacgacagcagccagaccaacgtgcccctgctgcaggcctgcatcgacggcgacttcaactacagcaagagactgctggagagcggcttcgaccccaacatcagagacagcagaggcagaaccggcctgcacctggccgccgccagaggcaacgtggacatctgccagctgctgcacaagttcggcgccgacctgctggccaccgactaccagggcaacaccgccctgcacctgtgcggccacgtggacaccatccagttcctggtgagcaacggcctgaagatcgacatctgcaaccaccagggcgccacccccctggtgctggccaagagaagaggcgtgaacaaggacgtgatcagactgctggagagcctggaggagcaggaggtgaagggcttcaacagaggcacccacagcaagctggagaccatgcagaccgccgagagcgagagcgccatggagagccacagcctgctgaaccccaacctgcagcagggcgagggcgtgctgagcagcttcagaaccacctggcaggagttcgtggaggacctgggcttctggagagtgctgctgctgatcttcgtgatcgccctgctgagcctgggcatcgcctactacagaagaaccctgagactgggcagcttcgccagacaggacagaagcagaatccaggccatctag

SEQ ID NO: 16391 - DNA, 249 bp, Artificial Sequence
  Description of Artificial Sequence: Synthetic coding sequence
atgagctacgtgttcgtgaacgacagcagccagaccaacgtgcccctgctgcaggcctgcatcgacggcgacttcaactacagcaagagactgctggagagcggcttcgaccccaacatcagagacagcagaggcagaaccggcctgcacctggccgccgccagaggcaacgtggacatctgccagctgctgcacaagttcggcgccgacctgctggccaccgactaccagggcaacaccgccctgtag

SEQ ID NO: 16392 - DNA, 261 bp, Artificial Sequence
  Description of Artificial Sequence: Synthetic coding sequence
atgagctacgtgttcgtgaacgacagcagccagaccaacgtgcccctgctgcaggcctgcatcgacggcgacttcaactacagcaagagactgctggagagcggcttcgaccccaacatcagagacagcagaggcagaaccggcctgcacctggccgccgccagaggcaacgtggacatctgccagctgctgcacaagttcggcgccgacctgctggccaccgactaccagggcaacaccgccctgcacctgtgcggctag

SEQ ID NO: 16393 - DNA, 312 bp, Artificial Sequence
  Description of Artificial Sequence: Synthetic coding sequence
atgagctacgtgttcgtgaacgacagcagccagaccaacgtgcccctgctgcaggcctgcatcgacggcgacttcaactacagcaagagactgctggagagcggcttcgaccccaacatcagagacagcagaggcagaaccggcctgcacctggccgccgccagaggcaacgtggacatctgccagctgctgcacaagttcggcgccgacctgctggccaccgactaccagggcaacaccgccctgcacctgtgcggccacgtggacaccatccagttcctggtgagcaacggcctgaagatcgacatctag

SEQ ID NO: 16394 - DNA, 1074 bp, Artificial Sequence
  Description of Artificial Sequence: Synthetic coding sequence
atgggcaacagacacagccagagctacaccctgagcgagggcagccagcagctgcccaagggcgacagccagcccagcaccgtggtgcagcccctgagccaccccagcagaaacggcgagcccgaggccccccagcccgccaaggccagcagcccccagggcttcgacgtggacagagacgccaagaagctgaacaaggcctgcaagggcatgggcaccaacgaggccgccatcatcgagatcctgagcggcagaaccagcgacgagagacagcagatcaagcagaagtacaaggccacctacggcaaggagctggaggaggtgctgaagagcgagctgagcggcaacttcgagaagaccgccctggccctgctggacagacccagcgagtacgccgccagacagctgcagaaggccatgaagggcctgggcaccgacgagagcgtgctgatcgaggtgctgtgcaccagaaccaacaaggagatcatcgccatcaaggaggcctaccagagactgttcgacagaagcctggagagcgacgtgaagggcgacaccagcggcaacctgaagaagatcctggtgagcctgctgcaggccaacagaaacgagggcgacgacgtggacaaggacctggccggccaggacgccaaggacctgtacgacgccggcgagggcagatggggcaccgacgagctggccttcaacgaggtgctggccaagagaagctacaagcagctgagagccaccttccaggcctaccagatcctgatcggcaaggacatcgaggaggccatcgaggaggagaccagcggcgacctgcagaaggcctacctgaccctggtgagatgcgcccaggactgcgaggactacttcgccgagagactgtacaagagcatgaagggcgccggcaccgacgaggagaccctgatcagaatcgtggtgaccagagccgaggtggacctgcagggcatcaaggccaagttccaggagaagtaccagaagagcctgagcgacatggtgagaagcgacaccagcggcgacttcagaaagctgctggtggccctgctgcactag

SEQ ID NO: 16395 - DNA, 951 bp, Artificial Sequence
  Description of Artificial Sequence: Synthetic coding sequence
atgggcaacagacacgccaaggccagcagcccccagggcttcgacgtggacagagacgccaagaagctgaacaaggcctgcaagggcatgggcaccaacgaggccgccatcatcgagatcctgagcggcagaaccagcgacgagagacagcagatcaagcagaagtacaaggccacctacggcaaggagctggaggaggtgctgaagagcgagctgagcggcaacttcgagaagaccgccctggccctgctggacagacccagcgagtacgccgccagacagctgcagaaggccatgaagggcctgggcaccgacgagagcgtgctgatcgaggtgctgtgcaccagaaccaacaaggagatcatcgccatcaaggaggcctaccagagactgttcgacagaagcctggagagcgacgtgaagggcgacaccagcggcaacctgaagaagatcctggtgagcctgctgcaggccaacagaaacgagggcgacgacgtggacaaggacctggccggccaggacgccaaggacctgtacgacgccggcgagggcagatggggcaccgacgagctggccttcaacgaggtgctggccaagagaagctacaagcagctgagagccaccttccaggcctaccagatcctgatcggcaaggacatcgaggaggccatcgaggaggagaccagcggcgacctgcagaaggcctacctgaccctggtgagatgcgcccaggactgcgaggactacttcgccgagagactgtacaagagcatgaagggcgccggcaccgacgaggagaccctgatcagaatcgtggtgaccagagccgaggtggacctgcagggcatcaaggccaagttccaggagaagtaccagaagagcctgagcgacatggtgagaagcgacaccagcggcgacttcagaaagctgctggtggccctgctgcactag

SEQ ID NO: 16396 - DNA, 2946 bp, Artificial Sequence
  Description of Artificial Sequence: Synthetic coding sequence
atggtgcaccacagcggcagcatccagagcttcaagcagcagaagggcatgaacatcagcaagagcgagatcaccaaggagaccagcctgaagcccagcagaagaagcctgccctgcctggcccagagctacgcctacagcaagagcctgagccagagcaccagcctgttccagagcaccgagagcgagagccaggcccccaccagcatcaccctgatcagcaccgacaaggccgagcaggtgaacaccgaggagaacaagaacgacagcgtgctgagatgcagcttcgccgacctgagcgacttctgcctggccctgggcaaggacaaggactacaccgacgagagcgagcacgccacctacgacagaagcagactgatcaacgacttcgtgatcaaggacaagagcgagttcaagaccaagctgagcaagaacgacatgaactacatcgccagcagcggccccctgttcaaggacggcaagaagagaatcgactacatcctggtgtacagaaagaccaacatccagtacgacaagagaaacaccttcgagaagaacctgagagccgagggcctgatgctggagaaggagcccgccatcgccagccccgacatcatgttcatcaagatccacatcccctgggacaccctgtgcaagtacgccgagagactgaacatcagaatgcccttcagaaagaagtgctactacaccgacggcagaagcaagagcatgggcagaatgcagacctacttcagaagaatcaagaactggatggcccagaaccccatggtgctggacaagagcgccttccccgacctggaggagagcgactgctacaccggccccttcagcagagccagaatccaccacttcatcatcaacaacaaggacaccttcttcagcaacgccaccagaagcagaatcgtgtaccacatgctggagagaaccaagtacgagaacggcatcagcaaggtgggcatcagaaagctgatcaacaacggcagctacatcgccgccttccccccccacgagggcgcctacaagagcagccagcccatcaagacccacggcccccagaacaacagacacctgctgtacgagagatgggccagatggggcatgtggtacaagcaccagcccctggacctgatcagactgtacttcggcgagaagatcggcctgtacttcgcctggctgggctggtacaccggcatgctgatccccgccgccatcgtgggcctgtgcgtgttcttctacggcctgttcaccatgaacaacagccaggtgagccaggagatctgcaaggccaccgaggtgttcatgtgccccctgtgcgacaagaactgcagcctgcagagactgaacgacagctgcatctacgccaaggtgacctacctgttcgacaacggcggcaccgtgttcttcgccatcttcatggccatctgggccaccgtgttcctggagttctggaagagaagaagaagcatcctgacctacacctgggacctgatcgagtgggaggaggaggaggagaccctgagaccccagttcgaggccaagtactacaagatggagatcgtgaaccccatcaccggcaagcccgagccccaccagcccagcagcgacaaggtgaccagactgctggtgagcgtgagcggcatcttcttcatgatcagcctggtgatcaccgccgtgttcggcgtggtggtgtacagactggtggtgatggagcagttcgccagcttcaagtggaacttcatcaagcagtactggcagttcgccaccagcgccgccgccgtgtgcatcaacttcatcatcatcatgctgctgaacctggcctacgagaagatcgcctacctgctgaccaacctggagtaccccagaaccgagagcgagtgggagaacagcttcgccctgaagatgttcctgttccagttcgtgaacctgaacagcagcatcttctacatcgccttcttcctgggcagattcgtgggccaccccggcaagtacaacaagctgttcgacagatggagactggaggagtgccaccccagcggctgcctgatcgacctgtgcctgcagatgggcgtgatcatgttcctgaagcagatctggaacaacttcatggagctgggctaccccctgatccagaactggtggagcagacacaagatcaagagaggcatccacgacgccagcatcccccagtgggagaacgactggaacctgcagcccatgaacctgcacggcctgatggacgagtacctggagatggtgctgcagttcggcttcaccaccatcttcgtggccgccttccccctggcccccctgctggccctgctgaacaacatcatcgagatcagactggacgcctacaagttcgtgacccagtggagaagacccctgcccgccagagccaccgacatcggcatctggctgggcatcctggagggcatcggcatcctggccgtgatcaccaacgccttcgtgatcgccatcaccagcgactacatccccagattcgtgtacgagtacaagtacggcccctgcgccaaccacgtggagcccagcgagaactgcctgaagggctacgtgaacaacagcctgagcttcttcgacctgagcgagctgggcatgggcaagagcggctactgcagatacagagactacagaggccccccctggagcagcaagccctacgagttcaccctgcagtactggcacatcctggccgccagactggccttcatcatcgtgttcgagcacctggtgttcggcatcaagagcttcatcgcctacctgatccccgacgtgcccaagggcctgcacgacagaatcagaagagagaagtacctggtgcaggagatgatgtacgaggccgagctggagcacctgcagcagcagagaagaaagagcggccagcccgtgcaccacgagtggccctag

SEQ ID NO: 16397 - DNA, 2898 bp, Artificial Sequence
  Description of Artificial Sequence: Synthetic coding sequence
atgaacatcagcaagagcgagatcaccaaggagaccagcctgaagcccagcagaagaagcctgccctgcctggcccagagctacgcctacagcaagagcctgagccagagcaccagcctgttccagagcaccgagagcgagagccaggcccccaccagcatcaccctgatcagcaccgacaaggccgagcaggtgaacaccgaggagaacaagaacgacagcgtgctgagatgcagcttcgccgacctgagcgacttctgcctggccctgggcaaggacaaggactacaccgacgagagcgagcacgccacctacgacagaagcagactgatcaacgacttcgtgatcaaggacaagagcgagttcaagaccaagctgagcaagaacgacatgaactacatcgccagcagcggccccctgttcaaggacggcaagaagagaatcgactacatcctggtgtacagaaagaccaacatccagtacgacaagagaaacaccttcgagaagaacctgagagccgagggcctgatgctggagaaggagcccgccatcgccagccccgacatcatgttcatcaagatccacatcccctgggacaccctgtgcaagtacgccgagagactgaacatcagaatgcccttcagaaagaagtgctactacaccgacggcagaagcaagagcatgggcagaatgcagacctacttcagaagaatcaagaactggatggcccagaaccccatggtgctggacaagagcgccttccccgacctggaggagagcgactgctacaccggccccttcagcagagccagaatccaccacttcatcatcaacaacaaggacaccttcttcagcaacgccaccagaagcagaatcgtgtaccacatgctggagagaaccaagtacgagaacggcatcagcaaggtgggcatcagaaagctgatcaacaacggcagctacatcgccgccttccccccccacgagggcgcctacaagagcagccagcccatcaagacccacggcccccagaacaacagacacctgctgtacgagagatgggccagatggggcatgtggtacaagcaccagcccctggacctgatcagactgtacttcggcgagaagatcggcctgtacttcgcctggctgggctggtacaccggcatgctgatccccgccgccatcgtgggcctgtgcgtgttcttctacggcctgttcaccatgaacaacagccaggtgagccaggagatctgcaaggccaccgaggtgttcatgtgccccctgtgcgacaagaactgcagcctgcagagactgaacgacagctgcatctacgccaaggtgacctacctgttcgacaacggcggcaccgtgttcttcgccatcttcatggccatctgggccaccgtgttcctggagttctggaagagaagaagaagcatcctgacctacacctgggacctgatcgagtgggaggaggaggaggagaccctgagaccccagttcgaggccaagtactacaagatggagatcgtgaaccccatcaccggcaagcccgagccccaccagcccagcagcgacaaggtgaccagactgctggtgagcgtgagcggcatcttcttcatgatcagcctggtgatcaccgccgtgttcggcgtggtggtgtacagactggtggtgatggagcagttcgccagcttcaagtggaacttcatcaagcagtactggcagttcgccaccagcgccgccgccgtgtgcatcaacttcatcatcatcatgctgctgaacctggcctacgagaagatcgcctacctgctgaccaacctggagtaccccagaaccgagagcgagtgggagaacagcttcgccctgaagatgttcctgttccagttcgtgaacctgaacagcagcatcttctacatcgccttcttcctgggcagattcgtgggccaccccggcaagtacaacaagctgttcgacagatggagactggaggagtgccaccccagcggctgcctgatcgacctgtgcctgcagatgggcgtgatcatgttcctgaagcagatctggaacaacttcatggagctgggctaccccctgatccagaactggtggagcagacacaagatcaagagaggcatccacgacgccagcatcccccagtgggagaacgactggaacctgcagcccatgaacctgcacggcctgatggacgagtacctggagatggtgctgcagttcggcttcaccaccatcttcgtggccgccttccccctggcccccctgctggccctgctgaacaacatcatcgagatcagactggacgcctacaagttcgtgacccagtggagaagacccctgcccgccagagccaccgacatcggcatctggctgggcatcctggagggcatcggcatcctggccgtgatcaccaacgccttcgtgatcgccatcaccagcgactacatccccagattcgtgtacgagtacaagtacggcccctgcgccaaccacgtggagcccagcgagaactgcctgaagggctacgtgaacaacagcctgagcttcttcgacctgagcgagctgggcatgggcaagagcggctactgcagatacagagactacagaggccccccctggagcagcaagccctacgagttcaccctgcagtactggcacatcctggccgccagactggccttcatcatcgtgttcgagcacctggtgttcggcatcaagagcttcatcgcctacctgatccccgacgtgcccaagggcctgcacgacagaatcagaagagagaagtacctggtgcaggagatgatgtacgaggccgagctggagcacctgcagcagcagagaagaaagagcggccagcccgtgcaccacgagtggccctag

SEQ ID NO: 16398 - DNA, 2508 bp, Artificial Sequence
  Description of Artificial Sequence: Synthetic coding sequence
atgaactacatcgccagcagcggccccctgttcaaggacggcaagaagagaatcgactacatcctggtgtacagaaagaccaacatccagtacgacaagagaaacaccttcgagaagaacctgagagccgagggcctgatgctggagaaggagcccgccatcgccagccccgacatcatgttcatcaagatccacatcccctgggacaccctgtgcaagtacgccgagagactgaacatcagaatgcccttcagaaagaagtgctactacaccgacggcagaagcaagagcatgggcagaatgcagacctacttcagaagaatcaagaactggatggcccagaaccccatggtgctggacaagagcgccttccccgacctggaggagagcgactgctacaccggccccttcagcagagccagaatccaccacttcatcatcaacaacaaggacaccttcttcagcaacgccaccagaagcagaatcgtgtaccacatgctggagagaaccaagtacgagaacggcatcagcaaggtgggcatcagaaagctgatcaacaacggcagctacatcgccgccttccccccccacgagggcgcctacaagagcagccagcccatcaagacccacggcccccagaacaacagacacctgctgtacgagagatgggccagatggggcatgtggtacaagcaccagcccctggacctgatcagactgtacttcggcgagaagatcggcctgtacttcgcctggctgggctggtacaccggcatgctgatccccgccgccatcgtgggcctgtgcgtgttcttctacggcctgttcaccatgaacaacagccaggtgagccaggagatctgcaaggccaccgaggtgttcatgtgccccctgtgcgacaagaactgcagcctgcagagactgaacgacagctgcatctacgccaaggtgacctacctgttcgacaacggcggcaccgtgttcttcgccatcttcatggccatctgggccaccgtgttcctggagttctggaagagaagaagaagcatcctgacctacacctgggacctgatcgagtgggaggaggaggaggagaccctgagaccccagttcgaggccaagtactacaagatggagatcgtgaaccccatcaccggcaagcccgagccccaccagcccagcagcgacaaggtgaccagactgctggtgagcgtgagcggcatcttcttcatgatcagcctggtgatcaccgccgtgttcggcgtggtggtgtacagactggtggtgatggagcagttcgccagcttcaagtggaacttcatcaagcagtactggcagttcgccaccagcgccgccgccgtgtgcatcaacttcatcatcatcatgctgctgaacctggcctacgagaagatcgcctacctgctgaccaacctggagtaccccagaaccgagagcgagtgggagaacagcttcgccctgaagatgttcctgttccagttcgtgaacctgaacagcagcatcttctacatcgccttcttcctgggcagattcgtgggccaccccggcaagtacaacaagctgttcgacagatggagactggaggagtgccaccccagcggctgcctgatcgacctgtgcctgcagatgggcgtgatcatgttcctgaagcagatctggaacaacttcatggagctgggctaccccctgatccagaactggtggagcagacacaagatcaagagaggcatccacgacgccagcatcccccagtgggagaacgactggaacctgcagcccatgaacctgcacggcctgatggacgagtacctggagatggtgctgcagttcggcttcaccaccatcttcgtggccgccttccccctggcccccctgctggccctgctgaacaacatcatcgagatcagactggacgcctacaagttcgtgacccagtggagaagacccctgcccgccagagccaccgacatcggcatctggctgggcatcctggagggcatcggcatcctggccgtgatcaccaacgccttcgtgatcgccatcaccagcgactacatccccagattcgtgtacgagtacaagtacggcccctgcgccaaccacgtggagcccagcgagaactgcctgaagggctacgtgaacaacagcctgagcttcttcgacctgagcgagctgggcatgggcaagagcggctactgcagatacagagactacagaggccccccctggagcagcaagccctacgagttcaccctgcagtactggcacatcctggccgccagactggccttcatcatcgtgttcgagcacctggtgttcggcatcaagagcttcatcgcctacctgatccccgacgtgcccaagggcctgcacgacagaatcagaagagagaagtacctggtgcaggagatgatgtacgaggccgagctggagcacctgcagcagcagagaagaaagagcggccagcccgtgcaccacgagtggccctag

SEQ ID NO: 16399 - DNA, 2898 bp, Artificial Sequence; identical to SEQ ID NO: 16397
  Description of Artificial Sequence: Synthetic coding sequence

SEQ ID NO: 16400 - DNA, 2652 bp, Artificial Sequence
  Description of Artificial Sequence: Synthetic coding sequence
atgagacccggccccaacaagccctaccccagccacagcaacatcttcgcctaccacagcagcgccctgggcaaggacaaggactacaccgacgagagcgagcacgccacctacgacagaagcagactgatcaacgacttcgtgatcaaggacaagagcgagttcaagaccaagctgagcaagaacgacatgaactacatcgccagcagcggccccctgttcaaggacggcaagaagagaatcgactacatcctggtgtacagaaagaccaacatccagtacgacaagagaaacaccttcgagaagaacctgagagccgagggcctgatgctggagaaggagcccgccatcgccagccccgacatcatgttcatcaagatccacatcccctgggacaccctgtgcaagtacgccgagagactgaacatcagaatgcccttcagaatgcagacctacttcagaagaatcaagaactggatggcccagaaccccatggtgctggacaagagcgccttccccgacctggaggagagcgactgctacaccggccccttcagcagagccagaatccaccacttcatcatcaacaacaaggacaccttcttcagcaacgccaccagaagcagaatcgtgtaccacatgctggagagaaccaagtacgagaacggcatcagcaaggtgggcatcagaaagctgatcaacaacggcagctacatcgccgccttccccccccacgagggcgcctacaagagcagccagcccatcaagacccacggcccccagaacaacagacacctgctgtacgagagatgggccagatggggcatgtggtacaagcaccagcccctggacctgatcagactgtacttcggcgagaagatcggcctgtacttcgcctggctgggctggtacaccggcatgctgatccccgccgccatcgtgggcctgtgcgtgttcttctacggcctgttcaccatgaacaacagccaggtgagccaggagatctgcaaggccaccgaggtgttcatgtgccccctgtgcgacaagaactgcagcctgcagagactgaacgacagctgcatctacgccaaggtgacctacctgttcgacaacggcggcaccgtgttcttcgccatcttcatggccatctgggccaccgtgttcctggagttctggaagagaagaagaagcatcctgacctacacctgggacctgatcgagtgggaggaggaggaggagaccctgagaccccagttcgaggccaagtactacaagatggagatcgtgaaccccatcaccggcaagcccgagccccaccagcccagcagcgacaaggtgaccagactgctggtgagcgtgagcggcatcttcttcatgatcagcctggtgatcaccgccgtgttcggcgtggtggtgtacagactggtggtgatggagcagttcgccagcttcaagtggaacttcatcaagcagtactggcagttcgccaccagcgccgccgccgtgtgcatcaacttcatcatcatcatgctgctgaacctggcctacgagaagatcgcctacctgctgaccaacctggagtaccccagaaccgagagcgagtgggagaacagcttcgccctgaagatgttcctgttccagttcgtgaacctgaacagcagcatcttctacatcgccttcttcctgggcagattcgtgggccaccccggcaagtacaacaagctgttcgacagatggagactggaggagtgccaccccagcggctgcctgatcgacctgtgcctgcagatgggcgtgatcatgttcctgaagcagatctggaacaacttcatggagctgggctaccccctgatccagaactggtggagcagacacaagatcaagagaggcatccacgacgccagcatcccccagtgggagaacgactggaacctgcagcccatgaacctgcacggcctgatggacgagtacctggagatggtgctgcagttcggcttcaccaccatcttcgtggccgccttccccctggcccccctgctggccctgctgaacaacatcatcgagatcagactggacgcctacaagttcgtgacccagtggagaagacccctgcccgccagagccaccgacatcggcatctggctgggcatcctggagggcatcggcatcctggccgtgatcaccaacgccttcgtgatcgccatcaccagcgactacatccccagattcgtgtacgagtacaagtacggcccctgcgccaaccacgtggagcccagcgagaactgcctgaagggctacgtgaacaacagcctgagcttcttcgacctgagcgagctgggcatgggcaagagcggctactgcagatacagagactacagaggccccccctggagcagcaagccctacgagttcaccctgcagtactggcacatcctggccgccagactggccttcatcatcgtgttcgagcacctggtgttcggcatcaagagcttcatcgcctacctgatccccgacgtgcccaagggcctgcacgacagaatcagaagagagaagtacctggtgcaggagatgatgtacgaggccgagctggagcacctgcagcagcagagaagaaagagcggccagcccgtgcaccacgagtggccctag

SEQ ID NO: 16401 - DNA, 1428 bp, Artificial Sequence
  Description of Artificial Sequence: Synthetic coding sequence
atggccgtgtgggccaccgtgttcctggagttctggaagagaagaagagccgtgatcgcctacgactgggacctgatcgactgggaggaggaggagatctgcgtggtgatcgccgccgtgttcggcatcgtgatctacagagtggtgaccgtgagcaccttcgccgccttcaagtgggccctgatcagaaacaacagccaggtggccaccaccggcaccgccgtgtgcatcaacttctgcatcatcatgctgctgaacgtgctgtacgagaaggtggccctgctgctgaccaacctggagcagcccagaaccgagagcgagtgggagaacagcttcaccctgaagatgttcctgttccagttcgtgaacctgaacagcagcaccttctacatcgccttcttcctgggcagattcaccggccaccccggcgcctacctgagactgatcaacagatggagactggaggagtgccaccccagcggctgcctgatcgacctgtgcatgcagatgggcatcatcatggtgctgaagcagacctggaacaacttcatggagctgggctaccccctgatccagaactggtggaccagaagaaaggtgagacaggagcacggccccgagagaaagatcagcttcccccagtgggagaaggactacaacctgcagcccatgaacgcctacggcctgttcgacgagtacctggagatgatcctgcagttcggcttcaccaccatcttcgtggccgccttccccctggcccccctgctggccctgctgaacaacatcatcgagatcagactggacgcctacaagttcgtgacccagtggagaagacccctggccagcagagccaaggacatcggcatctggtacggcatcctggagggcatcggcatcctgagcgtgatcaccaacgccttcgtgatcgccatcaccagcgacttcatccccagactggtgtacgcctacaagtacggcccctgcgccggccagggcgaggccggccagaagtgcatggtgggctacgtgaacgccagcctgagcgtgttcagaatcagcgacttcgagaacagaagcgagcccgagagcgacggcagcgagttcagcggcacccccctgaagtactgcagatacagagactacagagaccccccccacagcctggtgccctacggctacaccctgcagttctggcacgtgctggccgccagactggccttcatcatcgtgttcgagcacctggtgttctgcatcaagcacctgatcagctacctgatccccgacctgcccaaggacctgagagacagaatgagaagagagaagtacctgatccaggagatgatgtacgaggccgagctggagagactgcagaaggagagaaaggagagaaagaagaacggcaaggcccaccacaacgagtggccctag

SEQ ID NO: 16402 - DNA, 2868 bp, Artificial Sequence
  Description of Artificial Sequence: Synthetic coding sequence
atggaggccagcagcagcggcatcaccaacggcaagaccaaggtgttccaccccgagggcggcgtggacctgcagggctaccagctggacatgcagatcctgcccgacggccccaagagcgacgtggacttcagcgagatcctgaacgccatccaggagatggccaaggacgtgaacatcctgttcgacgagctggaggccgtgagcagcccctgcaaggacgacgacagcctgctgcaccccggcaacctgaccagcaccagcgacgacgccagcagactggaggccggcggcgagaccgtgcccgagagaaacaagagcaacggcctgtacttcagagacggcaagtgcagaatcgactacatcctggtgtacagaaagagcaacccccagaccgagaagagagaggtgttcgagagaaacatcagagccgagggcctgcagatggagaaggagagcagcctgatcaacagcgacatcatcttcgtgaagctgcacgccccctgggaggtgctgggcagatacgccgagcagatgaacgtgagaatgcccttcagaagaaagatctactacctgcccagaagatacaagttcatgagcagaatcgacaagcagatcagcagattcagaagatggctgcccaagaagcccatgagactggacaaggagaccctgcccgacctggaggagaacgactgctacaccgcccccttcagccagcagagaatccaccacttcatcatccacaacaaggagaccttcttcaacaacgccaccagaagcagaatcgtgcaccacatcctgcagagaatcaagtacgaggagggcaagaacaagatcggcctgaacagactgctgaccaacggcagctacgaggccgccttccccctgcacgagggcagctacagaagcaagaacagcatcagaacccacggcgccgagaaccacagacacctgctgtacgagtgctgggccagctggggcgtgtggtacaagtaccagcccctggacctggtgagaagatacttcggcgagaagatcggcctgtacttcgcctggctgggctggtacaccggcatgctgttccccgccgccttcatcggcctgttcgtgttcctgtacggcgtgaccaccctggaccacagccaggtgagcaaggaggtgtgccaggccaccgacatcatcatgtgccccgtgtgcgacaagtactgccccttcatgagactgagcgacagctgcgtgtacgccaaggtgacccacctgttcgacaacggcgccaccgtgttcttcgccgtgttcatggccgtgtgggccaccgtgttcctggagttctggaagagaagaagagccgtgatcgcctacgactgggacctgatcgactgggaggaggaggaggaggagatcagaccccagttcgaggccaagtacagcaagaaggagagaatgaaccccatcagcggcaagcccgagccctaccaggccttcaccgacaagtgcagcagactgatcgtgagcgccagcggcatcttcttcatgatctgcgtggtgatcgccgccgtgttcggcatcgtgatctacagagtggtgaccgtgagcaccttcgccgccttcaagtgggccctgatcagaaacaacagccaggtggccaccaccggcaccgccgtgtgcatcaacttctgcatcatcatgctgctgaacgtgctgtacgagaaggtggccctgctgctgaccaacctggagcagcccagaaccgagagcgagtgggagaacagcttcaccctgaagatgttcctgttccagttcgtgaacctgaacagcagcaccttctacatcgccttcttcctgggcagattcaccggccaccccggcgcctacctgagactgatcaacagatggagactggaggagtgccaccccagcggctgcctgatcgacctgtgcatgcagatgggcatcatcatggtgctgaagcagacctggaacaacttcatggagctgggctaccccctgatccagaactggtggaccagaagaaaggtgagacaggagcacggccccgagagaaagatcagcttcccccagtgggagaaggactacaacctgcagcccatgaacgcctacggcctgttcgacgagtacctggagatgatcctgcagttcggcttcaccaccatcttcgtggccgccttccccctggcccccctgctggccctgctgaacaacatcatcgagatcagactggacgcctacaagttcgtgacccagtggagaagacccctggccagcagagccaaggacatcggcatctggtacggcatcctggagggcatcggcatcctgagcgtgatcaccaacgccttcgtgatcgccatcaccagcgacttcatccccagactggtgtacgcctacaagtacggcccctgcgccggccagggcgaggccggccagaagtgcatggtgggctacgtgaacgccagcctgagcgtgttcagaatcagcgacttcgagaacagaagcgagcccgagagcgacggcagcgagttcagcggcacccccctgaagtactgcagatacagagactacagagaccccccccacagcctggtgccctacggctacaccctgcagttctggcacgtgctggccgccagactggccttcatcatcgtgttcgagcacctggtgttctgcatcaagcacctgatcagctacctgatccccgacctgcccaaggacctgagagacagaatgagaagagagaagtacctgatccaggagatgatgtacgaggccgagctggagagactgcagaaggagagaaaggagagaaagaagaacggcaaggcccaccacaacgagtggccctag

SEQ ID NO: 16403 - DNA, 2763 bp, Artificial Sequence
  Description of Artificial Sequence: Synthetic coding sequence
atggaggccagcagcagcggcatcaccaacggcaagaccaaggtgttccaccccgtggccaaggacgtgaacatcctgttcgacgagctggaggccgtgagcagcccctgcaaggacgacgacagcctgctgcaccccggcaacctgaccagcaccagcgacgacgccagcagactggaggccggcggcgagaccgtgcccgagagaaacaagagcaacggcctgtacttcagagacggcaagtgcagaatcgactacatcctggtgtacagaaagagcaacccccagaccgagaagagagaggtgttcgagagaaacatcagagccgagggcctgcagatggagaaggagagcagcctgatcaacagcgacatcatcttcgtgaagctgcacgccccctgggaggtgctgggcagatacgccgagcagatgaacgtgagaatgcccttcagaagaaagatctactacctgcccagaagatacaagttcatgagcagaatcgacaagcagatcagcagattcagaagatggctgcccaagaagcccatgagactggacaaggagaccctgcccgacctggaggagaacgactgctacaccgcccccttcagccagcagagaatccaccacttcatcatccacaacaaggagaccttcttcaacaacgccaccagaagcagaatcgtgcaccacatcctgcagagaatcaagtacgaggagggcaagaacaagatcggcctgaacagactgctgaccaacggcagctacgaggccgccttccccctgcacgagggcagctacagaagcaagaacagcatcagaacccacggcgccgagaaccacagacacctgctgtacgagtgctgggccagctggggcgtgtggtacaagtaccagcccctggacctggtgagaagatacttcggcgagaagatcggcctgtacttcgcctggctgggctggtacaccggcatgctgttccccgccgccttcatcggcctgttcgtgttcctgtacggcgtgaccaccctggaccacagccaggtgagcaaggaggtgtgccaggccaccgacatcatcatgtgccccgtgtgcgacaagtactgccccttcatgagactgagcgacagctgcgtgtacgccaaggtgacccacctgttcgacaacggcgccaccgtgttcttcgccgtgttcatggccgtgtgggccaccgtgttcctggagttctggaagagaagaagagccgtgatcgcctacgactgggacctgatcgactgggaggaggaggaggaggagatcagaccccagttcgaggccaagtacagcaagaaggagagaatgaaccccatcagcggcaagcccgagccctaccaggccttcaccgacaagtgcagcagactgatcgtgagcgccagcggcatcttcttcatgatctgcgtggtgatcgccgccgtgttcggcatcgtgatctacagagtggtgaccgtgagcaccttcgccgccttcaagtgggccctgatcagaaacaacagccaggtggccaccaccggcaccgccgtgtgcatcaacttctgcatcatcatgctgctgaacgtgctgtacgagaaggtggccctgctgctgaccaacctggagcagcccagaaccgagagcgagtgggagaacagcttcaccctgaagatgttcctgttccagttcgtgaacctgaacagcagcaccttctacatcgccttcttcctgggcagattcaccggccaccccggcgcctacctgagactgatcaacagatggagactggaggagtgccaccccagcggctgcctgatcgacctgtgcatgcagatgggcatcatcatggtgctgaagcagacctggaacaacttcatggagctgggctaccccctgatccagaactggtggaccagaagaaaggtgagacaggagcacggccccgagagaaagatcagcttcccccagtgggagaaggactacaacctgcagcccatgaacgcctacggcctgttcgacgagtacctggagatgatcctgcagttcggcttcaccaccatcttcgtggccgccttccccctggcccccctgctggccctgctgaacaacatcatcgagatcagactggacgcctacaagttcgtgacccagtggagaagacccctggccagcagagccaaggacatcggcatctggtacggcatcctggagggcatcggcatcctgagcgtgatcaccaacgccttcgtgatcgccatcaccagcgacttcatccccagactggtgtacgcctacaagtacggcccctgcgccggccagggcgaggccggccagaagtgcatggtgggctacgtgaacgccagcctgagcgtgttcagaatcagcgacttcgagaacagaagcgagcccgagagcgacggcagcgagttcagcggcacccccctgaagtactgcagatacagagactacagagaccccccccacagcctggtgccctacggctacaccctgcagttctggcacgtgctggccgccagactggccttcatcatcgtgttcgagcacctggtgttctgcatcaagcacctgatcagctacctgatccccgacctgcccaaggacctgagagacagaatgagaagagagaagtacctgatccaggagatgatgtacgaggccgagctggagagactgcagaaggagagaaaggagagaaagaagaacggcaaggcccaccacaacgagtggccctag

SEQ ID NO: 16404 - DNA, 1071 bp, Artificial Sequence
  Description of Artificial Sequence: Synthetic coding sequence
atggccagcctgaccgcctacgacaaggacgtgagcagcggcagctacaacctgagcagcgccaccaccggcagctactacagctgcgtgagccagatcaccatcggctacgacgtggccggccccgtggccatcggcctgacccactggaagaacccctacgtgcagggcagacccaccctgcccagcgacctgcccctgttcgtgagcaaggacgccggcatccccgtgtaccacagaagcttcaccagaaagaccgaccaggccacccccctgagctgccccgccagcctgagcatcacccccgtgcccagctacagcagcagcagccaggagaccctgagccaggacaccaccggcctgagcctgagcatccacggcgccgagaagagactgcagatccaccagagaagaagcgtggccagcagacccgccagcagaagaagactgcccgtggtgagacacagcagcctgccccccggcagaagaagcatcaagatggaggccagcagcagcggcatcaccaacggcaagaccaaggtgttccaccccgagggcggcgtggacctgcagggctaccagctggacatgcagatcctgcccgacggccccaagagcgacgtggacttcagcgagatcctgaacgccatccaggagatggccaaggacgtgaacatcctgttcgacgagctggaggccgtgagcagcccctgcaaggacgacgacagcctgctgcaccccggcaacctgaccagcaccagcgacgacgccagcagactggaggccggcggcgagaccgtgcccgagagaaacaagagcaacggcctgtacttcagagacggcaagtgcagaatcgactacatcctggtgtacagaaagagcaacccccagaccgagaagagagaggtgttcgagagaaacatcagagccgagggcctgcagatggagaaggagagcagcctgatcaacagcgacatcatcttcgtgaagctgcacgccccctgggaggtgctgggcagatacgccgagcagatgaacgtgagaatgcccttcagcagcaactgcaactag

SEQ ID NO: 16405 - DNA, 36 bp, Artificial Sequence
  Description of Artificial Sequence: Synthetic coding sequence
atggaggccagcagcagcggcatcaccaacggctag

SEQ ID NO: 16406 - DNA, 1428 bp, Artificial Sequence; identical to SEQ ID NO: 16401
  Description of Artificial Sequence: Synthetic coding sequence

SEQ ID NO: 16407 - DNA, 2802 bp, Artificial Sequence
  Description of Artificial Sequence: Synthetic coding sequence
atgagaatggccgccaccgcctgggccggcctgcagggcccccccctgcccaccctgtgccccgccgtgagaaccggcctgtactgcagagaccaggcccacgccgagagatgggccatgaccagcgagaccagcagcggcagccactgcgccagaagcagaatgctgagaagaagagcccaggaggaggacagcaccgtgctgatcgacgtgagcccccccgaggccgagaagagaggcagctacggcagcaccgcccacgccagcgagcccggcggccagcaggccgccgcctgcagagccggcagccccgccaagcccagaatcgccgacttcgtgctggtgtgggaggaggacctgaagctggacagacagcaggacagcgccgccagagacagaaccgacatgcacagaacctggagagagaccttcctggacaacctgagagccgccggcctgtgcgtggaccagcaggacgtgcaggacggcaacaccaccgtgcactacgccctgctgagcgccagctgggccgtgctgtgctactacgccgaggacctgagactgaagctgcccctgcaggagctgcccaaccaggccagcaactggagcgccggcctgctggcctggctgggcatccccaacgtgctgctggaggtggtgcccgacgtgccccccgagtactacagctgcagattcagagtgaacaagctgcccagattcctgggcagcgacaaccaggacaccttcttcaccagcaccaagagacaccagatcctgttcgagatcctggccaagaccccctacggccacgagaagaagaacctgctgggcatccaccagctgctggccgagggcgtgctgagcgccgccttccccctgcacgacggccccttcaagaccccccccgagggcccccaggcccccagactgaaccagagacaggtgctgttccagcactgggccagatggggcaagtggaacaagtaccagcccctggaccacgtgagaagatacttcggcgagaaggtggccctgtacttcgcctggctgggcttctacaccggctggctgctgcccgccgccgtggtgggcaccctggtgttcctggtgggctgcttcctggtgttcagcgacatccccacccaggagctgtgcggcagcaaggacagcttcgagatgtgccccctgtgcctggactgccccttctggctgctgagcagcgcctgcgccctggcccaggccggcagactgttcgaccacggcggcaccgtgttcttcagcctgttcatggccctgtgggccgtgctgctgctggagtactggaagagaaagagcgccaccctggcctacagatgggactgcagcgactacgaggacaccgaggagagacccagaccccagttcgccgccagcgcccccatgaccgcccccaaccccatcaccggcgaggacgagccctacttccccgagagaagcagagccagaagaatgctggccggcagcgtggtgatcgtggtgatggtggccgtggtggtgatgtgcctggtgagcatcatcctgtacagagccatcatggccatcgtggtgagcagaagcggcaacaccctgctggccgcctgggccagcagaatcgccagcctgaccggcagcgtggtgaacctggtgttcatcctgatcctgagcaagatctacgtgagcctggcccacgtgctgaccagatgggagatgcacagaacccagaccaagttcgaggacgccttcaccctgaaggtgttcatcttccagttcgtgaacttctacagcagccccgtgtacatcgccttcttcaagggcagattcgtgggctaccccggcaactaccacaccctgttcggcgtgagaaacgaggagtgcgccgccggcggctgcctgatcgagctggcccaggagctgctggtgatcatggtgggcaagcaggtgatcaacaacatgcaggaggtgctgatccccaagctgaagggctggtggcagaagttcagactgagaagcaagaagagaaaggccggcgccagcgccggcgccagccagggcccctgggaggacgactacgagctggtgccctgcgagggcctgttcgacgagtacctggagatggtgctgcagttcggcttcgtgaccatcttcgtggccgcctgccccctggcccccctgttcgccctgctgaacaactgggtggagatcagactggacgccagaaagttcgtgtgcgagtacagaagacccgtggccgagagagcccaggacatcggcatctggttccacatcctggccggcctgacccacctggccgtgatcagcaacgccttcctgctggccttcagcagcgacttcctgcccagagcctactacagatggaccagagcccacgacctgagaggcttcctgaacttcaccctggccagagcccccagcagcttcgccgccgcccacaacagaacctgcagatacagagccttcagagacgacgacggccactacagccagacctactggaacctgctggccatcagactggccttcgtgatcgtgttcgagcacgtggtgttcagcgtgggcagactgctggacctgctggtgcccgacatccccgagagcgtggagatcaaggtgaagagagagtactacctggccaagcaggccctggccgagaacgaggtgctgttcggcaccaacggcaccaaggacgagcagcccgagggcagcgagctgagcagccactggacccccttcaccgtgcccaaggccagccagctgcagcagtag

SEQ ID NO: 16408 - DNA, 2652 bp, Artificial Sequence
  Description of Artificial Sequence: Synthetic coding sequence
atgagaatggccgccaccgcctgggccggcctgcagggcccccccctgcccaccctgtgccccgccgtgagaaccggcctgtactgcagagaccaggcccacgccgagagatgggccatgaccagcgagaccagcagcggcagccactgcgccagaagcagaatgctgagaagaagagcccaggaggaggacagcaccgtgctgatcgacgtgagcccccccgaggccgagaagagaggcagctacggcagcaccgcccacgccagcgagcccggcggccagcaggccgccgcctgcagagccggcagccccgccaagcccagaatcgacttcgtgctggtgtgggaggaggacctgaagctggacagacagcaggacagcgccgccagagacagaaccgacatgcacagaacctggagagagaccttcctggacaacctgagagccgccggcctgtgcgtggaccagcaggacgtgcaggacggcaacaccaccgtgcactacgccctgctgagcgccagctgggccgtgctgtgctactacgccgaggacctgagactgaagctgcccctgcaggagctgcccaaccaggccagcaactggagcgccggcctgctggcctggctgggcatccccaacgtgctgctggaggtggtgcccgacgtgccccccgagtactacagctgcagattcagagtgaacaagctgcccagattcctgggcagcgacaaccaggacaccttcttcaccagcaccaagagacaccagatcctgttcgagatcctggccaagaccccctacggccacgagaagaagaacctgctgggcatccaccagctgctggccgagggcgtgctgagcgccgccttccccctgcacgacggccccttcaagaccccccccgagggcccccaggcccccagactgaaccagagacaggtgctgttccagcactgggccagatggggcaagtggaacaagtaccagcccctggaccacgtgagaagatacttcggcgagaaggtggccctgtacttcgcctggctgggcttctacaccggctggctgctgcccgccgccgtggtgggcaccctggtgttcctggtgggctgcttcctggtgttcagcgacatccccacccaggagctgtgcggcagcaaggacagcttcgagatgtgccccctgtgcctggactgccccttctggctgctgagcagcgcctgcgccctggcccaggccggcagactgttcgaccacggcggcaccgtgttcttcagcctgttcatggccctgtgggccgtgctgctgctggagtactggaagagaaagagcgccaccctggcctacagatgggactgcagcgactacgaggacaccgaggagagacccagaccccagttcgccgccagcgcccccatgaccgcccccaaccccatcaccggcgaggacgagccctacttccccgagagaagcagagccagaagaatgctggccggcagcgtggtgatcgtggtgatggtggccgtggtggtgatgtgcctggtgagcatcatcctgtacagagccatcatggccatcgtggtgagcagaagcggcaacaccctgctggccgcctgggccagcagaatcgccagcctgaccggcagcgtggtgaacctggtgttcatcctgatcctgagcaagatctacgtgagcctggcccacgtgctgaccagatgggagatgcacagaacccagaccaagttcgaggacgccttcaccctgaaggtgttcatcttccagttcgtgaacttctacagcagccccgtgtacatcgccttcttcaagggcagattcgtgggctaccccggcaactaccacaccctgttcggcgtgagaaacgaggagtgcgccgccggcggctgcctgatcgagctggcccaggagctgctggtgatcatggtgggcaagcaggtgatcaacaacatgcaggaggtgctgatccccaagctgaagggctggtggcagaagttcagactgagaagcaagaagagaaaggccggcgccagcgccggcgccagccagggcccctgggaggacgactacgagctggtgccctgcgagggcctgttcgacgagtacctggagatggtgctgcagttcggcttcgtgaccatcttcgtggccgcctgccccctggcccccctgttcgccctgctgaacaactgggtggagatcagactggacgccagaaagttcgtgtgcgagtacagaagacccgtggccgagagagcccaggacatcggcatctggttccacatcctggccggcctgacccacctggccgtgatcagcaacgccttcctgctggccttcagcagcgacttcctgcccagagcctactacagatggaccagagcccacgacctgagaggcttcctgaacttcaccctggccagagcccccagcagcttcgccgccgcccacaacagaacctgcagatacagagccttcagagacgacgacggccactacagccagacctactggaacctgctggccatcagactggccttcgtgatcgtgttcgaggtggccgaggcccccgccggcagccccatccacggcatgagacccagaccctgcgccctgcccaacagcagcacctggtag

SEQ ID NO: 16409 - DNA, 540 bp, Artificial Sequence
  Description of Artificial Sequence: Synthetic coding sequence
atgagaatggccgccaccgcctgggccggcctgcagggcccccccctgcccaccctgtgccccgccgtgagaaccggcctgtactgcagagaccaggcccacgccgagagatgggccatgaccagcgagaccagcagcggcagccactgcgccagaagcagaatgctgagaagaagagcccaggaggaggacagcaccgtgctgatcgacgtgagcccccccgaggccgagaagagaggcagctacggcagcaccgcccacgccagcgagcccggcggccagcaggccgccgcctgcagagccggcagccccgccaagcccagaatcgacttcgtgctggtgtgggaggaggacctgaagctggacagacagcaggacagcgccgccagagacagaaccgacatgcacagaacctggagagagaccttcctggacaacctgagagccgccggcctgtgcgtggaccaggtgagaggcggctgccacggccagggccccagaccctgcatccacagcgtgacccacgacctggccgcctag

SEQ ID NO: 16410 - DNA, 3699 bp, Artificial Sequence
  Description of Artificial Sequence: Synthetic coding sequence
atggccgaggccgccagcggcgccggcggcaccagcctggagggcgagagaggcaagagacccccccccgagggcgagcccgccgcccccgccagcggcgtgctggacaagctgttcggcaagagactgctgcaggccggcagatacctggtgagccacaaggcctggatgaagaccgtgcccaccgagaactgcgacgtgctgatgaccttccccgacaccaccgacgaccacaccctgctgtggctgctgaaccacatcagagtgggcatccccgagctgatcgtgcaggtgagacaccacagacacaccagagcctacgccttcttcgtgaccgccacctacgagagcctgctgagaggcgccgacgagctgggcctgagaaaggccgtgaaggccgagttcggcggcggcaccagaggcttcagctgcgaggaggacttcatctacgagaacgtggagagcgagctgagattcttcaccagccaggagagacagagcatcatcagattctggctgcagaacctgagagccaagcagggcgaggccctgcacaacgtgagattcctggaggaccagcccatcatccccgagctggccgccagaggcatcatccagcaggtgttccccgtgcacgagcagagaatcctgaacagactgatgaagagctgggtgcaggccgtgtgcgagaaccagcccctggacgacatctgcgactacttcggcgtgaagatcgccatgtacttcgcctggctgggcttctacaccagcgccatggtgtaccccgccgtgttcggcagcgtgctgtacaccttcaccgaggccgaccagaccagcagagacgtgagctgcgtggtgttcgccctgttcaacgtgatctggagcaccctgttcctggaggagtggaagagaagaggcgccgagctggcctacaagtggggcaccctggacagccccggcgaggccgtggaggagcccagaccccagttcagaggcgtgagaagaatcagccccatcaccagagccgaggagttctactaccccccctggaagagactgctgttccagctgctggtgagcctgcccctgtgcctggcctgcctggtgtgcgtgttcctgctgatgctgggctgcttccagctgcaggagctggtgctgagcgtgaagggcctgcccagactggccagattcctgcccaaggtgatgctggccctgctggtgagcgtgagcgccgagggctacaagaagctggccatctggctgaacgacatggagaactacagactggagagcgcctacgagaagcacctgatcatcaaggtggtgctgttccagttcgtgaacagctacctgagcctgttctacatcggcttctacctgaaggacatggagagactgaaggagatgctggccaccctgctgatcaccagacagttcctgcagaacgtgagagaggtgctgcagccccacctgtacagaagactgggcagaggcgagctgggcctgagagccgtgtgggagctggccagagccctgctgggcctgctgagcctgagaagacccgcccccagaagactggagccccaggccgacgagggcggcggcggcggcagcggcggcggcggcagaagatgcctgagcggcggctgcggcgcccccgaggaggaggaggaggccgccctggtggagagaagaagagccggcgagggcggcgaggagggcgacggcccccccggcggcaaggaggaggacgaggacgacgaggaggaggaggacgaggaggaggaggaggacgaggaggagggcgaggagggcggcctgctggactgcggcctgagactgaagaaggtgagcttcgccgagagaggcgccggcagaagaagacccggccccagccccgaggccctgctggaggagggcagccccaccatggtggagaagggcctggagcccggcgtgttcaccctggccgaggaggacgacgaggccgagggcgcccccggcagccccgagagagagccccccgccatcctgttcagaagagccggcggcgagggcagagaccagggccccgacggcggccccgaccccgagcccggcagcaacagcgacagcaccagaagacagagaagacagaacagaagcagctggatcgacccccccgaggaggagcacagcccccagctgacccaggccgagctggagagctgcatgaagaagtacgaggacaccttccaggactaccaggagatgttcgtgcagttcggctacgtggtgctgttcagcagcgccttccccctggccgccctgtgcgccctggtgaacaacctgatcgagatcagaagcgacgccttcaagctgtgcaccggcctgcagagacccttcggccagagagtggagagcatcggccagtggcagaaggtgatggaggccatgggcgtgctggccatcgtggtgaactgctacctgatcggccagtgcggccagctgcagagactgttcccctggctgagccccgaggccgccatcgtgagcgtggtggtgctggagcacttcgccctgctgctgaagtacctgatccacgtggccatccccgacatccccggctgggtggccgaggagatggccaagctggagtaccagagaagagaggccttcaagagacacgagagacaggcccagcacagataccagcagcagcagagaagaagaagagaggaggaggagagacagagacacgccgagcaccacgccagaagagagcacgacagcggcggcagagaggaggccagagccgagggcagcggcctggaccccgccaccagcagcgagaaggccagcgccaaggccaagggcagcaccgccggcggccacggccccgagagacccaagagacccggcagcctgctggcccccaacaacgtgatgaagctgaagcagatcatccccctgcagggcaagttcctgagcagcggcgccaccagcagcctggccgccgccggcgccggcgccaccaccagacccccccccgcccagagccccaccggcagcgacaccagactgcccgccttcctgagcttcaagttcctgaagagccccgagaccagaagagacagcgagagaagccacagcccccccaaggccttccacgccggcaagctgttccccttcggcggcaccagagccgagcccggcagcaacggcgccggcggccaggccagacccgacggcacccccagcagcggcagcagcagagtgcagagaagcggccccgtggacgaggccctggccgaggagctggaggcccccagacccgaggaggagggcagcggcaccgccctggcccccgtgggcgcccccgccctgagaaccagaagaagcagaagccccgccccccccccccccatgcccctgcccagaccccccaccccccccgccggctgctggcagtgggacggcccctggggctgcggcggcgagggcgccgcccccagacaggccctggccgccgccgagtgccccccctgcgccatggccggccccccccccgccccccagcccctgcccggcgacgccagcttctacagcctgccccccccccccctgccccccaccagcgaccccctggagacccccgcccccagccccagccccagccccagcccccaggccgtgtgctggcccagcggctggcactag

SEQ ID NO: 16411 - DNA, 2349 bp, Artificial Sequence
  Description of Artificial Sequence: Synthetic coding sequence
atgcagggcgaggagagcctgagaatcctggtggagcccgagggcgacagcttccccctgatggagatcagcacctgcgagaccgaggccagcgagcagtgggactacgtgctggtggcccagagacacacccagagagaccccagacaggccagacagcagcagttcctggaggagctgagaagaaagggcttccacatcaaggtgatcagagaccagaagcaggtgttcttcggcatcagagccgacaacagcgtgttcggcctgtacagaaccttcctgctggagcccgagggccccgccccccacgccgagctggccgcccccaccaccatccccgtgaccaccagcctgagaatcagaatcgtgaacttcgtggtgatgaacaacaagaccagcgccggcgagaccttcgaggacctgatgaaggacggcgtgttcgaggccagattccccctgcacaagggcgagggcagactgaagaagacctgggccagatggagacacatgttcagagagcagcccgtggacgagatcagaaactacttcggcgagaaggtggccctgtacttcgtgtggctgggctggtacacctacatgctggtgcccgccgccctgaccggcctgctggtgttcctgagcggcttcagcctgttcgaggccagccagatcagcaaggagatctgcgaggcccacgacatcctgatgtgccccctgggcgaccacagcagaagataccagagactgagcgagacctgcaccttcgccaagctgacccacctgttcgacaacgacggcaccgtggtgttcgccatcttcatggccctgtgggccaccgtgttcctggagatctggaagagacagagagccagagtggtgctgcactgggacctgtacgtgtgggacgaggagcaggaggagatggccctgcagctgatcaactgccccgactacaagctgagaccctaccagcacagctacctgagaagcaccgtgatcctggtgctgaccctgctgatgatctgcctgatgatcggcatggcccacgtgctggtggtgtacagagtgctggccagcgccctgttcagcagcagcgccgtgcccttcctggaggagcaggtgaccaccgccgtggtggtgaccggcgccctggtgcactacgtgaccatcatcatcatgaccaagatcaacagatgcgtggccctgaagctgtgcgacttcgagatgcccagaaccttcagcgagagagagagcagattcaccatcagattcttcaccctgcagttcttcacccacttcagcagcctgatctacatcgccttcatcctgggcagaatcaacggccaccccggcaagagcaccagactggccggcctgtggaagctggaggagtgccacgccagcggctgcatgatggacctgttcgtgcagatggccatcatcatgggcctgaagcagaccctgagcaactgcgtggagtacctggtgccctgggtgacccacaagtgcagaagcctgagagccagcgagagcggccacctgcccagagaccccgagctgagagactggagaagaaactacctgctgaaccccgtgaacaccttcagcctgttcgacgagttcatggagatgatgatccagtacggcttcaccaccatcttcgtggccgccttccccctggcccccctgctggccctgttcagcaacctggtggagatcagactggacgccatcaagatggtgtggctgcagagaagactggtgcccagaaaggccaaggacatcggcacctggctgcaggtgctggagaccatcggcgtgctggccgtgatcgccaacggcatggtgatcgccttcaccagcgagttcatccccagagtggtgtacaagtacagatacagcccctgcctgaaggagggcaacagcaccgtggactgcctgaagggctacgtgaaccacagcctgagcgtgttccacaccaaggacttccaggaccccgacggcatcgagggcagcgagaacgtgaccctgtgcagatacagagactacagaaacccccccgactacaacttcagcgagcagttctggttcctgctggccatcagactggccttcgtgatcctgttcgagcacgtggccctgtgcatcaagctgatcgccgcctggttcgtgcccgacatcccccagagcgtgaagaacaaggtgctggaggtgaagtaccagagactgagagagaagatgtggcacggcagacagagactgggcggcgtgggcgccggcagcagaccccccatgcccgcccaccccacccccgccagcatcttcagcgccagaagcaccgacgtgtag

SEQ ID NO: 16412 - DNA, 2592 bp, Artificial Sequence
  Description of Artificial Sequence: Synthetic coding sequence
atgaagaagttcttcgacagcagaagagagcagggcggcagcggcctgggcagcggcagcagcggcggcggcggcagcaccagcggcctgggcagcggctacatcggcagagtgttcggcatcggcagacagcaggtgaccgtggacgaggtgctggccgagggcggcttcgccatcgtgttcctggtgagaaccagcaacggcatgaagtgcgccctgaagagaatgttcgtgaacaacgagcacgacctgcaggtgtgcaagagagagatccagatcatgagagacctgagcggccacaagaacatcgtgggctacatcgacagcagcatcaacaacgtgagcagcggcgacgtgtgggaggtgctgatcctgatggacttctgcagaggcggccaggtggtgaacctgatgaaccagagactgcagaccggcttcaccgagaacgaggtgctgcagatcttctgcgacacctgcgaggccgtggccagactgcaccagtgcaagacccccatcatccacagagacctgaaggtggagaacatcctgctgcacgacagaggccactacgtgctgtgcgacttcggcagcgccaccaacaagttccagaacccccagaccgagggcgtgaacgccgtggaggacgagatcaagaagtacaccaccctgagctacagagcccccgagatggtgaacctgtacagcggcaagatcatcaccaccaaggccgacatctgggccctgggctgcctgctgtacaagctgtgctacttcaccctgcccttcggcgagagccaggtggccatctgcgacggcaacttcaccatccccgacaacagcagatacagccaggacatgcactgcctgatcagatacatgctggagcccgaccccgacaagagacccgacatctaccaggtgagctacttcagcttcaagctgctgaagaaggagtgccccatccccaacgtgcagaacagccccatccccgccaagctgcccgagcccgtgaaggccagcgaggccgccgccaagaagacccagcccaaggccagactgaccgaccccatccccaccaccgagaccagcatcgcccccagacagagacccaaggccggccagacccagcccaaccccggcatcctgcccatccagcccgccctgacccccagaaagagagccaccgtgcagccccccccccaggccgccggcagcagcaaccagcccggcctgctggccagcgtgccccagcccaagccccaggccccccccagccagcccctgccccagacccaggccaagcagccccaggccccccccaccccccagcagacccccagcacccaggcccagggcctgcccgcccaggcccaggccaccccccagcaccagcagcagctgttcctgaagcagcagcagcagcagcagcagcccccccccgcccagcagcagcccgccggcaccttctaccagcagcagcaggcccagacccagcagttccaggccgtgcaccccgccacccagaagcccgccatcgcccagttccccgtggtgagccagggcggcagccagcagcagctgatgcagaacttctaccagcagcagcagcagcagcagcagcagcagcagcagcagcagctggccaccgccctgcaccagcagcagctgatgacccagcaggccgccctgcagcagaagcccaccatggccgccggccagcagccccagccccagcccgccgccgccccccagcccgcccccgcccaggagcccgccatccaggcccccgtgagacagcagcccaaggtgcagaccacccccccccccgccgtgcagggccagaaggtgggcagcctgaccccccccagcagccccaagacccagagagccggccacagaagaatcctgagcgacgtgacccacagcgccgtgttcggcgtgcccgccagcaagagcacccagctgctgcaggccgccgccgccgaggccagcctgaacaagagcaagagcgccaccaccacccccagcggcagccccagaaccagccagcagaacgtgtacaaccccagcgagggcagcacctggaaccccttcgacgacgacaacttcagcaagctgaccgccgaggagctgctgaacaaggacttcgccaagctgggcgagggcaagcaccccgagaagctgggcggcagcgccgagagcctgatccccggcttccagagcacccagggcgacgccttcgccaccaccagcttcagcgccggcaccgccgagaagagaaagggcggccagaccgtggacagcggcctgcccctgctgagcgtgagcgaccccttcatccccctgcaggtgcccgacgcccccgagaagctgatcgagggcctgaagagccccgacaccagcctgctgctgcccgacctgctgcccatgaccgaccccttcggcagcaccagcgacgccgtgatcggcaaggtgatcatcagcgtgagcagcgtgatgcacgacatgtgcgcctgcttcaagaacgacaagtacctggtgaaccagagcctgggcaacagccccgccacccccgaggccaaggccatctag

SEQ ID NO: 16413 - DNA, 2886 bp, Artificial Sequence
  Description of Artificial Sequence: Synthetic coding sequence
atgaagaagttcttcgacagcagaagagagcagggcggcagcggcctgggcagcggcagcagcggcggcggcggcagcaccagcggcctgggcagcggctacatcggcagagtgttcggcatcggcagacagcaggtgaccgtggacgaggtgctggccgagggcggcttcgccatcgtgttcctggtgagaaccagcaacggcatgaagtgcgccctgaagagaatgttcgtgaacaacgagcacgacctgcaggtgtgcaagagagagatccagatcatgagagacctgagcggccacaagaacatcgtgggctacatcgacagcagcatcaacaacgtgagcagcggcgacgtgtgggaggtgctgatcctgatggacttctgcagaggcggccaggtggtgaacctgatgaaccagagactgcagaccggcttcaccgagaacgaggtgctgcagatcttctgcgacacctgcgaggccgtggccagactgcaccagtgcaagacccccatcatccacagagacctgaaggtggagaacatcctgctgcacgacagaggccactacgtgctgtgcgacttcggcagcgccaccaacaagttccagaacccccagaccgagggcgtgaacgccgtggaggacgagatcaagaagtacaccaccctgagctacagagcccccgagatggtgaacctgtacagcggcaagatcatcaccaccaaggccgacatctgggccctgggctgcctgctgtacaagctgtgctacttcaccctgcccttcggcgagagccaggtggccatctgcgacggcaacttcaccatccccgacaacagcagatacagccaggacatgcactgcctgatcagatacatgctggagcccgaccccgacaagagacccgacatctaccaggtgagctacttcagcttcaagctgctgaagaaggagtgccccatccccaacgtgcagaacagccccatccccgccaagctgcccgagcccgtgaaggccagcgaggccgccgccaagaagacccagcccaaggccagactgaccgaccccatccccaccaccgagaccagcatcgcccccagacagagacccaaggccggccagacccagcccaaccccggcatcctgcccatccagcccgccctgacccccagaaagagagccaccgtgcagccccccccccaggccgccggcagcagcaaccagcccggcctgctggccagcgtgccccagcccaagccccaggccccccccagccagcccctgccccagacccaggccaagcagccccaggccccccccaccccccagcagacccccagcacccaggcccagggcctgcccgcccaggcccaggccaccccccagcaccagcagcagctgttcctgaagcagcagcagcagcagcagcagcccccccccgcccagcagcagcccgccggcaccttctaccagcagcagcaggcccagacccagcagttccaggccgtgcaccccgccacccagaagcccgccatcgcccagttccccgtggtgagccagggcggcagccagcagcagctgatgcagaacttctaccagcagcagcagcagcagcagcagcagcagcagcagcagcagctggccaccgccctgcaccagcagcagctgatgacccagcaggccgccctgcagcagaagcccaccatggccgccggccagcagccccagccccagcccgccgccgccccccagcccgcccccgcccaggagcccgccatccaggcccccgtgagacagcagcccaaggtgcagaccacccccccccccgccgtgcagggccagaaggtgggcagcctgaccccccccagcagccccaagacccagagagccggccacagaagaatcctgagcgacgtgacccacagcgccgtgttcggcgtgcccgccagcaagagcacccagctgctgcaggccgccgccgccgaggccagcctgaacaagagcaagagcgccaccaccacccccagcggcagccccagaaccagccagcagaacgtgtacaaccccagcgagggcagcacctggaaccccttcgacgacgacaacttcagcaagctgaccgccgaggagctgctgaacaaggacttcgccaagctgggcgagggcaagcaccccgagaagctgggcggcagcgccgagagcctgatccccggcttccagagcacccagggcgacgccttcgccaccaccagcttcagcgccggcaccgccgagaagagaaagggcggccagaccgtggacagcggcctgcccctgctgagcgtgagcgaccccttcatccccctgcaggtgcccgacgcccccgagaagctgatcgagggcctgaagagccccgacaccagcctgctgctgcccgacctgctgcccatgaccgaccccttcggcagcaccagcgacgccgtgatcgagaaggccgacgtggccgtggagagcctgatccccggcctggagccccccgtgccccagagactgcccagccagaccgagagcgtgaccagcaacagaaccgacagcctgaccggcgaggacagcctgctggactgcagcctgctgagcaaccccaccaccgacctgctggaggagttcgcccccaccgccatcagcgcccccgtgcacaaggccgccgaggacagcaacctgatcagcggcttcgacgtgcccgagggcagcgacaaggtggccgaggacgagttcgaccccatccccgtgctgatcaccaagaacccccagggcggccacagcagaaacagcagcggcagcagcgagagcagcctgcccaacctggccagaagcctgctgctggtggaccagctgatcgacctgtag

SEQ ID NO: 16414 - DNA, 1143 bp, Artificial Sequence
  Description of Artificial Sequence: Synthetic coding sequence
atggaggagggcggcgacttcgacaactactacggcgccgacaaccagagcgagtgcgagtacaccgactggaagagcagcggcgccctgatccccgccatctacatgctggtgttcctgctgggcaccaccggcaacggcctggtgctgtggaccgtgttcagaagcagcagagagaagagaagaagcgccgacatcttcatcgccagcctggccgtggccgacctgaccttcgtggtgaccctgcccctgtgggccacctacacctacagagactacgactggcccttcggcaccttcttctgcaagctgagcagctacctgatcttcgtgaacatgtacgccagcgtgttctgcctgaccggcctgagcttcgacagatacctggccatcgtgagacccgtggccaacgccagactgagactgagagtgagcggcgccgtggccaccgccgtgctgtgggtgctggccgccctgctggccatgcccgtgatggtgctgagaaccaccggcgacctggagaacaccaccaaggtgcagtgctacatggactacagcatggtggccaccgtgagcagcgagtgggcctgggaggtgggcctgggcgtgagcagcaccaccgtgggcttcgtggtgcccttcaccatcatgctgacctgctacttcttcatcgcccagaccatcgccggccacttcagaaaggagagaatcgagggcctgagaaagagaagaagactgctgagcatcatcgtggtgctggtggtgaccttcgccctgtgctggatgccctaccacctggtgaagaccctgtacatgctgggcagcctgctgcactggccctgcgacttcgacctgttcctgatgaacatcttcccctactgcacctgcatcagctacgtgaacagctgcctgaaccccttcctgtacgccttcttcgaccccagattcagacaggcctgcaccagcatgctgtgctgcggccagagcagatgcgccggcaccagccacagcagcagcggcgagaagagcgccagctacagcagcggccacagccagggccccggccccaacatgggcaagggcggcgagcagatgcacgagaagagcatcccctacagccaggagaccctggtggtggactag

SEQ ID NO: 16415 - DNA, 786 bp, Artificial Sequence
  Description of Artificial Sequence: Synthetic coding sequence
atggaggagggcggcgacttcgacaactactacggcgccgacaaccagagcgagtgcgagtacaccgactggaagagcagcggcgccctgatccccgccatctacatgctggtgttcctgctggccatgcccgtgatggtgctgagaaccaccggcgacctggagaacaccaccaaggtgcagtgctacatggactacagcatggtggccaccgtgagcagcgagtgggcctgggaggtgggcctgggcgtgagcagcaccaccgtgggcttcgtggtgcccttcaccatcatgctgacctgctacttcttcatcgcccagaccatcgccggccacttcagaaaggagagaatcgagggcctgagaaagagaagaagactgctgagcatcatcgtggtgctggtggtgaccttcgccctgtgctggatgccctaccacctggtgaagaccctgtacatgctgggcagcctgctgcactggccctgcgacttcgacctgttcctgatgaacatcttcccctactgcacctgcatcagctacgtgaacagctgcctgaaccccttcctgtacgccttcttcgaccccagattcagacaggcctgcaccagcatgctgtgctgcggccagagcagatgcgccggcaccagccacagcagcagcggcgagaagagcgccagctacagcagcggccacagccagggccccggccccaacatgggcaagggcggcgagcagatgcacgagaagagcatcccctacagccaggagaccctggtggtggactag

SEQ ID NO: 16416 - DNA, 900 bp, Artificial Sequence
  Description of Artificial Sequence: Synthetic coding sequence
atgctggtgttcctgctgggcaccaccggcaacggcctggtgctgtggaccgtgttcagaagcagcagagagaagagaagaagcgccgacatcttcatcgccagcctggccgtggccgacctgaccttcgtggtgaccctgcccctgtgggccacctacacctacagagactacgactggcccttcggcaccttcttctgcaagctgagcagctacctgatcttcgtgaacatgtacgccatgcccgtgatggtgctgagaaccaccggcgacctggagaacaccaccaaggtgcagtgctacatggactacagcatggtggccaccgtgagcagcgagtgggcctgggaggtgggcctgggcgtgagcagcaccaccgtgggcttcgtggtgcccttcaccatcatgctgacctgctacttcttcatcgcccagaccatcgccggccacttcagaaaggagagaatcgagggcctgagaaagagaagaagactgctgagcatcatcgtggtgctggtggtgaccttcgccctgtgctggatgccctaccacctggtgaagaccctgtacatgctgggcagcctgctgcactggccctgcgacttcgacctgttcctgatgaacatcttcccctactgcacctgcatcagctacgtgaacagctgcctgaaccccttcctgtacgccttcttcgaccccagattcagacaggcctgcaccagcatgctgtgctgcggccagagcagatgcgccggcaccagccacagcagcagcggcgagaagagcgccagctacagcagcggccacagccagggccccggccccaacatgggcaagggcggcgagcagatgcacgagaagagcatcccctacagccaggagaccctggtggtggactag

SEQ ID NO: 16417 - DNA, 621 bp, Artificial Sequence
  Description of Artificial Sequence: Synthetic coding sequence
atgctgccctgcgccgccggcgccagaggcagaggcgccatggtggtgctgagagccggcaagaagaccttcctgccccccctgtgcagagccttcgcctgcagaggctgccagctggcccccgagagaggcgccgagagaagagacaccgcccccagcggcgtgagcagattctgcccccccagaaagagctgccacgactggatcggcccccccgacaagtacagcaacctgagacccgtgcacttctacatccccgagaacgagagccccctggagcagaagctgagaaagctgagacaggagacccaggagtggaaccagcagttctgggccaaccagaacctgaccttcagcaaggagaaggaggagttcatccacagcagactgaagaccaagggcctgggcctgagaaccgagagcggccagaaggccaccctgaacgccgaggagatggccgacttctacaaggagttcctgagcaagaacttccagaagcacatgtactacaacagagactggtacaagagaaacttcgccatcaccttcttcatgggcaaggtggccctggagagaatctggaacaagctgaagcagaagcagaagaagagaagcaactag

SEQ ID NO: 16418 - DNA, 1122 bp, Artificial Sequence
  Description of Artificial Sequence: Synthetic coding sequence
atgggcagccaggtgagcgtggagagcggcgccctgcacgtggtgatcgtgggcggcggcttcggcggcatcgccgccgccagccagctgcaggccctgaacgtgcccttcatgctggtggacatgaaggacagcttccaccacaacgtggccgccctgagagccagcgtggagaccggcttcgccaagaagaccttcatcagctacagcgtgaccttcaaggacaacttcagacagggcctggtggtgggcatcgacctgaagaaccagatggtgctgctgcagggcggcgaggccctgcccttcagccacctgatcctggccaccggcagcaccggccccttccccggcaagttcaacgaggtgagcagccagcaggccgccatccaggcctacgaggacatggtgagacaggtgcagagaagcagattcatcgtggtggtgggcggcggcagcgccggcgtggagatggccgccgagatcaagaccgagtaccccgagaaggaggtgaccctgatccacagccaggtggccctggccgacaaggagctgctgcccagcgtgagacaggaggtgaaggagatcctgctgagaaagggcgtgcagctgctgctgagcgagagagtgagcaacctggaggagctgcccctgaacgagtacagagagtacatcaaggtgcagaccgacaagggcaccgaggtggccaccaacctggtgatcctgtgcaccggcatcaagatcaacagcagcgcctacagaaaggccttcgagagcagactggccagcagcggcgccctgagagtgaacgagcacctgcaggtggagggccacagcaacgtgtacgccatcggcgactgcgccgacgtgagaacccccaagatggcctacctggccggcctgcacgccaacatcgccgtggccaacatcgtgaacagcgtgaagcagagacccctgcaggcctacaagcccggcgccctgaccttcctgctgagcatgggcagaaacgacggcgtgggccagatcagcggcttctacgtgggcagactgatggtgagactgaccaagagcagagacctgttcgtgagcaccagctggaagaccatgagacagagccccccctag

SEQ ID NO: 16419 - DNA, 1122 bp, Artificial Sequence; identical to SEQ ID NO: 16418
  Description of Artificial Sequence: Synthetic coding sequence

SEQ ID NO: 16420 - DNA, 1011 bp, Artificial Sequence
  Description of Artificial Sequence: Synthetic coding sequence
atgggcagccaggtgagcgtggagagcggcgccctgcacgtggtgatcgtgggcggcggcttcggcggcatcgccgccgccagccagctgcaggccctgaacgtgcccttcatgctggtggacatgaaggacagcttccaccacaacgtggccgccctgagagccagcgtggagaccggcttcgccaagaagaccttcatcagctacagcgtgaccttcaaggacaacttcagacagggcctggtggtgggcatcgacctgaagaaccagatggtgctgctgcagggcggcgaggtgcagagaagcagattcatcgtggtggtgggcggcggcagcgccggcgtggagatggccgccgagatcaagaccgagtaccccgagaaggaggtgaccctgatccacagccaggtggccctggccgacaaggagctgctgcccagcgtgagacaggaggtgaaggagatcctgctgagaaagggcgtgcagctgctgctgaccctgctgggcgagagagtgagcaacctggaggagctgcccctgaacgagtacagagagtacatcaaggtgcagaccgacaagggcaccgaggtggccaccaacctggtgatcctgtgcaccggcatcaagatcaacagcagcgcctacagaaaggccttcgagagcagactggccagcagcggcgccctgagagtgaacgagcacctgcaggtggagggccacagcaacgtgtacgccatcggcgactgcgccgacgtgagaacccccaagatggcctacctggccggcctgcacgccaacatcgccgtggccaacatcgtgaacagcgtgaagcagagacccctgcaggcctacaagcccggcgccctgaccttcctgctgagcatgggcagaaacgacggcgtgggccagatcagcggcttctacgtgggcagactgatggtgagactgaccaagagcagagacctgttcgtgagcaccagctggaagaccatgagacagagccccccctag

SEQ ID NO: 16421 - DNA, 906 bp, Artificial Sequence
  Description of Artificial Sequence: Synthetic coding sequence
atggtgttcacccaggcccccgccgagatcatgggccacctgagaatcagaagcctgctggccagacagtgcctggccgagttcctgggcgtgttcgtgctgatgctgctgacccagggcgccgtggcccaggccgtgaccagcggcgagaccaagggcaacttcttcaccatgttcctggccggcagcctggccgtgaccatcgccatctacgtgggcggcaacgtgagcggcgcccacctgaaccccgccttcagcctggccatgtgcatcgtgggcagactgccctgggtgaagctgcccatctacatcctggtgcagctgctgagcgccttctgcgccagcggcgccacctacgtgctgtaccacgacgccctgcagaactacaccggcggcaacctgaccgtgaccggccccaaggagaccgccagcatcttcgccacctaccccgccccctacctgagcctgaacaacggcttcctggaccaggtgctgggcaccggcatgctgatcgtgggcctgctggccatcctggacagaagaaacaagggcgtgcccgccggcctggagcccgtggtggtgggcatgctgatcctggccctgggcctgagcatgggcgccaactgcggcatccccctgaaccccgccagagacctgggccccagactgttcacctacgtggccggctggggccccgaggtgttcagcgccggcaacggctggtggtgggtgcccgtggtggcccccctggtgggcgccaccgtgggcaccgccacctaccagctgctggtggccctgcaccaccccgagggccccgagcccgcccaggacctggtgagcgcccagcacaaggccagcgagctggagacccccgccagcgcccagatgctggagtgcaagctgtag

SEQ ID NO: 16422 - DNA, 795 bp, Artificial Sequence
  Description of Artificial Sequence: Synthetic coding sequence
atggtgttcacccaggcccccgccgagatcatgggccacctgagaatcagaagcctgctggccagacagtgcctggccgagttcctgggcgtgttcgtgctgatgctgctgacccagggcgccgtggcccaggccgtgaccagcggcgagaccaagggcaacttcttcaccatgttcctggccggcagcctggccgtgaccatcgccatctacgtgggcggcaacgtgagcggcgcccacctgaaccccgccttcagcctggccatgtgcatcgtgggcagactgccctgggtgaagctgcccatctacatcctggtgcagctgctgagcgccttctgcgccagcggcgccacctacgtgctgtaccacgacgccctgcagaactacaccggcggcaacctgaccgtgaccggccccaaggagaccgccagcatcttcgccacctaccccgccccctacctgagcctgaacaacggcttcctggaccaggtgctgggcaccggcatgctgatcgtgggcctgctggccatcctggacagaagaaacaagggcgtgcccgccggcctggagcccgtggtggtgggcatgctgatcctggccctgggcctgagcatgggcgccaactgcggcatccccctgaaccccgccagagacctgggccccagactgttcacctacgtggccggctggggccccgaggtgttcagatgggagaccgacagccccggcgccggcctgcacagccccagcagcgccaagggcagcgtgcccggcagcaccgccctgtgcctgtag

SEQ ID NO: 16423 - DNA, 1125 bp, Artificial Sequence
  Description of Artificial Sequence: Synthetic coding sequence
atggccaaggagagaagaagagccgtgctggagctgctgcagagacccggcaacgccagatgcgccgactgcggcgcccccgaccccgactgggccagctacaccctgggcgtgttcatctgcctgagctgcagcggcatccacagaaacatcccccaggtgagcaaggtgaagagcgtgagactggacgcctgggaggaggcccaggtggagttcatggccagccacggcaacgacgccgccagagccagattcgagagcaaggtgcccagcttctactacagacccacccccagcgactgccagctgctgagagagcagtggatcagagccaagtacgagagacaggagttcatctaccccgagaagcaggagccctacagcgccggctacagagagggcttcctgtggaagagaggcagagacaacggccagttcctgagcagaaagttcgtgctgaccgagagagagggcgccctgaagtacttcaacagaaacgacgccaaggagcccaaggccgtgatgaagatcgagcacctgaacgccaccttccagcccgccaagatcggccacccccacggcctgcaggtgacctacctgaaggacaacagcaccagaaacatcttcatctaccacgaggacggcaaggagatcgtggactggttcaacgccctgagagccgccagattccactacctgcaggtggccttccccggcgccggcgacgccgacctggtgcccaagctgagcagaaactacctgaaggagggctacatggagaagaccggccccaagcagaccgagggcttcagaaagagatggttcaccatggacgacagaagactgatgtacttcaaggaccccctggacgccttcgccagaggcgaggtgttcatcggcagcaaggagagcggctacaccgtgctgcacggcttcccccccagcacccagggccaccactggccccacggcatcaccatcgtgacccccgacagaaagttcctgttcgcctgcgagaccgagagcgaccagagagagtgggtggccgccttccagaaggccgtggacagacccatgctgccccaggagtacgccgtggaggcccacttcaagcacaagccctag

SEQ ID NO: 16424 - DNA, 909 bp, Artificial Sequence
  Description of Artificial Sequence: Synthetic coding sequence
atggccagccacggcaacgacgccgccagagccagattcgagagcaaggtgcccagcttctactacagacccacccccagcgactgccagctgctgagagagcagtggatcagagccaagtacgagagacaggagttcatctaccccgagaagcaggagccctacagcgccggctacagagagggcttcctgtggaagagaggcagagacaacggccagttcctgagcagaaagttcgtgctgaccgagagagagggcgccctgaagtacttcaacagaaacgacgccaaggagcccaaggccgtgatgaagatcgagcacctgaacgccaccttccagcccgccaagatcggccacccccacggcctgcaggtgacctacctgaaggacaacagcaccagaaacatcttcatctaccacgaggacggcaaggagatcgtggactggttcaacgccctgagagccgccagattccactacctgcaggtggccttccccggcgccggcgacgccgacctggtgcccaagctgagcagaaactacctgaaggagggctacatggagaagaccggccccaagcagaccgagggcttcagaaagagatggttcaccatggacgacagaagactgatgtacttcaaggaccccctggacgccttcgccagaggcgaggtgttcatcggcagcaaggagagcggctacaccgtgctgcacggcttcccccccagcacccagggccaccactggccccacggcatcaccatcgtgacccccgacagaaagttcctgttcgcctgcgagaccgagagcgaccagagagagtgggtggccgccttccagaaggccgtggacagacccatgctgccccaggagtacgccgtggaggcccacttcaagcacaagccctag

SEQ ID NO: 16425 - DNA, 603 bp, Artificial Sequence
  Description of Artificial Sequence: Synthetic coding sequence
atgaagatcgagcacctgaacgccaccttccagcccgccaagatcggccacccccacggcctgcaggtgacctacctgaaggacaacagcaccagaaacatcttcatctaccacgaggacggcaaggagatcgtggactggttcaacgccctgagagccgccagattccactacctgcaggtggccttccccggcgccggcgacgccgacctggtgcccaagctgagcagaaactacctgaaggagggctacatggagaagaccggccccaagcagaccgagggcttcagaaagagatggttcaccatggacgacagaagactgatgtacttcaaggaccccctggacgccttcgccagaggcgaggtgttcatcggcagcaaggagagcggctacaccgtgctgcacggcttcccccccagcacccagggccaccactggccccacggcatcaccatcgtgacccccgacagaaagttcctgttcgcctgcgagaccgagagcgaccagagagagtgggtggccgccttccagaaggccgtggacagacccatgctgccccaggagtacgccgtggaggcccacttcaagcacaagccctag

SEQ ID NO: 16426 - DNA, 783 bp, Artificial Sequence
  Description of Artificial Sequence: Synthetic coding sequence
atggtgctggccagcctggagctgctgagagagcagtggatcagagccaagtacgagagacaggagttcatctaccccgagaagcaggagccctacagcgccggctacagagagggcttcctgtggaagagaggcagagacaacggccagttcctgagcagaaagttcgtgctgaccgagagagagggcgccctgaagtacttcaacagaaacgacgccaagatcggccacccccacggcctgcaggtgacctacctgaaggacaacagcaccagaaacatcttcatctaccacgaggacggcaaggagatcgtggactggttcaacgccctgagagccgccagattccactacctgcaggtggccttccccggcgccggcgacgccgacctggtgcccaagctgagcagaaactacctgaaggagggctacatggagaagaccggccccaagcagaccgagggcttcagaaagagatggttcaccatggacgacagaagactgatgtacttcaaggaccccctggacgccttcgccagaggcgaggtgttcatcggcagcaaggagagcggctacaccgtgctgcacggcttcccccccagcacccagggccaccactggccccacggcatcaccatcgtgacccccgacagaaagttcctgttcgcctgcgagaccgagagcgaccagagagagtgggtggccgccttccagaaggccgtggacagacccatgctgccccaggagtacgccgtggaggcccacttcaagcacaagccctag

SEQ ID NO: 16427 - DNA, 1158 bp, Artificial Sequence
  Description of Artificial Sequence: Synthetic coding sequence
atgttccagttcgtgttcagcagagtgtactgcatcaaccccgccagaagaaagtggaaggagttcgagaagatgctgggctgcgccgaggagggccacgccagcctgggcagagaccccgactgggccagctacaccctgggcgtgttcatctgcctgagctgcagcggcatccacagaaacatcccccaggtgagcaaggtgaagagcgtgagactggacgcctgggaggaggcccaggtggagttcatggccagccacggcaacgacgccgccagagccagattcgagagcaaggtgcccagcttctactacagacccacccccagcgactgccagctgctgagagagcagtggatcagagccaagtacgagagacaggagttcatctaccccgagaagcaggagccctacagcgccggctacagagagggcttcctgtggaagagaggcagagacaacggccagttcctgagcagaaagttcgtgctgaccgagagagagggcgccctgaagtacttcaacagaaacgacgccaaggagcccaaggccgtgatgaagatcgagcacctgaacgccaccttccagcccgccaagatcggccacccccacggcctgcaggtgacctacctgaaggacaacagcaccagaaacatcttcatctaccacgaggacggcaaggagatcgtggactggttcaacgccctgagagccgccagattccactacctgcaggtggccttccccggcgccggcgacgccgacctggtgcccaagctgagcagaaactacctgaaggagggctacatggagaagaccggccccaagcagaccgagggcttcagaaagagatggttcaccatggacgacagaagactgatgtacttcaaggaccccctggacgccttcgccagaggcgaggtgttcatcggcagcaaggagagcggctacaccgtgctgcacggcttcccccccagcacccagggccaccactggccccacggcatcaccatcgtgacccccgacagaaagttcctgttcgcctgcgagaccgagagcgaccagagagagtgggtggccgccttccagaaggccgtggacagacccatgctgccccaggagtacgccgtggaggcccacttcaagcacaagccctag

SEQ ID NO: 16428 - DNA, 1146 bp, Artificial Sequence
  Description of Artificial Sequence: Synthetic coding sequence
atgggcgacagagagagaaacaagaagagactgctggagctgctgagagcccccgacaccggcaacgcccactgcgccgactgcggcgccgccgaccccgactgggccagctacaagctgggcatcttcatctgcctgaactgctgcggcgtgcacagaaacttccccgacatcagcagagtgaagagcgtgagactggacttctgggacgacagcatcgtggagttcatgatccacaacggcaacctgagagtgaaggccaagttcgaggccagagtgcccgccttctactacatcccccaggccaacgactgcctggtgctgaaggagcagtggatcagagccaagtacgagagaagagagttcatggccgacggcgagaccatcagcctgcccggcaacagagagggcttcctgtggaagagaggcagagacaacagccagttcctgagaagaaagttcgtgctgctggccagagagggcctgctgaagtacttcaccaaggagcagggcaagagccccaaggccgtgatcagcatcaaggacctgaacgccaccttccagaccgagaagatcggccacccccacggcctgcagatcacctacagaagagacggccacaccagaaacctgttcgtgtaccacgagagcggcaaggagatcgtggactggttcaacgccctgagagccgccagactgcagtacctgaagatggccttccccgagctgcccgagagcgagctggtgcccttcctgaccagaaactacctgaagcagggcttcatggagaagaccggccccaagcagaaggagcccttcaagaagagatggttcgccctggactgccacgagagaagactgctgtactacaagaaccccctggacgccttcgagcagggccaggtgttcctgggcaacaaggagcagggctacgaggcctacgaggacctgcccaagggcatcagaggcaacagatggaaggccggcctgaccatcgtgacccccgagagaagattcgtgctgacctgccccagcgagaaggagcagcaggagtggctggagagcctgagaggcgtgctgagcagccccctgacccccctgaacagactgaccgccagcaccgagagcggcagaagcagcagatag

SEQ ID NO: 16429 - DNA, 3021 bp, Artificial Sequence
  Description of Artificial Sequence: Synthetic coding sequence
atgcccgaccagatcagcgtgagcgagttcgtggccgagacccacgaggactacaaggcccccaccgccagcagcttcaccaccagaaccgcccagtgcagaaacaccgtggccgccatcgaggaggccctggacgtggacagaatggtgctgtacaagatgaagaagagcgtgaaggccatcaacagcagcggcctggcccacgtggagaacgaggagcagtacacccaggccctggagaagttcggcggcaactgcgtgtgcagagacgaccccgacctgggcagcgccttcctgaagttcagcgtgttcaccaaggagctgaccgccctgttcaagaacctgatccagaacatgaacaacatcatcagcttccccctggacagcctgctgaagggcgacctgaagggcgtgaagggcgacctgaagaagcccttcgacaaggcctggaaggactacgagaccaagatcaccaagatcgagaaggagaagaaggagcacgccaagctgcacggcatgatcagaaccgagatcagcggcgccgagatcgccgaggagatggagaaggagagaagattcttccagctgcagatgtgcgagtacctgctgaaggtgaacgagatcaagatcaagaagggcgtggacctgctgcagaacctgatcaagtacttccacgcccagtgcaacttcttccaggacggcctgaaggccgtggagagcctgaagcccagcatcgagaccctgagcaccgacctgcacaccatcaagcaggcccaggacgaggagagaagacagctgatccagctgagagacatcctgaagagcgccctgcaggtggagcagaaggaggacagccagatcagacagagcaccgcctacagcctgcaccagccccagggcaacaaggagcacggcaccgagagaaacggcagcctgtacaagaagagcgacggcatcagaaaggtgtggcagaagagaaagtgcagcgtgaagaacggcttcctgaccatcagccacggcaccgccaacagaccccccgccaagctgaacctgctgacctgccaggtgaagaccaaccccgaggagaagaagtgcttcgacctgatcagccacgacagaacctaccacttccaggccgaggacgagcaggagtgccagatctggatgagcgtgctgcagaacagcaaggaggaggccctgaacaacgccttcaagggcgacgacaacaccggcgagaacaacatcgtgcaggagctgaccaaggagatcatcagcgaggtgcagagaatgaccggcaacgacgtgtgctgcgactgcggcgcccccgaccccacctggctgagcaccaacctgggcatcctgacctgcatcgagtgcagcggcatccacagagagctgggcgtgcactacagcagaatgcagagcctgaccctggacgtgctgggcaccagcgagctgctgctggccaagaacatcggcaacgccggcttcaacgagatcatggagtgctgcctgcccgccgaggacagcgtgaagcccaaccccggcagcgacatgaacgccagaaaggactacatcaccgccaagtacatcgagagaagatacgccagaaagaagcacgccgacaacgccgccaagctgcacagcctgtgcgaggccgtgaagaccagagacatcttcggcctgctgcaggcctacgccgacggcgtggacctgaccgagaagatccccctggccaacggccacgagcccgacgagaccgccctgcacctggccgtgagaagcgtggacagaaccagcctgcacatcgtggacttcctggtgcagaacagcggcaacctggacaagcagaccggcaagggcagcaccgccctgcactactgctgcctgaccgacaacgccgagtgcctgaagctgctgctgagaggcaaggccagcatcgagatcgccaacgagagcggcgagacccccctggacatcgccaagagactgaagcacgagcactgcgaggagctgctgacccaggccctgagcggcagattcaacagccacgtgcacgtggagtacgagtggagactgctgcacgaggacctggacgagagcgacgacgacatggacgagaagctgcagcccagccccaacagaagagaggacagacccatcagcttctaccagctgggcagcaaccagctgcagagcaacgccgtgagcctggccagagacgccgccaacctggccaaggagaagcagagagccttcatgcccagcatcctgcagaacgagacctacggcgccctgctgagcggcagccccccccccgcccagcccgccgcccccagcaccaccagcgccccccccctgccccccagaaacgtgggcaaggtgcagaccgccagcagcgccaacaccctgtggaagaccaacagcgtgagcgtggacggcggcagcagacagagaagcagcagcgacccccccgccgtgcacccccccctgccccccctgagagtgaccagcaccaaccccctgacccccaccccccccccccccgtggccaagacccccagcgtgatggaggccctgagccagcccagcaagcccgccccccccggcatcagccagatcagacccccccccctgcccccccagccccccagcagactgccccagaagaagcccgcccccggcgccgacaagagcacccccctgaccaacaagggccagcccagaggccccgtggacctgagcgccaccgaggccctgggccccctgagcaacgccatggtgctgcagccccccgcccccatgcccagaaagagccaggccaccaagctgaagcccaagagagtgaaggccctgtacaactgcgtggccgacaaccccgacgagctgaccttcagcgagggcgacgtgatcatcgtggacggcgaggaggaccaggagtggtggatcggccacatcgacggcgaccccggcagaaagggcgccttccccgtgagcttcgtgcacttcatcgccgactag

SEQ ID NO: 16430 - DNA, 2886 bp, Artificial Sequence
  Description of Artificial Sequence: Synthetic coding sequence
atgcccgaccagatcagcgtgagcgagttcgtggccgagacccacgaggactacaaggcccccaccgccagcagcttcaccaccagaaccgcccagtgcagaaacaccgtggccgccatcgaggaggccctggacgtggacagaatggtgctgtacaagatgaagaagagcgtgaaggccatcaacagcagcggcctggcccacgtggagaacgaggagcagtacacccaggccctggagaagttcggcggcaactgcgtgtgcagagacgaccccgacctgggcagcgccttcctgaagttcagcgtgttcaccaaggagctgaccgccctgttcaagaacctgatccagaacatgaacaacatcatcagcttccccctggacagcctgctgaagggcgacctgaagggcgtgaagggcgacctgaagaagcccttcgacaaggcctggaaggactacgagaccaagatcaccaagatcgagaaggagaagaaggagcacgccaagctgcacggcatgatcagaaccgagatcagcggcgccgagatcgccgaggagatggagaaggagagaagattcttccagctgcagatgtgcgagtacctgctgaaggtgaacgagatcaagatcaagaagggcgtggacctgctgcagaacctgatcaagtacttccacgcccagtgcaacttcttccaggacggcctgaaggccgtggagagcctgaagcccagcatcgagaccctgagcaccgacctgcacaccatcaagcaggcccaggacgaggagagaagacagctgatccagctgagagacatcctgaagagcgccctgcaggtggagcagaaggaggacagccagatcagacagagcaccgcctacagcctgcaccagccccagggcaacaaggagcacggcaccgagagaaacggcagcctgtacaagaagagcgacggcatcagaaaggtgtggcagaagagaaagtgcagcgtgaagaacggcttcctgaccatcagccacggcaccgccaacagaccccccgccaagctgaacctgctgacctgccaggtgaagaccaaccccgaggagaagaagtgcttcgacctgatcagccacgacagaacctaccacttccaggccgaggacgagcaggagtgccagatctggatgagcgtgctgcagaacagcaaggaggaggccctgaacaacgccttcaagggcgacgacaacaccggcgagaacaacatcgtgcaggagctgaccaaggagatcatcagcgaggtgcagagaatgaccggcaacgacgtgtgctgcgactgcggcgcccccgaccccacctggctgagcaccaacctgggcatcctgacctgcatcgagtgcagcggcatccacagagagctgggcgtgcactacagcagaatgcagagcctgaccctggacgtgctgggcaccagcgagctgctgctggccaagaacatcggcaacgccggcttcaacgagatcatggagtgctgcctgcccgccgaggacagcgtgaagcccaaccccggcagcgacatgaacgccagaaaggactacatcaccgccaagtacatcgagagaagatacgccagaaagaagcacgccgacaacgccgccaagctgcacagcctgtgcgaggccgtgaagaccagagacatcttcggcctgctgcaggcctacgccgacggcgtggacctgaccgagaagatccccctggccaacggccacgagcccgacgagaccgccctgcacctggccgtgagaagcgtggacagaaccagcctgcacatcgtggacttcctggtgcagaacagcggcaacctggacaagcagaccggcaagggcagcaccgccctgcactactgctgcctgaccgacaacgccgagtgcctgaagctgctgctgagaggcaaggccagcatcgagatcgccaacgagagcggcgagacccccctggacatcgccaagagactgaagcacgagcactgcgaggagctgctgacccaggccctgagcggcagattcaacagccacgtgcacgtggagtacgagtggagactgctgcacgaggacctggacgagagcgacgacgacatggacgagaagctgcagcccagccccaacagaagagaggacagacccatcagcttctaccagctgggcagcaaccagctgcagagcaacgccgtgagcctggccagagacgccgccaacctggccaaggagaagcagagagccttcatgcccagcatcctgcagaacgagacctacggcgccctgctgagcggcagccccccccccgcccagcccgccgcccccagcaccaccagcgccccccccctgccccccagaaacgtgggcaaggaccccctgacccccaccccccccccccccgtggccaagacccccagcgtgatggaggccctgagccagcccagcaagcccgccccccccggcatcagccagatcagacccccccccctgcccccccagccccccagcagactgccccagaagaagcccgcccccggcgccgacaagagcacccccctgaccaacaagggccagcccagaggccccgtggacctgagcgccaccgaggccctgggccccctgagcaacgccatggtgctgcagccccccgcccccatgcccagaaagagccaggccaccaagctgaagcccaagagagtgaaggccctgtacaactgcgtggccgacaaccccgacgagctgaccttcagcgagggcgacgtgatcatcgtggacggcgaggaggaccaggagtggtggatcggccacatcgacggcgaccccggcagaaagggcgccttccccgtgagcttcgtgcacttcatcgccgactag

SEQ ID NO: 16431 - DNA, 849 bp, Artificial Sequence
  Description of Artificial Sequence: Synthetic coding sequence
atgaacagcagcaccagcaccatgagcgaggagcccgacgccctgagcgtggtgaaccagctgagagacctggccgccgaccccctgaacagaagagccatcgtgcaggaccagggctgcctgcccggcctgatcctgttcatggaccaccccaacccccccgtggtgcacagcgccctgctggccctgagatacctggccgagtgcagagccaacagagagaagatgaagggcgagctgggcatgatgctgagcctgcagaacgtgatccagaagaccaccacccccggcgagaccaagctgctggccagcgagatctacgacatcctgcagagcagcaacatggccgacggcgacagcttcaacgagatgaacagcagaagaagaaaggcccagttcttcctgggcaccaccaacaagagagccaagaccgtggtgctgcacatcgacggcctggacgacaccagcagaagaaacctgtgcgaggaggccctgctgaagatcaagggcgtgatcagcttcaccttccagatggccgtgcagagatgcgtggtgagaatcagaagcgacctgaaggccgaggccctggccagcgccatcgccagcaccaaggtgatgaaggcccagcaggtggtgaagagcgagagcggcgaggagatgctggtgcccttccaggacacccccgtggaggtggagcagaacaccgagctgcccgactacctgcccgaggacgagagccccaccaaggagcaggacaaggccgtgagcagagtgggcagccaccccgagggcggcgccagctggctgagcaccgccgccaacttcctgagcagaagcttctactggtag

SEQ ID NO: 16432 - DNA, 543 bp, Artificial Sequence
  Description of Artificial Sequence: Synthetic coding sequence
atgagcgcctggccctacttcatctacggccccagccagcccagcagcagacccctgagattcgcctgcagcagcatcctgggcagaatgccctgcaagcagagaaaggacgagagaagaaccggctacgacgtggagctgaccaagtgctacaccgagagcagaagaaacctgtgcgaggaggccctgctgaagatcaagggcgtgatcagcttcaccttccagatggccgtgcagagatgcgtggtgagaatcagaagcgacctgaaggccgaggccctggccagcgccatcgccagcaccaaggtgatgaaggcccagcaggtggtgaagagcgagagcggcgaggagatgctggtgcccttccaggacacccccgtggaggtggagcagaacaccgagctgcccgactacctgcccgaggacgagagccccaccaaggagcaggacaaggccgtgagcagagtgggcagccaccccgagggcggcgccagctggctgagcaccgccgccaacttcctgagcagaagcttctactggtag

SEQ ID NO: 16433 - DNA, 6873 bp, Artificial Sequence
  Description of Artificial Sequence: Synthetic coding sequence
atgggcagaatccaggaggtgggctgggtgaccgccggcctggtgatctgggccggcacctgctactacatctacaagttcaccaagggcagagcccagagcgtgagaaccctggccagaaacggcagcaccgtgaagatggagaccgtggtgggcgtgcagagccagaccctggccatcaacgaggccgagatcaagaccaagccccaggtggagatcggcgccgagaccggcgccagaagcggccccagagccgaggtggagaccaaggccaccgccatcgccatccacagagccaacagccaggccaaggccatggtgggcgccgagcccgagacccagagcgagagcaaggtggtggccggcaccctggtgatgaccgaggccgtgaccctgaccgaggtgaaggccaaggccagagaggtggccatgaaggaggccgtgacccagaccgacgccgaggccggcaagatcgtgaagaaggaggccgtgacccagaccaaggccaaggcctgggccctggtggccaagaccgaggccaagagagaggccatgacccagaccaaggccgagacccacatcctggccgagaaggagaccgagatcaacagagtgatggtgacccagagcgagaccctggccgtgcccagagaggtggccaagatgggcgccaccaacaagaccggcatcgtggacgagaccaagaccagagccctggaggagaccgtgagcgtggccaagacccagagcgaggccagacccggcgccaccgtggacgccagaggcaaccccaacggcatgagcagagaggtggccggcgtggacatgaagagctgcgcccagagccaggccgtgaccaagatccagggcgacgacatgcccggcaccggcgtggaggacatgggcaactgcaagaccatgagcagagccgagagcggcgccgacaccagagccagcgcccagccccagatcttcgccaagacccagaccgaggccatccccggcgccaagatcgacgccggcggcaacaccaacgccatgtgcaaggtgggcgccggcgccgacgtgagagcctgcatccagccccagaccgtggccaagaagcaggccgaggtgaccagcggcgccagagtggacggcagaggcaacaccaacgtgatcagcaaggccatcaccggcgccgacatgagagccgccgcccagccccaggccgtggccagcacccacgccgaggccatgagcgacgccaaggtgaagaacagaggcaaccccaacgccatgaccaaggccggcgccaaggccaacctgagagccaacagccaggtggaggccctgcccgacgccagagacaagagcagaggcaaccccaacgtgatggccaaggtgggcgacggcaccgacatgctgagctgcacccagccccagctggtggccagcgtgcaggccgacaccctgagcgacggcaagatcaaggtgagaggcaacgtgaacaccatgcccaaggagggcgccggcgtggacatgaaggcccagggcatggcccagagccagggcgaggccctgcccaacaccagaggcaaggccagaggcaaggccaaggccaagtgcaagaccggccccggcatggacatgaagacctgcacccagccccaggccggcgtgaagacccccgccgaggccctgctggacagcagagtggacggcagaggcaaccccaacgccaccagcaaggccggcaccaaggccgaccagagagtgtgcggccagcccctggtggtggccaacccccagggcgaggccctgcccggcgccaagaacaaggtgaagggcaacccccacaccgtgctgaaggtgggcgccggcgagggcaccaccgacagcgcccagcccgaggccgtggtgagcttccagggcgaggccctgctgggcaccaagaacaaggtgaagggcaaccccaacgtggtgctgaaggccgaggtgggcgagggcgccatgggcaccgcccagctgcagatcatggccagcagcaagggcgaggccctgctggacagcaagaacaaggtgaagggcaacagcaacgccgtgagcaaggccggcgccggcaccgacaccaccggcagcgtgcagccccagatcgtggccaacagccagggcgaggtgctgcccggcgccaagaacaagatcagaggcaaccccaccaccgtgcccaacagcggcgtgggcccctacaccaccgacagcgccagactgcaggccgtggccaacagccagggcgaggtgctgcccggcgccaagaacaaggtgaaggccaacctgaacgccgtgagcaaggccgaggccggcatgggcgccaccggcagcgtgcagccccaggccgtggccaacagccactgcgagaccctgcccggcgccaagaacaaggtgagaggcaactggaacgccgtgagcaaggccggcgccggcatggacaccagaggcagcgcccagccccaggccgtggccaacagccagggcgaggtgctgcccggcgccaagaacaaggtgaagggcaaccccaacgtggtgagcaaggccggcgccagagaggacaccgtgggcagcacccagccccaggtgctggccagcagccagagagagaccctgcccggcgccagaaacaaggtgaagggcaacagcaacgtggtgagcaaggccggcgccagagaggacaccatgggcagcgcccagccccaggtggtggccaacagccagagagagaccctgcccggcgccagaaacaaggtgaagggcaacagcaacgccatcagcaaggccgaggccggcgccggcatcatgggcagcgtgcaggtgcaggtggtggccagcttccagggcgaggtgctgcccggcgccaagaacaaggtgagaggcaacagcaacgccgtgcccaaggccgaggccggcgccgacaccgtgggcagcgcccagccccaggccgtggccaacagccagagcgagaccctgctgggcgccagaaacaaggtgaagggcaacaccatcgccgtgcccaaggccggcaccggcgccggcaccagacacagcgcccagccccagatcgtggccggcagccagggcgagaccctgcccggcgccagagacaagagcatgagcaccagcgaggccgaggccaccgccgaggacgaggcctacgccaagcccgaggccgaggccatgcccaccagcgagagcgagggcggcagcggcacccaggcctgcagaaagacccagcccaacatccacgactactactggaacggcatcggcgtggaggactggatcgccgccgagagatggatcaagttcagattccagaccatggacggcgactgggagaacagcgtgagctgggccgacgacgagaacgaggccagcatcggcagctggagcggcgccagcgacaaggccggcatcatcagaagctgggccgtggcctgcgacgagaccagcgtgaagagctgggccggcgccagagccgagaacgtggtgggcatcggcacctgggccagagccggcgagcaggccagcggcggcctgtgggccggcggccagaccagcgagggcacctgggccggcgacaaggccagcggcggcgcctggaccggcgccgagaaccaggccagcggcggcagctgggccctggccggcaaccaggccatcggcgagctgtgggccgccggccaggccagcgacggcagctggcccggcggccaggccagcggcgtgagctgggtgggcgaggaggccatcggcggcagctggaccggcgccgagaaccaggccagcgagggcagctgggccggcgccggcgccggcaacatgagcagcgtgagctactgggccggcgtggtggaccaggccggcggcggcagctgggccggcaccagcgaccagagcggcggcggcagcaagcccagattcgaggaccaggccagcggcgagggcagctgggccggcgccggcggccaggccagcggcggcagcatgctgggccccgaggaccagagcagcggcagaagctgggccgacaccgccgaccaggccagcggcggcagcagactgggccacgtggaccagagcagcggcggcgcctgggccggcaccctggaccagagcggcggcggcagcaagcccagattcgagaaccagaccaccgaggagggcagctgggccggcgccggcggccaggccggcggcggcagcaaggtgggccccgaggaccagagcagcggcagaagctgggccaacagcggcgaccagatcagcggcggcttcctggtgggcatcgtggaccaggccaacggcggcagctggaccggcgccggccaccccgccagcgtgggccccaagcccatcttcgaggaccaggtgagcggcagaggcagctgggccgacgccagagagcaggtggtgggcgacagcagactgggcctgagagaccagagcagcggcgacagctgggccgacaccggcgaccaggccagcggctggttctgcgtgtgccccggcagccagaccaacggcggcagctggggcggcgccagcggccaggacgtgggcggcagcagacccggccccaccaaccagagcagcgccggcagctgggacagccccggcagccaggtgagcggcagctgctggaccggcgccggcgccgtggaccaggccggcggctgcagcaagcccggcttcgaggaccaggccatcggcggcggcttctggcccggcgccggcgaccagaccggcggcggcagcagacccggcagcgaggaccagagcagcggcatcggcagctggggcgtggccggcggccaggtgctgggcggcgccagacccggccccgccgaccagagcagcggcggcagctgggccggcaccggcaaccagagcagcggcagaagctggatcggccccggcgaccaggccgtggactgcagcaagcccgagttcgaggaccaggcctgcggcggcggcagctgggccggcgccggcagccaggccagcggcgagagctgggccggcagcagacccggcaacgaggccatcggcggcagcagaatgggcagcgaggaccaggccaccggcggcagctgggccagaagcgaggaccaggccagcggcagattccaggtgagcttcgaggtggaggccaacgagggcttctggttcggccccggcgccgaggccgtgatcggcagctggtgctggaccgaggagaaggccgacatcgtgagcagacccgacgacaaggacgaggccaccaccgccagcagaagcggcgccggcgaggaggccatgatctgcagcagaatcgaggccgagaacaaggccagcagcggcagctggatcagaagcgaggaggtggcctacatgggcagctgcgtgggcgccgaggccggcgccggcgccgaggccggcgccggcgccgaggccggcgccggcgccggcgccgaggccggcgccgaggccggcgccggcgccggcgccggccccggcaccgagagcggcgccggcatctggagctgggacggcgacgccaccaccgtggagagcagactgggcgccggcgaggaggccggcgtggagagctggaccctggccagaaacgtgggcgaggacgagctgagcagagagagcagccccgacatcgaggagatcagcctgagaagcctgttctgggccgagagcgagaacagcaacaccttcagaagcaagagcggcaaggacgccagcttcgagagcggcgccggcgacaacaccagcatcaaggacaagttcgaggccgccggcggcgtggacatcggcagctggttctgcgccggcaacgagaacaccagcgaggacaagagcgcccccaaggccaaggccaagaagagcagcgagagcagaggcatctacccctacatggtgcccggcgccggcatgggcagctgggacggcgccatgatctggagcgagaccaagttcgcccaccagagcgaggccagcttccccgtggaggacgagagcagaaagcagaccagaaccggcgagaagaccagaccctggagctgcagatgcaagcacgaggccaacatggaccccagagacctggagaagctgatctgcatgatcgagatgaccgaggaccccagcgtgcacgagatcgccaacaacgccctgtacaacagcgccgactacagctacagccacgaggtggtgagaaacgtgggcggcatcagcgtgatcgagagcctgctgaacaacccctaccccagcgtgagacagaaggccctgaacgccctgaacaacatcagcgtggccgccgagaaccacagaaaggtgaagacctacctgaaccaggtgtgcgaggacaccgtgacctaccccctgaacagcaacgtgcagctggccggcctgagactgatcagacacctgaccatcaccagcgagtaccagcacatggtgaccaactacatcagcgagttcctgagactgctgaccgtgggcagcggcgagaccaaggaccacgtgctgggcatgctgctgaacttcagcaagaaccccagcatgaccaaggacctgctgatcgccaacgcccccaccagcctgatcaacatcttcagcaagaaggagaccaaggagaacatcctgaacgccctgagcctgttcgagaacatcaactaccacttcaagagaagagccaaggccttcacccaggacaagttcagcaagaacagcctgtacttcctgttccagagacccaaggcctgcgccaagaagctgagagccctggccgccgagtgcaacgaccccgaggtgaaggagagagtggagctgctgatcagcaagctgtag

SEQ ID NO: 16434 - DNA, 1083 bp, Artificial Sequence
  Description of Artificial Sequence: Synthetic coding sequence
atgagcgccgccggcctgaagatcaccggcagcaaggagaccaagagaagactgctgctgatcagcatcgactggagcagagacctgatgaacctgtgcatctacttcagagtgtactgccaggagaagcaggaggagagaagagagctgcccagaatcatcaccggccccccccccgaggccgccgtggtggccttcgagtggctgaagaccagcaccctgaccggcctgcacccccagctgcccctgagcctgccccagcccgagtgcgccctgccctacctggtgagagccttcagcagaggcgactacatgggcagaatccaggaggtgggctgggtgaccgccggcctggtgatctgggccggcacctgctactacatctacaagttcaccaagggcagagcccagagcgtgagaaccctggccagaaacggcagcaccgtgaagatggagaccgtggtgggcgtgcagagccagaccctggccatcaacgaggccgagatcaagaccaagccccaggtggagatcggcgccgagaccggcgccagaagcggccccagagccgaggtggagaccaaggccaccgccatcgccatccacagagccaacagccaggccaaggccatggtgggcgccgagcccgagacccagagcgagagcaaggtggtggccggcaccctggtgatgaccgaggccgtgaccctgaccgaggtgaaggccaaggccagagaggtggccatgaaggaggccgtgacccagaccgacgccgaggccggcaagatcgtgaagaaggaggccgtgacccagaccaaggccaaggcctgggccctggtggccaagaccgaggccaagagagaggccatgacccagaccaaggccgagacccacatcctggccgagaaggagaccgagatcaacagagtgatggtgacccagagcgagaccctggccgtgcccagagaggtggccaagatgggcgccaccaacaagaccggcatcgtggacgagaccaagaccagagccctggaggagaccgtgctgatccccagagccttccccagcaagaacgccagctgctag

SEQ ID NO: 16435 - DNA, 1083 bp, Artificial Sequence; identical to SEQ ID NO: 16434
  Description of Artificial Sequence: Synthetic coding sequence

SEQ ID NO: 16436 - DNA, 903 bp, Artificial Sequence
  Description of Artificial Sequence: Synthetic coding sequence
atgggcagagccagagaggtgggctggatggccgccggcctgatgatcggcgccggcgcctgctactgcgtgtacaagctgaccatcggcagagacgacagcgagaagctggaggaggagggcgaggaggagtgggacgacgaccaggagctggacgaggaggagcccgacatctggttcgacttcgagaccatggccagaccctggaccgaggacggcgactggaccgagcccggcgcccccggcggcaccgaggacagacccagcggcggcggcaaggccaacagagcccaccccatcaagcagagacccttcccctacgagcacaagaacacctggagcgcccagaactgcaagaacggcagctgcgtgctggacctgagcaagtgcctgttcatccagggcaagctgctgttcgccgagcccaaggacgccggcttccccttcagccaggacatcaacagccacctggccagcctgagcatggccagaaacaccagccccacccccgaccccaccgtgagagaggccctgtgcgcccccgacaacctgaacgccagcatcgagagccagggccagatcaagatgtacatcaacgaggtgtgcagagagaccgtgagcagatgctgcaacagcttcctgcagcaggccggcctgaacctgctgatcagcatgaccgtgatcaacaacatgctggccaagagcgccagcgacctgaagttccccctgatcagcgagggcagcggctgcgccaaggtgcaggtgctgaagcccctgatgggcctgagcgagaagcccgtgctggccggcgagctggtgggcgcccagatgctgttcagcttcatgagcctgttcatcagaaacggcaacagagagatcctgctggagacccccgccccctag

SEQ ID NO: 16437 - DNA, 903 bp, Artificial Sequence; identical to SEQ ID NO: 16436
  Description of Artificial Sequence: Synthetic coding sequence

SEQ ID NO: 16438 - DNA, 903 bp, Artificial Sequence; identical to SEQ ID NO: 16436
  Description of Artificial Sequence: Synthetic coding sequence

SEQ ID NO: 16439 - DNA, 1302 bp, Artificial Sequence
  Description of Artificial Sequence: Synthetic coding sequence
atgggcagagtgcagctgttcgagatcagcctgagccacggcagagtggtgtacagccccggcgagcccctggccggcaccgtgagagtgagactgggcgcccccctgcccttcagagccatcagagtgacctgcatcggcagctgcggcgtgagcaacaaggccaacgacaccgcctgggtggtggaggagggctacttcaacagcagcctgagcctggccgacaagggcagcctgcccgccggcgagcacagcttccccttccagttcctgctgcccgccaccgcccccaccagcttcgagggccccttcggcaagatcgtgcaccaggtgagagccgccatccacacccccagattcagcaaggaccacaagtgcagcctggtgttctacatcctgagccccctgaacctgaacagcatccccgacatcgagcagcccaacgtggccagcgccaccaagaagttcagctacaagctggtgaagaccggcagcgtggtgctgaccgccagcaccgacctgagaggctacgtggtgggccaggccctgcagctgcacgccgacgtggagaaccagagcggcaaggacaccagccccgtggtggccagcctgctgcagaaggtgagctacaaggccaagagatggatccacgacgtgagaaccatcgccgaggtggagggcgccggcgtgaaggcctggagaagagcccagtggcacgagcagatcctggtgcccgccctgccccagagcgccctgcccggctgcagcctgatccacatcgactactacctgcaggtgagcctgaaggcccccgaggccaccgtgaccctgcccgtgttcatcggcaacatcgccgtgaaccacgcccccgtgagccccagacccggcctgggcctgccccccggcgccccccccctggtggtgcccagcgcccccccccaggaggaggccgaggccgaggccgccgccggcggcccccacttcctggaccccgtgttcctgagcaccaagagccacagccagagacagcccctgctggccaccctgagcagcgtgcccggcgcccccgagccctgcccccaggacggcagccccgccagccaccccctgcacccccccctgtgcatcagcaccggcgccaccgtgccctacttcgccgagggcagcggcggccccgtgcccaccaccagcaccctgatcctgccccccgagtacagcagctggggctacccctacgaggccccccccagctacgagcagagctgcggcggcgtggagcccagcctgacccccgagagctag

SEQ ID NO: 16440 - DNA, 816 bp, Artificial Sequence
  Description of Artificial Sequence: Synthetic coding sequence
atgggcagagtgcagctgttcgagatcagcctgagccacggcagagtggtgtacagccccggcgagcccctggccggcaccgtgagagtgagactgggcgcccccctgcccttcagagccatcagagtgacctgcatcggcagctgcggcgtgagcaacaaggccaacgacaccgcctgggtggtggaggagggctacttcaacagcagcctgagcctggccgacaagggcagcctgcccgccggcgagcacagcttccccttccagttcctgctgcccgccaccgcccccaccagcttcgagggccccttcggcaagatcgtgcaccaggtgagagccgccatccacacccccagattcagcaaggaccacaagtgcagcctggtgttctacatcctgagccccctgaacctgaacagcatccccgacatcgaggccctgcagctgcacgccgacgtggagaaccagagcggcaaggacaccagccccgtggtggccagcctgctgcagaaggtgagctacaaggccaagagatggatccacgacgtgagaaccatcgccgaggtggagggcgccggcgtgaaggcctggagaagagcccagtggcacgagcagatcctggtgcccgccctgccccagagcgccctgcccggctgcagcctgatccacatcgactactacctgcaggtgagcctgaaggcccccgaggccaccgtgaccctgcccgtgttcatcggcaacatcgccgtgaaccacgcccccgtgagccccagacccggcctgggcctgccccccggcgccccccccctggtgtag

SEQ ID NO: 16441 - DNA, 534 bp, Artificial Sequence
  Description of Artificial Sequence: Synthetic coding sequence
atgggcagagtgcagctgttcgagatcagcctgagccacggcagagtggtgtacagccccggcgagcccctggccggcaccgtgagagtgagactgggcgcccccctgcccttcagagccatcagagtgacctgcatcggcagctgcggcgtgagcaacaaggccaacgacaccgcctgggtggtggaggagggctacttcaacagcagcctgagcctggccgacaagggcagcctgcccgccggcgagcacagcttccccttccagttcctgctgcccgccaccgcccccaccagcttcgagggccccttcggcaagatcgtgcaccaggtgagagccgccatccacacccccagattcagcaaggaccacaagtgcagcctggtgttctacatcctgagccccctgaacctgaacagcatccccgacatcgagggcagcagcctgagaacccccgccaagcccctgcccggccccccccccaagcagcccaacgtggccagcgccaccaagaagttcagctacaagctgtag

SEQ ID NO: 16442 - DNA, 1224 bp, Artificial Sequence
  Description of Artificial Sequence: Synthetic coding sequence
atggccgtgccctggctggtgctgctgctggccctgcccatcttcttcctgggcgtgttcgtgtgggccgtgttcgagcacttcctgaccaccgacatccccgccaccctgcagcaccccgccaagctgagattcctgcactgcatcttcctgtacctggtgaccctgggcaacatcttcgagaagctgggcatctgcagcatgcccaagttcatcagattcctgcacgacagcgtgagaatcaagaaggaccccgagctggtggtgaccgacctgagattcggcaccatccccgtgagactgttccagcccaaggccgccagcagcagacccagaagaggcatcatcttctaccacggcggcgccaccgtgttcggcagcctggactgctaccacggcctgtgcaactacctggccagagagaccgagagcgtgctgctgatgatcggctacagaaagctgcccgaccaccacagccccgccctgttccaggactgcatgaacgccagcatccacttcctgaaggccctggagacctacggcgtggaccccagcagagtggtggtgtgcggcgagagcgtgggcggcgccgccgtggccgccatcacccaggccctggtgggcagaagcgacctgcccagaatcagagcccaggtgctgatctaccccgtggtgcaggccttctgcctgcagctgcccagcttccagcagaaccagaacgtgcccctgctgagcagaaagttcatggtgaccagcctgtgcaactacctggccatcgacctgagctggagagacgccatcctgaacggcacctgcgtgccccccgacgtgtggagaaagtacgagaagtggctgagccccgacaacatccccaagaagttcaagaacagaggctaccagccctggagccccggccccttcaacgaggccgcctacctggaggccaagcacatgctggacgtggagaacagccccctgatcgccgacgacgaggtgatcgcccagctgcccgaggccttcctggtgagctgcgagaacgacatcctgagagacgacagcctgctgtacaagaagagactggaggaccagggcgtgagagtgacctggtaccacctgtacgacggcttccacggcagcatcatcttcttcgacaagaaggccctgagcttcccctgcagcctgaagatcgtgaacgccgtggtgagctacatcaagggcatctag

SEQ ID NO: 16443 - DNA, 8910 bp, Artificial Sequence
  Description of Artificial Sequence: Synthetic coding sequence
atggaccccagaaacaccgccatgctgggcctgggcagcgacagcgagggcttcagcagaaagagccccagcgccatcagcaccggcaccctggtgagcaagagagaggtggagctggagaagaacaccaaggaggaggaggacctgagaaagagaaacagagagagaaacatcgaggccggcaaggacgacggcctgaccgacgcccagcagcagttcagcgtgaaggagaccaacttcagcgagggcaacctgaagctgaagatcggcctgcaggccaagagaaccaagaagccccccaagaacctggagaactacgtgtgcagacccgccatcaagaccaccatcaagcaccccagaaaggccctgaagagcggcaagatgaccgacgagaagaacgagcactgccccagcaagagagaccccagcaagctgtacaagaaggccgacgacgtggccgccatcgagtgccagagcgaggaggtgatcagactgcacagccagggcgagaacaaccccctgagcaagaagctgagccccgtgcacagcgagatggccgactacatcaacgccacccccagcaccctgctgggcagcagagaccccgacctgaaggacagagccctgctgaacggcggcaccagcgtgaccgagaagctggcccagctgatcgccacctgcccccccagcaagagcagcaagaccaagcccaagaagctgggcaccggcaccaccgccggcctggtgagcaaggacctgatcagaaaggccggcgtgggcagcgtggccggcatcatccacaaggacctgatcaagaagcccaccatcagcaccgccgtgggcctggtgaccaaggaccccggcaagaagcccgtgttcaacgccgccgtgggcctggtgaacaaggacagcgtgaagaagctgggcaccggcaccaccgccgtgttcatcaacaagaacctgggcaagaagcccggcaccatcaccaccgtgggcctgctgagcaaggacagcggcaagaagctgggcatcggcatcgtgcccggcctggtgcacaaggagagcggcaagaagctgggcctgggcaccgtggtgggcctggtgaacaaggacctgggcaagaagctgggcagcaccgtgggcctggtggccaaggactgcgccaagaagatcgtggccagcagcgccatgggcctggtgaacaaggacatcggcaagaagctgatgagctgccccctggccggcctgatcagcaaggacgccatcaacctgaaggccgaggccctgctgcccacccaggagcccctgaaggccagctgcagcaccaacatcaacaaccaggagagccaggagctgagcgagagcctgaaggacagcgccaccagcaagaccttcgagaagaacgtggtgagacagaacaaggagagcatcctggagaagttcagcgtgagaaaggagatcatcaacctggagaaggagatgttcaacgagggcacctgcatccagcaggacagcttcagcagcagcgagaagggcagctacgagaccagcaagcacgagaagcagccccccgtgtactgcaccagccccgacttcaagatgggcggcgccagcgacgtgagcaccgccaagagccccttcagcgccgtgggcgagagcaacctgcccagccccagccccaccgtgagcgtgaaccccctgaccagaagcccccccgagaccagcagccagctggcccccaaccccctgctgctgagcagcaccaccgagctgatcgaggagatcagcgagagcgtgggcaagaaccagttcaccagcgagagcacccacctgaacgtgggccacagaagcgtgggccacagcatcagcatcgagtgcaagggcatcgacaaggaggtgaacgacagcaagaccacccacatcgacatccccagaatcagcagcagcctgggcaagaagcccagcctgaccagcgagagcagcatccacaccatcacccccagcgtggtgaacttcaccagcctgttcagcaacaagcccttcctgaagctgggcgccgtgagcgccagcgacaagcactgccaggtggccgagagcctgagcaccagcctgcagagcaagcccctgaagaagagaaagggcagaaagcccagatggaccaaggtggtggccagaagcacctgcagaagccccaagggcctggagctggagagaagcgagctgttcaagaacgtgagctgcagcagcctgagcaacagcaacagcgagcccgccaagttcatgaagaacatcggcccccccagcttcgtggaccacgacttcctgaagagaagactgcccaagctgagcaagagcaccgcccccagcctggccctgctggccgacagcgagaagcccagccacaagagcttcgccacccacaagctgagcagcagcatgtgcgtgagcagcgacctgctgagcgacatctacaagcccaagagaggcagacccaagagcaaggagatgccccagctggagggcccccccaagagaaccctgaagatccccgccagcaaggtgttcagcctgcagagcaaggaggagcaggagccccccatcctgcagcccgagatcgagatccccagcttcaagcagggcctgagcgtgagccccttccccaagaagagaggcagacccaagagacagatgagaagccccgtgaagatgaagccccccgtgctgagcgtggcccccttcgtggccaccgagagccccagcaagctggagagcgagagcgacaaccacagaagcagcagcgacttcttcgagagcgaggaccagctgcaggaccccgacgacctggacgacagccacagacccagcgtgtgcagcatgagcgacctggagatggagcccgacaagaagatcaccaagagaaacaacggccagctgatgaagaccatcatcagaaagatcaacaagatgaagaccctgaagagaaagaagctgctgaaccagatcctgagcagcagcgtggagagcagcaacaagggcaaggtgcagagcaagctgcacaacaccgtgagcagcctggccgccaccttcggcagcaagctgggccagcagatcaacgtgagcaagaagggcaccatctacatcggcaagagaagaggcagaaagcccaagaccgtgctgaacggcatcctgagcggcagccccaccagcctggccgtgctggagcagaccgcccagcaggccgccggcagcgccctgggccagatcctgccccccctgctgcccagcagcgccagcagcagcgagatcctgcccagccccatctgcagccagagcagcggcaccagcggcggccagagccccgtgagcagcgacgccggcttcgtggagcccagcagcgtgccctacctgcacctgcacagcagacagggcagcatgatccagaccctggccatgaagaaggccagcaagggcagaagaagactgagcccccccaccctgctgcccaacagccccagccacctgagcgagctgaccagcctgaaggaggccacccccagccccatcagcgagagccacagcgacgagaccatccccagcgacagcggcatcggcaccgacaacaacagcaccagcgacagagccgagaagttctgcggccagaagaagagaagacacagcttcgagcacgtgagcctgatcccccccgagaccagcaccgtgctgagcagcctgaaggagaagcacaagcacaagtgcaagagaagaaaccacgactacctgagctacgacaagatgaagagacagaagagaaagagaaagaagaagtacccccagctgagaaacagacaggaccccgacttcatcgccgagctggaggagctgatcagcagactgagcgagatcagaatcacccacagaagccaccacttcatccccagagacctgctgcccaccatcttcagaatcaacttcaacagcttctacacccaccccagcttccccctggaccccctgcactacatcagaaagcccgacctgaagaagaagagaggcagaccccccaagatgagagaggccatggccgagatgcccttcatgcacagcctgagcttccccctgagcagcaccggcttctaccccagctacggcatgccctacagccccagccccctgaccgccgcccccatcggcctgggctactacggcagatacccccccaccctgtacccccccccccccagccccagcttcaccacccccctgcccccccccagctacatgcacgccggccacctgctgctgaaccccgccaagtaccacaagaagaagcacaagctgctgagacaggaggccttcctgaccaccagcagaacccccctgctgagcatgagcacctaccccagcgtgccccccgagatggcctacggctggatggtggagcacaagcacagacacagacacaagcacagagagcacagaagcagcgagcagccccaggtgagcatggacaccggcagcagcagaagcgtgctggagagcctgaagagatacagattcggcaaggacgccgtgggcgagagatacaagcacaaggagaagcacagatgccacatgagctgcccccacctgagccccagcaagagcctgatcaacagagaggagcagtgggtgcacagagagcccagcgagagcagccccctggccctgggcctgcagacccccctgcagatcgactgcagcgagagcagccccagcctgagcctgggcggcttcacccccaacagcgagcccgccagcagcgacgagcacaccaacctgttcaccagcgccatcggcagctgcagagtgagcaaccccaacagcagcggcagaaagaagctgaccgacagccccggcctgttcagcgcccaggacaccagcctgaacagactgcacagaaaggagagcctgcccagcaacgagagagccgtgcagaccctggccggcagccagcccaccagcgacaagcccagccagagacccagcgagagcaccaactgcagccccaccagaaagagaagcagcagcgagagcaccagcagcaccgtgaacggcgtgcccagcagaagccccagactggtggccagcggcgacgacagcgtggacagcctgctgcagagaatggtgcagaacgaggaccaggagcccatggagaagagcatcgacgccgtgatcgccaccgccagcgccccccccagcagcagccccggcagaagccacagcaaggacagaaccctgggcaagcccgacagcctgctggtgcccgccgtgaccagcgacagctgcaacaacagcatcagcctgctgagcgagaagctgaccagcagctgcagcccccaccacatcaagagaagcgtggtggaggccatgcagagacaggccagaaagatgtgcaactacgacaagatcctggccaccaagaagaacctggaccacgtgaacaagatcctgaaggccaagaagctgcagagacaggccagaaccggcaacaacttcgtgaagagaagacccggcagacccagaaagtgccccctgcaggccgtggtgagcatgcaggccttccaggccgcccagttcgtgaaccccgagctgaacagagacgaggagggcgccgccctgcacctgagccccgacaccgtgaccgacgtgatcgaggccgtggtgcagagcgtgaacctgaaccccgagcacaagaagggcctgaagagaaagggctggctgctggaggagcagaccagaaagaagcagaagcccctgcccgaggaggaggagcaggagaacaacaagagcttcaacgaggcccccgtggagatccccagccccagcgagacccccgccaagcccagcgagcccgagagcaccctgcagcccgtgctgagcctgatccccagagagaagaagccccccagaccccccaagaagaagtaccagaaggccggcctgtacagcgacgtgtacaagaccaccgaccccaagagcagactgatccagctgaagaaggagaagctggagtacacccccggcgagcacgagtacggcctgttccccgcccccatccacgtggtgttcttcgtgagcggcaagtacctgagacagaagagaatcgacttccagctgccctacgacatcctgtggcagtggaagcacaaccagctgtacaagaagcccgacgtgcccctgtacaagaagatcagaagcaacgtgtacgtggacgtgaagcccctgagcggctacgaggccaccacctgcaactgcaagaagcccgacgacgacaccagaaagggctgcgtggacgactgcctgaacagaatgatcttcgccgagtgcagccccaacacctgcccctgcggcgagcagtgctgcaaccagagaatccagagacacgagtgggtgcagtgcctggagagattcagagccgaggagaagggctggggcatcagaaccaaggagcccctgaaggccggccagttcatcatcgagtacctgggcgaggtggtgagcgagcaggagttcagaaacagaatgatcgagcagtaccacaaccacagcgaccactactgcctgaacctggacagcggcatggtgatcgacagctacagaatgggcaacgaggccagattcatcaaccacagctgcgaccccaactgcgagatgcagaagtggagcgtgaacggcgtgtacagaatcggcctgtacgccctgaaggacatgcccgccggcaccgagctgacctacgactacaacttccacagcttcaacgtggagaagcagcagctgtgcaagtgcggcttcgagaagtgcagaggcatcatcggcggcaagagccagagagtgaacggcctgaccagcagcaagaacagccagcccatggccacccacaagaagagcggcagaagcaaggagaagagaaagagcaagcacaagctgaagaagagaagaggccacctgagcgaggagcccagcgagaacatcaacacccccaccagactgaccccccagctgcagatgaagcccatgagcaacagagagagaaacttcgtgctgaagcaccacgtgttcctggtgagaaactgggagaagatcagacagaagcaggaggaggtgaagcacaccagcgacaacatccacagcgccagcctgtacaccagatggaacggcatctgcagagacgacggcaacatcaagagcgacgtgttcatgacccagttcagcgccctgcagaccgccagaagcgtgagaaccagaagactggccgccgccgaggagaacatcgaggtggccagagccgccagactggcccagatcttcaaggagatctgcgacggcatcatcagctacaaggacagcagcagacaggccctggccgcccccctgctgaacctgccccccaagaagaagaacgccgactactacgagaagatcagcgaccccctggacctgatcaccatcgagaagcagatcctgaccggctactacaagaccgtggaggccttcgacgccgacatgctgaaggtgttcagaaacgccgagaagtactacggcagaaagagccccgtgggcagagacgtgtgcagactgagaaaggcctactacaacgccagacacgaggccagcgcccagatcgacgagatcgtgggcgagaccgccagcgaggccgacagcagcgagaccagcgtgagcgagaaggagaacggccacgagaaggacgacgacgtgatcagatgcatctgcggcctgtacaaggacgagggcctgatgatccagtgcgacaagtgcatggtgtggcagcactgcgactgcatgggcgtgaacagcgacgtggagcactacctgtgcgagcagtgcgaccccagacccgtggacagagaggtgcccatgatccccagaccccactacgcccagcccggctgcgtgtacttcatctgcctgctgagagacgacctgctgctgagacagggcgactgcgtgtacctgatgagagacagcagaagaacccccgacggccaccccgtgagacagagctacagactgctgagccacatcaacagagacaagctggacatcttcagaatcgagaagctgtggaagaacgagaaggaggagagattcgccttcggccaccactacttcagaccccacgagacccaccacagccccagcagaagattctaccacaacgagctgttcagagtgcccctgtacgagatcatccccctggaggccgtggtgggcacctgctgcgtgctggacctgtacacctactgcaagggcagacccaagggcgtgaaggagcaggacgtgtacatctgcgactacagactggacaagagcgcccacctgttctacaagatccacagaaacagataccccgtgtgcaccaagccctacgccttcgaccacttccccaagaagctgacccccaagaaggacttcagcccccactacgtgcccgacaactacaagagaaacggcggcagaagcagctggaagagcgagagaagcaagccccccctgaaggacctgggccaggaggacgacgccctgcccctgatcgaggaggtgctggccagccaggagcaggccgccaacgagatccccagcctggaggagcccgagagagagggcgccaccgccaacgtgagcgagggcgagaagaagaccgaggagagcagccaggagccccagagcacctgcacccccgaggagagaagacacaaccagagagagagactgaaccagatcctgctgaacctgctggagaagatccccggcaagaacgccatcgacgtgacctacctgctggaggagggcagcggcagaaagctgagaagaagaaccctgttcatccccgagaacagcttcagaaagtag

SEQ ID NO: 16444 - DNA, 8895 bp, Artificial Sequence
  Description of Artificial Sequence: Synthetic coding sequence
atggaccccagaaacaccgccatgctgggcctgggcagcgacagcgagggcttcagcagaaagagccccagcgccatcagcaccggcaccctggtgagcaagagagaggtggagctggagaagaacaccaaggaggaggaggacctgagaaagagaaacagagagagaaacatcgaggccggcaaggacgacggcctgaccgacgcccagcagcagttcagcgtgaaggagaccaacttcagcgagggcaacctgaagctgaagatcggcctgcaggccaagagaaccaagaagccccccaagaacctggagaactacgtgtgcagacccgccatcaagaccaccatcaagcaccccagaaaggccctgaagagcggcaagatgaccgacgagaagaacgagcactgccccagcaagagagaccccagcaagctgtacaagaaggccgacgacgtggccgccatcgagtgccagagcgaggaggtgatcagactgcacagccagggcgagaacaaccccctgagcaagaagctgagccccgtgcacagcgagatggccgactacatcaacgccacccccagcaccctgctgggcagcagagaccccgacctgaaggacagagccctgctgaacggcggcaccagcgtgaccgagaagctggcccagctgatcgccacctgcccccccagcaagagcagcaagaccaagcccaagaagctgggcaccggcaccaccgccggcctggtgagcaaggacctgatcagaaaggccggcgtgggcagcgtggccggcatcatccacaaggacctgatcaagaagcccaccatcagcaccgccgtgggcctggtgaccaaggaccccggcaagaagcccgtgttcaacgccgccgtgggcctggtgaacaaggacagcgtgaagaagctgggcaccggcaccaccgccgtgttcatcaacaagaacctgggcaagaagcccggcaccatcaccaccgtgggcctgctgagcaaggacagcggcaagaagctgggcatcggcatcgtgcccggcctggtgcacaaggagagcggcaagaagctgggcctgggcaccgtggtgggcctggtgaacaaggacctgggcaagaagctgggcagcaccgtgggcctggtggccaaggactgcgccaagaagatcgtggccagcagcgccatgggcctggtgaacaaggacatcggcaagaagctgatgagctgccccctggccggcctgatcagcaaggacgccatcaacctgaaggccgaggccctgctgcccacccaggagcccctgaaggccagctgcagcaccaacatcaacaaccaggagagccaggagctgagcgagagcctgaaggacagcgccaccagcaagaccttcgagaagaacgtggtgagacagaacaaggagagcatcctggagaagttcagcgtgagaaaggagatcatcaacctggagaaggagatgttcaacgagggcacctgcatccagcaggacagcttcagcagcagcgagaagggcagctacgagaccagcaagcacgagaagcagccccccgtgtactgcaccagccccgacttcaagatgggcggcgccagcgacgtgagcaccgccaagagccccttcagcgccgtgggcgagagcaacctgcccagccccagccccaccgtgagcgtgaaccccctgaccagaagcccccccgagaccagcagccagctggcccccaaccccctgctgctgagcagcaccaccgagctgatcgaggagatcagcgagagcgtgggcaagaaccagttcaccagcgagagcacccacctgaacgtgggccacagaagcgtgggccacagcatcagcatcgagtgcaagggcatcgacaaggaggtgaacgacagcaagaccacccacatcgacatccccagaatcagcagcagcctgggcaagaagcccagcctgaccagcgagagcagcatccacaccatcacccccagcgtggtgaacttcaccagcctgttcagcaacaagcccttcctgaagctgggcgccgtgagcgccagcgacaagcactgccaggtggccgagagcctgagcaccagcctgcagagcaagcccctgaagaagagaaagggcagaaagcccagatggaccaaggtggtggccagaagcacctgcagaagccccaagggcctggagctggagagaagcgagctgttcaagaacgtgagctgcagcagcctgagcaacagcaacagcgagcccgccaagttcatgaagaacatcggcccccccagcttcgtggaccacgacttcctgaagagaagactgcccaagctgagcaagagcaccgcccccagcctggccctgctggccgacagcgagaagcccagccacaagagcttcgccacccacaagctgagcagcagcatgtgcgtgagcagcgacctgctgagcgacatctacaagcccaagagaggcagacccaagagcaaggagatgccccagctggagggcccccccaagagaaccctgaagatccccgccagcaaggtgttcagcctgcagagcaaggaggagcaggagccccccatcctgcagcccgagatcgagatccccagcttcaagcagggcctgagcgtgagccccttccccaagaagagaggcagacccaagagacagatgagaagccccgtgaagatgaagccccccgtgctgagcgtggcccccttcgtggccaccgagagccccagcaagctggagagcgagagcgacaaccacagaagcagcagcgacttcttcgagagcgaggaccagctgcaggaccccgacgacctggacgacagccacagacccagcgtgtgcagcatgagcgacctggagatggagcccgacaagaagatcaccaagagaaacaacggccagctgatgaagaccatcatcagaaagatcaacaagatgaagaccctgaagagaaagaagctgctgaaccagatcctgagcagcagcgtggagagcagcaacaagggcaaggtgcagagcaagctgcacaacaccgtgagcagcctggccgccaccttcggcagcaagctgggccagcagatcaacgtgagcaagaagggcaccatctacatcggcaagagaagaggcagaaagcccaagaccgtgctgaacggcatcctgagcggcagccccaccagcctggccgtgctggagcagaccgcccagcaggccgccggcagcgccctgggccagatcctgccccccctgctgcccagcagcgccagcagcagcgagatcctgcccagccccatctgcagccagagcagcggcaccagcggcggccagagccccgtgagcagcgacgccggcttcgtggagcccagcagcgtgccctacctgcacctgcacagcagacagggcagcatgatccagaccctggccatgaagaaggccagcaagggcagaagaagactgagcccccccaccctgctgcccaacagccccagccacctgagcgagctgaccagcctgaaggaggccacccccagccccatcagcgagagccacagcgacgagaccatccccagcgacagcggcatcggcaccgacaacaacagcaccagcgacagagccgagaagttctgcggccagaagaagagaagacacagcttcgagcacgtgagcctgatcccccccgagaccagcaccgtgctgagcagcctgaaggagaagcacaagcacaagtgcaagagaagaaaccacgactacctgagctacgacaagatgaagagacagaagagaaagagaaagaagaagtacccccagctgagaaacagacaggaccccgacttcatcgccgagctggaggagctgatcagcagactgagcgagatcagaatcacccacagaagccaccacttcatccccagagacctgctgcccaccatcttcagaatcaacttcaacagcttctacacccaccccagcttccccctggaccccctgcactacatcagaaagcccgacctgaagaagaagagaggcagaccccccaagatgagagaggccatggccgagatgcccttcatgcacagcctgagcttccccctgagcagcaccggcttctaccccagctacggcatgccctacagccccagccccctgaccgccgcccccatcggcctgggctactacggcagatacccccccaccctgtacccccccccccccagccccagcttcaccacccccctgcccccccccagctacatgcacgccggccacctgctgctgaaccccgccaagtaccacaagaagaagcacaagctgctgagacaggaggccttcctgaccaccagcagaacccccctgctgagcatgagcacctaccccagcgtgccccccgagatggcctacggctggatggtggagcacaagcacagacacagacacaagcacagagagcacagaagcagcgagcagccccaggtgagcatggacaccggcagcagcagaagcgtgctggagagcctgaagagatacagattcggcaaggacgccgtgggcgagagatacaagcacaaggagaagcacagatgccacatgagctgcccccacctgagccccagcaagagcctgatcaacagagaggagcagtgggtgcacagagagcccagcgagagcagccccctggccctgggcctgcagacccccctgcagatcgactgcagcgagagcagccccagcctgagcctgggcggcttcacccccaacagcgagcccgccagcagcgacgagcacaccaacctgttcaccagcgccatcggcagctgcagagtgagcaaccccaacagcagcggcagaaagaagctgaccgacagccccggcctgttcagcgcccaggacaccagcctgaacagactgcacagaaaggagagcctgcccagcaacgagagagccgtgcagaccctggccggcagccagcccaccagcgacaagcccagccagagacccagcgagagcaccaactgcagccccaccagaaagagaagcagcagcgagagcaccagcagcaccgtgaacggcgtgcccagcagaagccccagactggtggccagcggcgacgacagcgtggacagcctgctgcagagaatggtgcagaacgaggaccaggagcccatggagaagagcatcgacgccgtgatcgccaccgccagcgccccccccagcagcagccccggcagaagccacagcaaggacagaaccctgggcaagcccgacagcctgctggtgcccgccgtgaccagcgacagctgcaacaacagcatcagcctgctgagcgagaagctgaccagcagctgcagcccccaccacatcaagagaagcgtggtggaggccatgcagagacaggccagaaagatgtgcaactacgacaagatcctggccaccaagaagaacctggaccacgtgaacaagatcctgaaggccaagaagctgcagagacaggccagaaccggcaacaacttcgtgaagagaagacccggcagacccagaaagtgccccctgcaggccgtggtgagcatgcaggccttccaggccgcccagttcgtgaaccccgagctgaacagagacgaggagggcgccgccctgcacctgagccccgacaccgtgaccgacgtgatcgaggccgtggtgcagagcgtgaacctgaaccccgagcacaagaagggcctgaagagaaagggctggctgctggaggagcagaccagaaagaagcagaagcccctgcccgaggaggaggagcaggagaacaacaagagcttcaacgaggcccccgtggagatccccagccccagcgagacccccgccaagcccagcgagcccgagagcaccctgcagcccgtgctgagcctgatccccagagagaagaagccccccagaccccccaagaagaagtaccagaaggccggcctgtacagcgacgtgtacaagaccaccgaccccaagagcagactgatccagctgaagaaggagaagctggagtacacccccggcgagcacgagtacggcctgttccccgcccccatccacgtgggcaagtacctgagacagaagagaatcgacttccagctgccctacgacatcctgtggcagtggaagcacaaccagctgtacaagaagcccgacgtgcccctgtacaagaagatcagaagcaacgtgtacgtggacgtgaagcccctgagcggctacgaggccaccacctgcaactgcaagaagcccgacgacgacaccagaaagggctgcgtggacgactgcctgaacagaatgatcttcgccgagtgcagccccaacacctgcccctgcggcgagcagtgctgcaaccagagaatccagagacacgagtgggtgcagtgcctggagagattcagagccgaggagaagggctggggcatcagaaccaaggagcccctgaaggccggccagttcatcatcgagtacctgggcgaggtggtgagcgagcaggagttcagaaacagaatgatcgagcagtaccacaaccacagcgaccactactgcctgaacctggacagcggcatggtgatcgacagctacagaatgggcaacgaggccagattcatcaaccacagctgcgaccccaactgcgagatgcagaagtggagcgtgaacggcgtgtacagaatcggcctgtacgccctgaaggacatgcccgccggcaccgagctgacctacgactacaacttccacagcttcaacgtggagaagcagcagctgtgcaagtgcggcttcgagaagtgcagaggcatcatcggcggcaagagccagagagtgaacggcctgaccagcagcaagaacagccagcccatggccacccacaagaagagcggcagaagcaaggagaagagaaagagcaagcacaagctgaagaagagaagaggccacctgagcgaggagcccagcgagaacatcaacacccccaccagactgaccccccagctgcagatgaagcccatgagcaacagagagagaaacttcgtgctgaagcaccacgtgttcctggtgagaaactgggagaagatcagacagaagcaggaggaggtgaagcacaccagcgacaacatccacagcgccagcctgtacaccagatggaacggcatctgcagagacgacggcaacatcaagagcgacgtgttcatgacccagttcagcgccctgcagaccgccagaagcgtgagaaccagaagactggccgccgccgaggagaacatcgaggtggccagagccgccagactggcccagatcttcaaggagatctgcgacggcatcatcagctacaaggacagcagcagacaggccctggccgcccccctgctgaacctgccccccaagaagaagaacgccgactactacgagaagatcagcgaccccctggacctgatcaccatcgagaagcagatcctgaccggctactacaagaccgtggaggccttcgacgccgacatgctgaaggtgttcagaaacgccgagaagtactacggcagaaagagccccgtgggcagagacgtgtgcagactgagaaaggcctactacaacgccagacacgaggccagcgcccagatcgacgagatcgtgggcgagaccgccagcgaggccgacagcagcgagaccagcgtgagcgagaaggagaacggccacgagaaggacgacgacgtgatcagatgcatctgcggcctgtacaaggacgagggcctgatgatccagtgcgacaagtgcatggtgtggcagcactgcgactgcatgggcgtgaacagcgacgtggagcactacctgtgcgagcagtgcgaccccagacccgtggacagagaggtgcccatgatccccagaccccactacgcccagcccggctgcgtgtacttcatctgcctgctgagagacgacctgctgctgagacagggcgactgcgtgtacctgatgagagacagcagaagaacccccgacggccaccccgtgagacagagctacagactgctgagccacatcaacagagacaagctggacatcttcagaatcgagaagctgtggaagaacgagaaggaggagagattcgccttcggccaccactacttcagaccccacgagacccaccacagccccagcagaagattctaccacaacgagctgttcagagtgcccctgtacgagatcatccccctggaggccgtggtgggcacctgctgcgtgctggacctgtacacctactgcaagggcagacccaagggcgtgaaggagcaggacgtgtacatctgcgactacagactggacaagagcgcccacctgttctacaagatccacagaaacagataccccgtgtgcaccaagccctacgccttcgaccacttccccaagaagctgacccccaagaaggacttcagcccccactacgtgcccgacaactacaagagaaacggcggcagaagcagctggaagagcgagagaagcaagccccccctgaaggacctgggccaggaggacgacgccctgcccctgatcgaggaggtgctggccagccaggagcaggccgccaacgagatccccagcctggaggagcccgagagagagggcgccaccgccaacgtgagcgagggcgagaagaagaccgaggagagcagccaggagccccagagcacctgcacccccgaggagagaagacacaaccagagagagagactgaaccagatcctgctgaacctgctggagaagatccccggcaagaacgccatcgacgtgacctacctgctggaggagggcagcggcagaaagctgagaagaagaaccctgttcatccccgagaacagcttcagaaagtag

SEQ ID NO: 16445 - DNA, 864 bp, Artificial Sequence
  Description of Artificial Sequence: Synthetic coding sequence
atggccaaggacttccaggacatccagcagctgagcagcgaggagaacgaccaccccttccaccagggccccccccccgcccagcccctggcccagagactgtgcagcatggtgtgcttcagcctgctggccctgagcttcaacatcctgctgctggtggtgatctgcgtgaccggcagccagagcgcccagctgcaggccgagctgagaagcctgaaggaggccttcagcaacttcagcagcagcaccctgaccgaggtgcaggccatcagcacccacggcggcagcgtgggcgacaagatcaccagcctgggcgccaagctggagaagcagcagcaggacctgaaggccgaccacgacgccctgctgttccacctgaagcacttccccgtggacctgagattcgtggcctgccagatggagctgctgcacagcaacggcagccagagaacctgctgccccgtgaactgggtggagcaccagggcagctgctactggttcagccacagcggcaaggcctgggccgaggccgagaagtactgccagctggagaacgcccacctggtggtgatcaacagctgggaggagcagaagttcatcgtgcagcacaccaaccccttcaacacctggatcggcctgaccgacagcgacggcagctggaagtgggtggacggcaccgactacagacacaactacaagaactgggccgtgacccagcccgacaactggcacggccacgagctgggcggcagcgaggactgcgtggaggtgcagcccgacggcagatggaacgacgacttctgcctgcaggtgtacagatgggtgtgcgagaagagaagaaacgccaccggcgaggtggcctag

SEQ ID NO: 16446 - DNA, 936 bp, Artificial Sequence
  Description of Artificial Sequence: Synthetic coding sequence
atggccaaggacttccaggacatccagcagctgagcagcgaggagaacgaccaccccttccaccagggcgagggccccggcaccagaagactgaaccccagaagaggcaaccccttcctgaagggccccccccccgcccagcccctggcccagagactgtgcagcatggtgtgcttcagcctgctggccctgagcttcaacatcctgctgctggtggtgatctgcgtgaccggcagccagagcgagggccacggcggcgcccagctgcaggccgagctgagaagcctgaaggaggccttcagcaacttcagcagcagcaccctgaccgaggtgcaggccatcagcacccacggcggcagcgtgggcgacaagatcaccagcctgggcgccaagctggagaagcagcagcaggacctgaaggccgaccacgacgccctgctgttccacctgaagcacttccccgtggacctgagattcgtggcctgccagatggagctgctgcacagcaacggcagccagagaacctgctgccccgtgaactgggtggagcaccagggcagctgctactggttcagccacagcggcaaggcctgggccgaggccgagaagtactgccagctggagaacgcccacctggtggtgatcaacagctgggaggagcagaagttcatcgtgcagcacaccaaccccttcaacacctggatcggcctgaccgacagcgacggcagctggaagtgggtggacggcaccgactacagacacaactacaagaactgggccgtgacccagcccgacaactggcacggccacgagctgggcggcagcgaggactgcgtggaggtgcagcccgacggcagatggaacgacgacttctgcctgcaggtgtacagatgggtgtgcgagaagagaagaaacgccaccggcgaggtggcctag

SEQ ID NO: 16447 - DNA, 936 bp, Artificial Sequence; identical to SEQ ID NO: 16446
  Description of Artificial Sequence: Synthetic coding sequence

SEQ ID NO: 16448 - DNA, 879 bp, Artificial Sequence
  Description of Artificial Sequence: Synthetic coding sequence
atggccaaggacttccaggacatccagcagctgagcagcgaggagaacgaccaccccttccaccagggccccccccccgcccagcccctggcccagagactgtgcagcatggtgtgcttcagcctgctggccctgagcttcaacatcctgctgctggtggtgatctgcgtgaccggcagccagagcgagggccacggcggcgcccagctgcaggccgagctgagaagcctgaaggaggccttcagcaacttcagcagcagcaccctgaccgaggtgcaggccatcagcacccacggcggcagcgtgggcgacaagatcaccagcctgggcgccaagctggagaagcagcagcaggacctgaaggccgaccacgacgccctgctgttccacctgaagcacttccccgtggacctgagattcgtggcctgccagatggagctgctgcacagcaacggcagccagagaacctgctgccccgtgaactgggtggagcaccagggcagctgctactggttcagccacagcggcaaggcctgggccgaggccgagaagtactgccagctggagaacgcccacctggtggtgatcaacagctgggaggagcagaagttcatcgtgcagcacaccaaccccttcaacacctggatcggcctgaccgacagcgacggcagctggaagtgggtggacggcaccgactacagacacaactacaagaactgggccgtgacccagcccgacaactggcacggccacgagctgggcggcagcgaggactgcgtggaggtgcagcccgacggcagatggaacgacgacttctgcctgcaggtgtacagatgggtgtgcgagaagagaagaaacgccaccggcgaggtggcctag

SEQ ID NO: 16449 - DNA, 414 bp, Artificial Sequence
  Description of Artificial Sequence: Synthetic coding sequence
atggccaaggacttccaggacatccagcagctgagcagcgaggagaacgaccaccccttccaccagggccccccccccgcccagcccctggcccagagactgtgcagcatggtgtgcttcagcctgctggccctgagcttcaacatcctgctgctggtggtgatctgcgtgaccggcagccagagcgcccagctgcaggccgagctgagaagcctgaaggaggccttcagcaacttcagcagcagcaccctgaccgaggtgcaggccatcagcacccacggcggcagcgtgggcgacaagatcaccagcctgggcgccaagctggagaagcagcagcaggacctgaaggccggccagagagccagcggcgtgtgcgcccacgtgagagcctgcgtgagagtgagatgcgtgtag

SEQ ID NO: 16450 - DNA, 1422 bp, Artificial Sequence
  Description of Artificial Sequence: Synthetic coding sequence
atggcccagctggagggctactgcttcagcgccgccctgagctgcaccttcctggtgagctgcctgctgttcagcgccttcagcagagccctgagagagccctacatggacgagatcttccacctgccccaggcccagagatactgcgagggccacttcagcctgagccagtgggaccccatgatcaccaccctgcccggcctgtacctggtgagcgtgggcgtggtgaagcccgccatctggatcttcgcctggagcgagcacgtggtgtgcagcatcggcatgctgagattcgtgaacctgctgttcagcgtgggcaacttctacctgctgtacctgctgttccacaaggtgcagcccagaaacaaggccgccagcagcatccagagagtgctgagcaccctgaccctggccgtgttccccaccctgtacttcttcaacttcctgtactacaccgaggccggcagcatgttcttcaccctgttcgcctacctgatgtgcctgtacggcaaccacaagaccagcgccttcctgggcttctgcggcttcatgttcagacagaccaacatcatctgggccgtgttctgcgccggcaacgtgatcgcccagaagctgaccgaggcctggaagaccgagctgcagaagaaggaggacagactgccccccatcaagggccccttcgccgagttcagaaagatcctgcagttcctgctggcctacagcatgagcttcaagaacctgagcatgctgttctgcctgacctggccctacatcctgctgggcttcctgttctgcgccttcgtggtggtgaacggcggcatcgtgatcggcgacagaagcagccacgaggcctgcctgcacttcccccagctgttctacttcttcagcttcaccctgttcttcagcttcccccacctgctgagccccagcaagatcaagaccttcctgagcctggtgtggaagcacggcatcctgttcctggtggtgaccctggtgagcgtgttcctggtgtggaagttcacctacgcccacaagtacctgctggccgacaacagacactacaccttctacgtgtggaagagagtgttccagagatacgccatcctgaagtacctgctggtgcccgcctacatcttcgccggctggagcatcgccgacagcctgaagagcaagcccatcttctggaacctgatgttcttcatctgcctgttcatcgtgatcgtgccccagaagctgctggagttcagatacttcatcctgccctacgtgatctacagactgaacatcaccctgccccccaccagcagactggtgtgcgagctgagctgctacgccatcgtgaacttcatcaccttctacatcttcctgaacaagaccttccagtggcccaacagccaggacatccagagattcatgtggtag

SEQ ID NO: 16451 - DNA, 1173 bp, Artificial Sequence
  Description of Artificial Sequence: Synthetic coding sequence
atgttccccgcccaggccaaggagaacgccggcttcagcggctgcggcggcgacaccgagatcgactggaaggcctacatggccgaggtggagggcgtgatcaacggcacctacgactacacccagctgcagggcgacaccggccccctggtgtaccccgccggcttcgtgtacatcttcatgggcctgtactacgccaccagcagaggcaccgacatcagaatggcccagaacatcttcgccgtgctgtacctggccaccctgctgctggtgttcctgatctaccaccagacctgcaaggtgccccccttcgtgttcttcttcatgtgctgcgccagctacagagtgcacagcatcttcgtgctgagactgttcaacgaccccgtggccatggtgctgctgttcctgagcatcaacctgctgctggcccagagatggggctggggctgctgcttcttcagcctggccgtgagcgtgaagatgaacgtgctgctgttcgcccccggcctgctgttcctgctgctgacccagttcggcttcagaggcgccctgcccaagctgggcatctgcgccggcctgcaggtggtgctgggcctgcccttcctgctggagaaccccagcggctacctgagcagaagcttcgacctgggcagacagttcctgttccactggaccgtgaactggagattcctgcccgaggccctgttcctgcacagagccttccacctggccctgctgaccgcccacctgaccctgctgctgctgttcgccctgtgcagatggcacagaaccggcgagagcatcctgagcctgctgagagaccccagcaagagaaaggtgcccccccagcccctgacccccaaccagatcgtgagcaccctgttcaccagcaacttcatcggcatctgcttcagcagaagcctgcactaccagttctacgtgtggtacttccacaccctgccctacctgctgtgggccatgcccgccagatggctgacccacctgctgagactgctggtgctgggcctgatcgagctgagctggaacacctaccccagcaccagctgcagcagcgccgccctgcacatctgccacgccgtgatcctgctgcagctgtggctgggcccccagcccttccccaagagcacccagcacagcaagaaggcccactag

SEQ ID NO: 16452 - DNA, 975 bp, Artificial Sequence
  Description of Artificial Sequence: Synthetic coding sequence
atggcccccctgctgctgcagctggccgtgctgggcgccgccctggccgccgccgccctggtgctgatcagcatcgtggccttcaccaccgccaccaagatgcccgccctgcacagacacgaggaggagaagttcttcctgaacgccaagggccagaaggagaccctgcccagcatctgggacagccccaccaagcagctgagcgtggtggtgcccagctacaacgaggagaagagactgcccgtgatgatggacgaggccctgagctacctggagaagagacagaagagagaccccgccttcacctacgaggtgatcgtggtggacgacggcagcaaggaccagaccagcaaggtggccttcaagtactgccagaagtacggcagcgacaaggtgagagtgatcaccctggtgaagaacagaggcaagggcggcgccatcagaatgggcatcttcagcagcagaggcgagaagatcctgatggccgacgccgacggcgccaccaagttccccgacgtggagaagctggagaagggcctgaacgacctgcagccctggcccaaccagatggccatcgcctgcggcagcagagcccacctggagaaggagagcatcgcccagagaagctacttcagaaccctgctgatgtacggcttccacttcctggtgtggttcctgtgcgtgaagggcatcagagacacccagtgcggcttcaagctgttcaccagagaggccgccagcagaaccttcagcagcctgcacgtggagagatgggccttcgacgtggagctgctgtacatcgcccagttcttcaagatccccatcgccgagatcgccgtgaactggaccgagatcgagggcagcaagctggtgcccttctggagctggctgcagatgggcaaggacctgctgttcatcagactgagatacctgaccggcgcctggagactggagcagaccagaaagatgaactag

SEQ ID NO: 16453 - DNA, 693 bp, Artificial Sequence
  Description of Artificial Sequence: Synthetic coding sequence
atggcccccctgctgctgcagctggccgtgctgggcgccgccctggccgccgccgccctggtgctgatcagcatcgtggccttcaccaccgccaccaagatgcccgccctgcacagacacgaggaggagaagttcttcctgaacgccaagggccagaaggagaccctgcccagcatctgggacagccccaccaagcagctgagcgtggtggtgcccagctacaacgaggagaagagactgcccgtgatgatggacgaggccctgagctacctggagaagagacagaagagagaccccgccttcacctacgaggtgatcgtggtggacgacggcagcaaggaccagaccagcaaggtggccttcaagtactgccagaagtacggcagcgacaaggtgagagtgatcaccctggtgaagaacagaggcaagggcggcgccatcagaatgggcatcttcagcagcagaggcgagaagatcctgatggccgacgccgacggcgccaccaagttccccgacgtggagaagctggagaagggcctgaacgacctgcagccctggcccaaccagatggccatcgcctgcggcagcagagcccacctggagaaggagagcatcgcccagcacaagtgcagcttcggcggcctgatcagccagcccgtgttcatcggcagcatcctgtacggcagacactag

SEQ ID NO: 16454 - DNA, 885 bp, Artificial Sequence
  Description of Artificial Sequence: Synthetic coding sequence
atggcccccctgctgctgcagctggccgtgctgggcgccgccctggccgccgccgccctggtgctgatcagcatcgtggccttcaccaccgccaccaagatgcccgccctgcacagacacgaggaggagaagttcttcctgaacgccaagggccagaaggagaccctgcccagcatctgggacagccccaccaagcagctgagcgtggtggtgcccagctacaacgaggagaagagactgcccgtgatgatggacgaggccctgagctacctggagaagagacagaagtacggcagcgacaaggtgagagtgatcaccctggtgaagaacagaggcaagggcggcgccatcagaatgggcatcttcagcagcagaggcgagaagatcctgatggccgacgccgacggcgccaccaagttccccgacgtggagaagctggagaagggcctgaacgacctgcagccctggcccaaccagatggccatcgcctgcggcagcagagcccacctggagaaggagagcatcgcccagagaagctacttcagaaccctgctgatgtacggcttccacttcctggtgtggttcctgtgcgtgaagggcatcagagacacccagtgcggcttcaagctgttcaccagagaggccgccagcagaaccttcagcagcctgcacgtggagagatgggccttcgacgtggagctgctgtacatcgcccagttcttcaagatccccatcgccgagatcgccgtgaactggaccgagatcgagggcagcaagctggtgcccttctggagctggctgcagatgggcaaggacctgctgttcatcagactgagatacctgaccggcgcctggagactggagcagaccagaaagatgaactag

SEQ ID NO: 16455 - DNA, 1173 bp, Artificial Sequence
  Description of Artificial Sequence: Synthetic coding sequence
atgaaggagggcagaggcagcttcagcgtggagagaggccccagaaaggagagagagaccgcccagagcggcatgtggaagggcaacagccccgccggcagccagggcgccgccatggagggcaccggcggcgagctgggcggccagggcaactggggccccgaggacgcccccggcctgctggccagagccagcctgatcatgctgccctggcccctgcccctggccagcagcgccctgaccctgctgttcggcgccctgaccagcctgttcctgtggtactgctacagactgggcagccaggacatgcaggccctgggcgccggcagcagagccggcggcgtgagaggcggccccgtgggctgcagcgaggccggcggccccagccccggcggccccggcgaccccggcgagggccccagaaccgagggcctggtgagcagaagactgagagcctacgccagaagatacagctgggccggcatgggcagagtgagaagagccgcccagggcggccccggccccggcagaggccccggcgtgctgggcatccagagacccggcctgctgttcctgcccgacctgcccagcgcccccttcgtgcccagagacgcccagagacacgacgtggagctgctggagagcagcttccccgccatcctgagagacttcggcgccgtgagctgggacttcagcggcaccacccccccccccagaggctggagcccccccctggcccccggctgctaccagctgctgctgtaccaggccggcagatgccagcccagcaactgcagaagatgccccggcgcctacagagccctgagaggcctgagaagcttcatgagcgccaacaccttcggcaacgccggcttcagcgtgctgctgcccggcgccagactggagggcagatgcggccccaccaacgccagagtgagatgccacctgggcctgaagatcccccccggctgcgagctggtggtgggcggcgagccccagtgctgggccgagggccactgcctgctggtggacgacagcttcctgcacaccgtggcccacaacggcagccccgaggacggccccagagtggtgttcatcgtggacctgtggcaccccaacgtggccggcgccgagagacaggccctggacttcgtgttcgcccccgacccctag

SEQ ID NO: 16456 - DNA, 1173 bp, Artificial Sequence; identical to SEQ ID NO: 16455
  Description of Artificial Sequence: Synthetic coding sequence

SEQ ID NO: 16457 - DNA, 891 bp, Artificial Sequence
  Description of Artificial Sequence: Synthetic coding sequence
atggccagatgcgagagactgagaggcgccgccctgagagacgtgctgggcagagcccagggcgtgctgttcgactgcgacggcgtgctgtggaacggcgagagagccgtgcccggcgcccccgagctgctggagagactggccagagccggcaaggccgccctgttcgtgagcaacaacagcagaagagccagacccgagctggccctgagattcgccagactgggcttcggcggcctgagagccgagcagctgttcagcagcgccctgtgcgccgccagactgctgagacagagactgcccggcccccccgacgcccccggcgccgtgttcgtgctgggcggcgagggcctgagagccgagctgagagccgccggcctgagactggccggcgaccccagcgccggcgacggcgccgcccccagagtgagagccgtgctggtgggctacgacgagcacttcagcttcgccaagctgagagaggcctgcgcccacctgagagaccccgagtgcctgctggtggccaccgacagagacccctggcaccccctgagcgacggcagcagaacccccggcaccggcagcctggccgccgccgtggagaccgccagcggcagacaggccctggtggtgggcaagcccagcccctacatgttcgagtgcatcaccgagaacttcagcatcgaccccgccagaaccctgatggtgggcgacagactggagaccgacatcctgttcggccacagatgcggcatgaccaccgtgctgaccctgaccggcgtgagcagactggaggaggcccaggcctacctggccgccggccagcacgacctggtgccccactactacgtggagagcatcgccgacctgaccgagggcctggaggactag

SEQ ID NO: 16458 - DNA, 1506 bp, Artificial Sequence
  Description of Artificial Sequence: Synthetic coding sequence
atgcccagcgccagcgccagcagaaagagccaggagaagcccagagagatcatggacgccgccgaggactacgccaaggagagatacggcatcagcagcatgatccagagccaggagaagcccgacagagtgctggtgagagtgagagacctgaccatccagaaggccgacgaggtggtgtgggtgagagccagagtgcacaccagcagagccaagggcaagcagtgcttcctggtgctgagacagcagcagttcaacgtgcaggccctggtggccgtgggcgaccacgccagcaagcagatggtgaagttcgccgccaacatcaacaaggagagcatcgtggacgtggagggcgtggtgagaaaggtgaaccagaagatcggcagctgcacccagcaggacgtggagctgcacgtgcagaagatctacgtgatcagcctggccgagcccagactgcccctgcagctggacgacgccgtgagacccgaggccgagggcgaggaggagggcagagccaccgtgaaccaggacaccagactggacaacagagtgatcgacctgagaaccagcaccagccaggccgtgttcagactgcagagcggcatctgccacctgttcagagagaccctgatcaacaagggcttcgtggagatccagacccccaagatcatcagcgccgccagcgagggcggcgccaacgtgttcaccgtgagctacttcaagaacaacgcctacctggcccagagcccccagctgtacaagcagatgtgcatctgcgccgacttcgagaaggtgttcagcatcggccccgtgttcagagccgaggacagcaacacccacagacacctgaccgagttcgtgggcctggacatcgagatggccttcaactaccactaccacgaggtgatggaggagatcgccgacaccatggtgcagatcttcaagggcctgcaggagagattccagaccgagatccagaccgtgaacaagcagttcccctgcgagcccttcaagttcctggagcccaccctgagactggagtactgcgaggccctggccatgctgagagaggccggcgtggagatgggcgacgaggacgacctgagcacccccaacgagaagctgctgggccacctggtgaaggagaagtacgacaccgacttctacatcctggacaagtaccccctggccgtgagacccttctacaccatgcccgaccccagaaaccccaagcagagcaacagctacgacatgttcatgagaggcgaggagatcctgagcggcgcccagagaatccacgacccccagctgctgaccgagagagccctgcaccacggcatcgacctggagaagatcaaggcctacatcgacagcttcagattcggcgcccccccccacgccggcggcggcatcggcctggagagagtgaccatgctgttcctgggcctgcacaacgtgagacagaccagcatgttccccagagaccccaagagactgaccccctag

SEQ ID NO: 16459 - DNA, 1206 bp, Artificial Sequence
  Description of Artificial Sequence: Synthetic coding sequence
atggtgaagttcgccgccaacatcaacaaggagagcatcgtggacgtggagggcgtggtgagaaaggtgaaccagaagatcggcagctgcacccagcaggacgtggagctgcacgtgcagaagatctacgtgatcagcctggccgagcccagactgcccctgcagctggacgacgccgtgagacccgaggccgagggcgaggaggagggcagagccaccgtgaaccaggacaccagactggacaacagagtgatcgacctgagaaccagcaccagccaggccgtgttcagactgcagagcggcatctgccacctgttcagagagaccctgatcaacaagggcttcgtggagatccagacccccaagatcatcagcgccgccagcgagggcggcgccaacgtgttcaccgtgagctacttcaagaacaacgcctacctggcccagagcccccagctgtacaagcagatgtgcatctgcgccgacttcgagaaggtgttcagcatcggccccgtgttcagagccgaggacagcaacacccacagacacctgaccgagttcgtgggcctggacatcgagatggccttcaactaccactaccacgaggtgatggaggagatcgccgacaccatggtgcagatcttcaagggcctgcaggagagattccagaccgagatccagaccgtgaacaagcagttcccctgcgagcccttcaagttcctggagcccaccctgagactggagtactgcgaggccctggccatgctgagagaggccggcgtggagatgggcgacgaggacgacctgagcacccccaacgagaagctgctgggccacctggtgaaggagaagtacgacaccgacttctacatcctggacaagtaccccctggccgtgagacccttctacaccatgcccgaccccagaaaccccaagcagagcaacagctacgacatgttcatgagaggcgaggagatcctgagcggcgcccagagaatccacgacccccagctgctgaccgagagagccctgcaccacggcatcgacctggagaagatcaaggcctacatcgacagcttcagattcggcgcccccccccacgccggcggcggcatcggcctggagagagtgaccatgctgttcctgggcctgcacaacgtgagacagaccagcatgttccccagagaccccaagagactgaccccctag

SEQ ID NO: 16460 - DNA, 564 bp, Artificial Sequence
  Description of Artificial Sequence: Synthetic coding sequence
atgaccagcagagagcaccaggtgagcctgtgcaactgcgtgcccctgctgagaagactgctgtgcgacgccccctggagaaaggccagacccctgcacgccctgagcagatacttcagaagcagagtgagccccagcaagatggccgaggagccccagagcgtgctgcagctgcccaccagcatcgccgccggcggcgagggcctgaccgacgtgagccccgagaccaccacccccgagccccccagcagcgccgccgtgagccccggcaccgaggagcccgccggcgacaccaagaagaagatcgacatcctgctgaaggccgtgggcgacacccccatcatgaagaccaagaagtgggccgtggagagaaccagaaccatccagggcctgatcgacttcatcaagaagttcctgaagctggtggccagcgagcagctgttcatctacgtgaaccagagcttcgcccccagccccgaccaggaggtgggcaccctgtacgagtgcttcggcagcgacggcaagctggtgctgcactactgcaagagccaggcctggggctag

SEQ ID NO: 16461 - DNA, 225 bp, Artificial Sequence
  Description of Artificial Sequence: Synthetic coding sequence
atggccgaggagccccagagcgtgctgcagctgcccaccagcatcgccgccggcggcgagggcctgaccgacgtgagccccgagaccaccacccccgagccccccagcagcgccgccgtgagccccggcaccgaggagcccgccggcgacaccaagaagaagatctacctgtgcgagagcgtgctgtgcagcttccccagacccagaagctggaacagcctgtag

SEQ ID NO: 16462 - DNA, 423 bp, Artificial Sequence
  Description of Artificial Sequence: Synthetic coding sequence
atggccgaggagccccagagcgtgctgcagctgcccaccagcatcgccgccggcggcgagggcctgaccgacgtgagccccgagaccaccacccccgagccccccagcagcgccgccgtgagccccggcaccgaggagcccgccggcgacaccaagaagaagatcgacatcctgctgaaggccgtgggcgacacccccatcatgaagaccaagaagtgggccgtggagagaaccagaaccatccagggcctgatcgacttcatcaagaagttcctgaagctggtggccagcgagcagctgttcatctacgtgaaccagagcttcgcccccagccccgaccaggaggtgggcaccctgtacgagtgcttcggcagcgacggcaagctggtgctgcactactgcaagagccaggcctggggctag

SEQ ID NO: 16463 - DNA, 1479 bp, Artificial Sequence
  Description of Artificial Sequence: Synthetic coding sequence
atggccagccccagcggcaagggcgccagagccctggaggcccccggctgcggccccagacccctggccagagacctggtggacagcgtggacgacgccgagggcctgtacgtggccgtggagagatgccccctgtgcaacaccaccagaagaagactgacctgcgccaagtgcgtgcagagcggcgacttcgtgtacttcgacggcagagacagagagagattcatcgacaagaaggagagactgagcagactgaagagcaagcaggaggagttccagaaggaggtgctgaaggccatggagggcaagtggatcaccgaccagctgagatggaagatcatgagctgcaagatgagaatcgagcagctgaagcagaccatctgcaagggcaacgaggagatggagaagaacagcgagggcctgctgaagaccaaggagaagaaccagaagctgtacagcagagcccagagacaccaggagaagaaggagaagatccagagacacaacagaaagctgggcgacctggtggagaagaagaccatcgacctgagaagccactacgagagactggccaacctgagaagaagccacatcctggagctgaccagcgtgatcttccccatcgaggaggtgaagaccggcgtgagagaccccgccgacgtgagcagcgagagcgacagcgccatgaccagcagcaccgtgagcaagctggccgaggccagaagaaccacctacctgagcggcagatgggtgtgcgacgaccacaacggcgacaccagcatcagcatcaccggcccctggatcagcctgcccaacaacggcgactacagcgcctactacagctgggtggaggagaagaagaccacccagggccccgacatggagcagagcaaccccgcctacaccatcagcgccgccctgtgctacgccacccagctggtgaacatcctgagccacatcctggacgtgaacctgcccaagaagctgtgcaacagcgagttctgcggcgagaacctgagcaagcagaagttcaccagagccgtgaagaagctgaacgccaacatcctgtacctgtgcttcagccagcacgtgaacctggaccagctgcagcccctgcacaccctgagaaacctgatgtacctggtgagccccagcagcgagcacctgggcagaagcggccccttcgaggtgagagccgacctggaggagagcatggagttcgtggaccccggcgtggccggcgagagcgacgagagcggcgacgagagagtgagcgacgaggagaccgacctgggcaccgactgggagaacctgcccagccccagattctgcgacatccccagccagagcgtggaggtgagccagagccagagcacccaggccagcccccccatcgccagcagcagcgccggcggcatgatcagcagcgccgccgccagcgtgaccagctggttcaaggcctacaccggccacagatag

SEQ ID NO: 16464 - DNA, 828 bp, Artificial Sequence
  Description of Artificial Sequence: Synthetic coding sequence
atgaccgacgacaaggacgtgctgagagacgtgtggttcggcagaatccccacctgcttcaccctgtaccaggacgagatcaccgagagagaggccgagccctactacctgctgctgcccagagtgagctacctgaccctggtgaccgacaaggtgaagaagcacttccagaaggtgatgagacaggaggacatcagcgagatctggttcgagtacgagggcacccccctgaagtggcactaccccatcggcctgctgttcgacctgctggccagcagcagcgccctgccctggaacatcaccgtgcacttcaagagcttccccgagaaggacctgctgcactgccccagcaaggacgccatcgaggcccacttcatgagctgcatgaaggaggccgacgccctgaagcacaagagccaggtgatcaacgagatgcagaagaaggaccacaagcagctgtggatgggcctgcagaacgacagattcgaccagttctgggccatcaacagaaagctgatggagtaccccgccgaggagaacggcttcagatacatccccttcagaatctaccagaccaccaccgagagacccttcatccagaagctgttcagacccgtggccgccgacggccagctgcacaccctgggcgacctgctgaaggaggtgtgccccagcgccatcgaccccgaggacggcgagaagaagaaccaggtgatgatccacggcatcgagcccatgctggagacccccctgcagtggctgagcgagcacctgagctaccccgacaacttcctgcacatcagcatcatcccccagcccaccgactag

SEQ ID NO: 16465 - DNA, 276 bp, Artificial Sequence
  Description of Artificial Sequence: Synthetic coding sequence
atgaccgacgacaaggacgtgctgagagacgtgtggttcggcagaatccccacctgcttcaccctgtaccaggacgagatcaccgagagagaggccgagccctactacaccgacctgaccagcttcggccccagcatcggcaacagctggaacatcctgcagaagaagatggacttcgtgatcagccccctggagtacatcagacagagactgaaggacctgagcttcagaagctgcttcgtgctgtggctgcagatggacagctgcacccactag

SEQ ID NO: 16466 - DNA, 594 bp, Artificial Sequence
  Description of Artificial Sequence: Synthetic coding sequence
atgcactaccccatcggcctgctgttcgacctgctggccagcagcagcgccctgccctggaacatcaccgtgcacttcaagagcttccccgagaaggacctgctgcactgccccagcaaggacgccatcgaggcccacttcatgagctgcatgaaggaggccgacgccctgaagcacaagagccaggtgatcaacgagatgcagaagaaggaccacaagcagctgtggatgggcctgcagaacgacagattcgaccagttctgggccatcaacagaaagctgatggagtaccccgccgaggagaacggcttcagatacatccccttcagaatctaccagaccaccaccgagagacccttcatccagaagctgttcagacccgtggccgccgacggccagctgcacaccctgggcgacctgctgaaggaggtgtgccccagcgccatcgaccccgaggacggcgagaagaagaaccaggtgatgatccacggcatcgagcccatgctggagacccccctgcagtggctgagcgagcacctgagctaccccgacaacttcctgcacatcagcatcatcccccagcccaccgactag

SEQ ID NO: 16467 - DNA, 828 bp, Artificial Sequence; identical to SEQ ID NO: 16464
  Description of Artificial Sequence: Synthetic coding sequence

SEQ ID NO: 16468 - DNA, 384 bp, Artificial Sequence
  Description of Artificial Sequence: Synthetic coding sequence
atgtgctgcgccgtgagcgagcagagactgacctgcgccgaccagatgatgcccttcggcaagatcagccagcagctgtgcggcgtgaagaagctgccctggagctgcgacagcagatacttctggggctggctgaacgccgtgttcaacaaggtggactacgacagaatcagagacgtgggccccgacagagccgccagcgagtggctgctgagatgcggcgccatggtgagataccacggccaggagagatggcagaaggactacaaccacctgcccaccggccccctggacaagtacaagatccaggccatcgacgccaccgacagctgcatcatgagcatcggcttcgaccacatggagaccagcaacatctgctgctag

SEQ ID NO: 16469 - DNA, 411 bp, Artificial Sequence
  Description of Artificial Sequence: Synthetic coding sequence
atgtgctgcgccgtgagcgagcagagactgacctgcgccgaccagatgatgcccttcggcaagatcagccagcagctgtgcggcgtgaagaagctgccctggagctgcgacagcagatacttctggggctggctgaacgccgtgttcaacaaggtggactacgacagaatcagagacgtgggccccgacagagccgccagcgagtggctgctgagatgcggcgccatggtgagataccacggccaggagagatggcagaaggactacaaccacctgcccaccggccccctggacaagtacaagatccaggccatcgacgccaccgacagctgcatcatgagcatcggcttcgaccacatgggcaactaccccatcgtgctgctgatcgagaacgccgacgacctgcagtag

SEQ ID NO: 16470 - DNA, 783 bp, Artificial Sequence
  Description of Artificial Sequence: Synthetic coding sequence
atggccgccgtggtggtggccgccgccggcggcgccggccccgccgtgctgcaggtggccggcctgtacagaggcctgtgcgccgtgagaagcagagccctgggcctgggcctggtgagccccgcccagctgagagtgttccccgtgagacccggcagcggcagacccgagggcggcgccgacagcagcggcgtgggcgccgaggccgagctgcaggccaaccccttctacgacagatacagagacaagatccagctgctgagaagaagcgaccccgccgccttcgagagcagactggagaagagaagcgagttcagaaagcagcccgtgggccacagcagacagggcgacttcatcaagtgcgtggagcagaagaccgacgccctgggcaagcagagcgtgaacagaggcttcaccaaggacaagaccctgagcagcatcttcaacatcgagatggtgaaggagaagaccgccgaggagatcaagcagatctggcagcagtacttcgccgccaaggacaccgtgtacgccgtgatccccgccgagaagttcgacctgatctggaacagagcccagagctgccccaccaacgtggccgaggcccagtgcatcgccaaccaggtgcagctgttctacgccaccgacagaaaggagacctacggcctggtggagaccttcaacctgagacccaacgagttcaagtacatgagcgtgatcgccgagctggagcagagcggcctgggcgccgagctgaagtgcgcccagaaccagaacaagacctag

SEQ ID NO: 16471 - DNA, 987 bp, Artificial Sequence
  Description of Artificial Sequence: Synthetic coding sequence
atggccgccgtggtggtggccgccgccggcggcgccggccccgccgtgctgcaggtggccggcctgtacagaggcctgtgcgccgtgagaagcagagccctgggcctgggcctggtgagccccgcccagctgagagtgttccccgtgagacccggcagcggcagacccgagggcggcgccgacagcagcggcgtgggcgccgaggccgagctgcaggccaaccccttctacgacagatacagagacaagatccagctgctgagaagaagcgaccccgccgccttcgagagcagactggagaagagaagcgagttcagaaagcagcccgtgggccacagcagacagggcgacttcatcaagtgcgtggagcagaagaccgacgccctgggcaagcagagcgtgaacagaggcttcaccaaggacaagaccctgagcagcatcttcaacatcgagatggtgaaggagaagaccgccgaggagatcaagcagatctggcagcagtacttcgccgccaaggacaccgtgtacgccgtgatccccgccgagaagttcgacctgatctggaacagagcccagagctgccccaccttcctgtgcgccctgcccagaagagagggctacgagttcttcgtgggccagtggaccggcaccgagctgcacttcaccgccctgatcaacatccagaccagaggcgaggccgccgccagccagctgatcctgtaccactaccccgagctgaaggaggagaagggcatcgtgctgatgaccgccgagatggacagcaccttcctgaacgtggccgaggcccagtgcatcgccaaccaggtgcagctgttctacgccaccgacagaaaggagacctacggcctggtggagaccttcaacctgagacccaacgagttcaagtacatgagcgtgatcgccgagctggagcagagcggcctgggcgccgagctgaagtgcgcccagaaccagaacaagacctag

SEQ ID NO: 16472 - DNA, 723 bp, Artificial Sequence
  Description of Artificial Sequence: Synthetic coding sequence
atgagcgaccccgccgccttcgagagcagactggagaagagaagcgagttcagaaagcagcccgtgggccacagcagacagggcgacttcatcaagtgcgtggagcagaagaccgacgccctgggcaagcagagcgtgaacagaggcttcaccaaggacaagaccctgagcagcatcttcaacatcgagatggtgaaggagaagaccgccgaggagatcaagcagatctggcagcagtacttcgccgccaaggacaccgtgtacgccgtgatccccgccgagaagttcgacctgatctggaacagagcccagagctgccccaccttcctgtgcgccctgcccagaagagagggctacgagttcttcgtgggccagtggaccggcaccgagctgcacttcaccgccctgatcaacatccagaccagaggcgaggccgccgccagccagctgatcctgtaccactaccccgagctgaaggaggagaagggcatcgtgctgatgaccgccgagatggacagcaccttcctgaacgtggccgaggcccagtgcatcgccaaccaggtgcagctgttctacgccaccgacagaaaggagacctacggcctggtggagaccttcaacctgagacccaacgagttcaagtacatgagcgtgatcgccgagctggagcagagcggcctgggcgccgagctgaagtgcgcccagaaccagaacaagacctag

SEQ ID NO: 16473 - DNA, 534 bp, Artificial Sequence
  Description of Artificial Sequence: Synthetic coding sequence
atggtgaaggagaagaccgccgaggagatcaagcagatctggcagcagtacttcgccgccaaggacaccgtgtacgccgtgatccccgccgagaagttcgacctgatctggaacagagcccagagctgccccaccttcctgtgcgccctgcccagaagagagggctacgagttcttcgtgggccagtggaccggcaccgagctgcacttcaccgccctgatcaacatccagaccagaggcgaggccgccgccagccagctgatcctgtaccactaccccgagctgaaggaggagaagggcatcgtgctgatgaccgccgagatggacagcaccttcctgaacgtggccgaggcccagtgcatcgccaaccaggtgcagctgttctacgccaccgacagaaaggagacctacggcctggtggagaccttcaacctgagacccaacgagttcaagtacatgagcgtgatcgccgagctggagcagagcggcctgggcgccgagctgaagtgcgcccagaaccagaacaagacctag

SEQ ID NO: 16474 - DNA, 138 bp, Artificial Sequence
  Description of Artificial Sequence: Synthetic coding sequence
atgagcgaccccgccgccttcgagagcagactggagaagagaagcgagttcagaaagcagcccgtgggccacagcagacagggcgacttcatcaagtgcgtggagcagaaggacggcgcccagaacaagctggtgtag

SEQ ID NO: 16475 - DNA, 783 bp, Artificial Sequence; identical to SEQ ID NO: 16470
  Description of Artificial Sequence: Synthetic coding sequence

SEQ ID NO: 16476 - DNA, 207 bp, Artificial Sequence
  Description of Artificial Sequence: Synthetic coding sequence
atgccccagctgaacaccaccgtgtggcccaccatgatcacccccatgctgctgaccctgttcctgatcacccagctgaagatgctgaacaccaactaccacctgccccccagccccaagcccatgaagatgaagaactacaacaagccctgggagcccaagtggaccaagatctgcagcctgcacagcctgcccccccagagctag

SEQ ID NO: 16477 - DNA, 642 bp, Artificial Sequence
  Description of Artificial Sequence: Synthetic coding sequence
atggcccccgcccagagacccctgctgcccctgctgctgctgctgctgcccctgccccccccccccttcgccagagccgaggacgccgccagagccaacagcgacagatacgccgtgtactggaacagaagcaaccccagattccacgccggcgccggcgacgacggcggcggctacaccgtggaggtgagcatcaacgactacctggacatctactgcccccactacggcgcccccctgccccccgccgagagaatggagcactacgtgctgtacatggtgaacggcgagggccacgccagctgcgaccacagacagagaggcttcaagagatgggagtgcaacagacccgccgcccccggcggccccctgaagttcagcgagaagttccagctgttcacccccttcagcctgggcttcgagttcagacccggccacgagtactactacatcagcgccaccccccccaacgccgtggacagaccctgcctgagactgaaggtgtacgtgagacccaccaacgagaccctgtacgaggcccccgagcccatcttcaccagcaacaacagctgcagcagccccggcggctgcagactgttcctgagcaccatccccgtgctgtggaccctgctgggcagctag

SEQ ID NO: 16478 - DNA, 507 bp, Artificial Sequence
  Description of Artificial Sequence: Synthetic coding sequence
atgctgcccgccgccctgctgagaagacccggcctgggcagactggtgagacacgccagagcctacgccgaggccgccgccgcccccgccgccgccagcggccccaaccagatgagcttcaccttcgccagccccacccaggtgttcttcaacggcgccaacgtgagacaggtggacgtgcccaccctgaccggcgccttcggcatcctggccgcccacgtgcccaccctgcaggtgctgagacccggcctggtggtggtgcacgccgaggacggcaccaccagcaagtacttcgtgagcagcggcagcatcgccgtgaacgccgacagcagcgtgcagctgctggccgaggaggccgtgaccctggacatgctggacctgggcgccgccaaggccaacctggagaaggcccaggccgagctggtgggcaccgccgacgaggccaccagagccgagatccagatcagaatcgaggccaacgaggccctggtgaaggccctggagtag

SEQ ID NO: 16479 - DNA, 156 bp, Artificial Sequence
  Description of Artificial Sequence: Synthetic coding sequence
atggtggcctactggagacaggccggcctgagctacatcagatacagccagatctgcgccaaggtggtgagagacgccctgaagaccgagttcaaggccaacgccaagaagaccagcggcaacagcgtgaagatcgtgaaggtgaagaaggagtag

SEQ ID NO: 16480 - DNA, 771 bp, Artificial Sequence
  Description of Artificial Sequence: Synthetic coding sequence
atgctgagcagagtggtgctgagcgccgccgccaccgccgcccccagcctgaagaacgccgccttcctgggccccggcgtgctgcaggccaccagaaccttccacaccggccagccccacctggtgcccgtgccccccctgcccgagtacggcggcaaggtgagatacggcctgatccccgaggagttcttccagttcctgtaccccaagaccggcgtgaccggcccctacgtgctgggcaccggcctgatcctgtacgccctgagcaaggagatctacgtgatcagcgccgagaccttcaccgccctgagcgtgctgggcgtgatggtgtacggcatcaagaagtacggccccttcgtggccgacttcgccgacaagctgaacgagcagaagctggcccagctggaggaggccaagcaggccagcatccagcacatccagaacgccatcgacaccgagaagagccagcaggccctggtgcagaagagacactacctgttcgacgtgcagagaaacaacatcgccatggccctggaggtgacctacagagagagactgtacagagtgtacaaggaggtgaagaacagactggactaccacatcagcgtgcagaacatgatgagaagaaaggagcaggagcacatgatcaactgggtggagaagcacgtggtgcagagcatcagcacccagcaggagaaggagaccatcgccaagtgcatcgccgacctgaagctgctggccaagaaggcccaggcccagcccgtgatgtag

SEQ ID NO: 16481 - DNA, 588 bp, Artificial Sequence
  Description of Artificial Sequence: Synthetic coding sequence
atgctgagcagagtggtgctgagcgccgccgccaccgccggcccctacgtgctgggcaccggcctgatcctgtacgccctgagcaaggagatctacgtgatcagcgccgagaccttcaccgccctgagcgtgctgggcgtgatggtgtacggcatcaagaagtacggccccttcgtggccgacttcgccgacaagctgaacgagcagaagctggcccagctggaggaggccaagcaggccagcatccagcacatccagaacgccatcgacaccgagaagagccagcaggccctggtgcagaagagacactacctgttcgacgtgcagagaaacaacatcgccatggccctggaggtgacctacagagagagactgtacagagtgtacaaggaggtgaagaacagactggactaccacatcagcgtgcagaacatgatgagaagaaaggagcaggagcacatgatcaactgggtggagaagcacgtggtgcagagcatcagcacccagcaggagaaggagaccatcgccaagtgcatcgccgacctgaagctgctggccaagaaggcccaggcccagcccgtgatgtag

SEQ ID NO: 16482 - DNA, 486 bp, Artificial Sequence
  Description of Artificial Sequence: Synthetic coding sequence
atggccggcagaaagctggccctgaagaccatcgactgggtggccttcgccgagatcatcccccagaaccagaaggccatcgccagcagcctgaagagctggaacgagaccctgaccagcagactggccgccctgcccgagaacccccccgccatcgactgggcctactacaaggccaacgtggccaaggccggcctggtggacgacttcgagaagaagttcaacgccctgaaggtgcccgtgcccgaggacaagtacaccgcccaggtggacgccgaggagaaggaggacgtgaagagctgcgccgagtgggtgagcctgagcaaggccagaatcgtggagtacgagaaggagatggagaagatgaagaacctgatccccttcgaccagatgaccatcgaggacctgaacgaggccttccccgagaccaagctggacaagaagaagtacccctactggccccaccagcccatcgagaacctgtag

SEQ ID NO: 16483 - DNA, 414 bp, Artificial Sequence
  Description of Artificial Sequence: Synthetic coding sequence
atggccggcagaaagctggccctgaagaccatcgactgggtggccttcgccgagatcatcccccagaaccagaaggccatcgccagcagcctgaagagctggaacgagaccctgaccagcagactggccgccctgcccgagaacccccccgccatcgactgggcctactacaaggccaacgtggccaaggccggcctggtggacgacttcgagaagaaggtgaagagctgcgccgagtgggtgagcctgagcaaggccagaatcgtggagtacgagaaggagatggagaagatgaagaacctgatccccttcgaccagatgaccatcgaggacctgaacgaggccttccccgagaccaagctggacaagaagaagtacccctactggccccaccagcccatcgagaacctgtag

SEQ ID NO: 16484 - DNA, 309 bp, Artificial Sequence
  Description of Artificial Sequence: Synthetic coding sequence
atggccggcagaaagctggccctgaagaccatcgactgggtggccttcgccgagatcatcccccagaaccagaaggccatcgccagcagcctgaagagctggaacgagaccctgaccagcagactggccgccctgcccgagaacccccccgccatcgactgggcctactacaaggccaacgtggccaaggccggcctggtggacgacttcgagaagaagttcaacgccctgaaggtgcccgtgcccgaggacaagtacaccgcccaggtggacgccgaggagaaggaggacaagaagaagaagaagtag

SEQ ID NO: 16485 - DNA, 285 bp, Artificial Sequence
  Description of Artificial Sequence: Synthetic coding sequence
atggccagcgtgggcgagtgccccgcccccgtgcccgtgaaggacaagaagctgctggaggtgaagctgggcgagctgcccagctggatcctgatgagagacttcagccccagcggcatcttcggcgccttccagagaggctactacagatactacaacaagtacatcaacgtgaagaagggcagcatcagcggcatcaccatggtgctggcctgctacgtgctgttcagctacagcttcagctacaagcacctgaagcacgagagactgagaaagtaccactag

SEQ ID NO: 16486 - DNA, 168 bp, Artificial Sequence
  Description of Artificial Sequence: Synthetic coding sequence
atggccagcgtgggcgagtgccccgcccccgtgcccgtgaaggacaagaagctgctggaggtgaagctgggcgagctgcccagctggatcctgatgagagacttcagccccagcggcatcttcggcgccttccagagagagcacgagagactgagaaagtaccactag

SEQ ID NO: 16487 - DNA, 267 bp, Artificial Sequence
  Description of Artificial Sequence: Synthetic coding sequence
atggccagcgtggtgcccgtgaaggacaagaagctgctggaggtgaagctgggcgagctgcccagctggatcctgatgagagacttcagccccagcggcatcttcggcgccttccagagaggctactacagatactacaacaagtacatcaacgtgaagaagggcagcatcagcggcatcaccatggtgctggcctgctacgtgctgttcagctacagcttcagctacaagcacctgaagcacgagagactgagaaagtaccactag

SEQ ID NO: 16488 - DNA, 150 bp, Artificial Sequence
  Description of Artificial Sequence: Synthetic coding sequence
atggccagcgtggtgcccgtgaaggacaagaagctgctggaggtgaagctgggcgagctgcccagctggatcctgatgagagacttcagccccagcggcatcttcggcgccttccagagagagcacgagagactgagaaagtaccactag

SEQ ID NO: 16489 - DNA, 267 bp, Artificial Sequence
  Description of Artificial Sequence: Synthetic coding sequence
atgagcagcaagctgcccgtgaaggacaagaagctgctggaggtgaagctgggcgagctgcccagctggatcctgatgagagacttcagccccagcggcatcttcggcgccttccagagaggctactacagatactacaacaagtacatcaacgtgaagaagggcagcatcagcggcatcaccatggtgctggcctgctacgtgctgttcagctacagcttcagctacaagcacctgaagcacgagagactgagaaagtaccactag

SEQ ID NO: 16490 - DNA, 312 bp, Artificial Sequence
  Description of Artificial Sequence: Synthetic coding sequence
atggcccagttcgtgagaaacctggtggagaagacccccgccctggtgaacgccgccgtgacctacagcaagcccagactggccaccttctggtactacgccaaggtggagctggtgccccccacccccgccgagatccccagagccatccagagcctgaagaagatcgtgaacagcgcccagaccggcagcttcaagcagctgaccgtgaaggaggccgtgctgaacggcctggtggccaccgaggtgctgatgtggttctacgtgggcgagatcatcggcaagagaggcatcatcggctacgacgtgtag

SEQ ID NO: 16491 - DNA, 303 bp, Artificial Sequence
  Description of Artificial Sequence: Synthetic coding sequence
atggcccccttcgtgagaaacctggtggagaagacccccgccctggtgaacgccgccgtgacctacctgaagcccagactggccgccttctggtactacaccaccgtggagctggtgccccccacccccgccgagatccccagagccatccagagcctgaagaagatcgtgagcagcgcccagaccggcagcttcaagcagctgaccgtgaaggaggccctgctgaacggcctggtggccaccgaggtgagcacctggttctacgtgagagagatcaccggcaagagaggcatcatcggctag

SEQ ID NO: 16492 - DNA, 648 bp, Artificial Sequence
  Description of Artificial Sequence: Synthetic coding sequence
atgtgctgcgccgtgagcgagcagagactgacctgcgccgaccagatgatgcccttcggcaagatcagccagcagctgtgcggcgtgaagaagctgccctggagctgcgacagcagatacttctggggctggctgaacgccgtgttcaacaaggtggactacgacagaatcagagacgtgggccccgacagagccgccagcgagtggctgctgagatgcggcgccatggtgagataccacggccaggagagatggcagaaggactacaaccacctgcccaccggccccctggacaagtacaagatccaggccatcgacgccaccgacagctgcatcatgagcatcggcttcgaccacatggagggcctggagcacgtggagaagatcagactgtgcaagtgccactacatcgaggacgactgcctgctgagactgagccagctggagaacctgcagaagaccatcctggagatggagatcatcagctgcggcaacatcaccgacaagggcatcatcgccctgagacacctgagaaacctgaagtacctgctgctgagcgacctgcccggcgtgagagagaaggagaacctggtgcaggccttcaagaccgccctgcccagcctggagctgaagctgcagctgaagtag

SEQ ID NO: 16493 - DNA, 801 bp, Artificial Sequence
  Description of Artificial Sequence: Synthetic coding sequence
atgatcagaggcagcggcgccgaggcctgcagcaacgaggacggctgcagcgagaagggcatgaagggcgtggactacgacagaatcagagacgtgggccccgacagagccgccagcgagtggctgctgagatgcggcgccatggtgagataccacggccaggagagatggcagaaggactacaaccacctgcccaccggccccctggacaagtacaagatccaggccatcgacgccaccgacagctgcatcatgagcatcggcttcgaccacatggagggcctggagcacgtggagaagatcagactgtgcaagtgccactacatcgaggacgactgcctgctgagactgagccagctggagaacctgcagaagaccatcctggagatggagatcatcagctgcggcaacatcaccgacaagggcatcatcgccctgagacacctgagaaacctgaagtacctgctgctgagcgacctgcccggcgccggcaaccccggcccctgcgtggccagcggcagcagcagaaccagagcccccctgggcttcagagagagaggcctgcaggagaccgacgtgcccggcgccctggtggacagaagctacgacctgagccccagcgccggcatgagaatgctggagctgaaggccaccaccgccatcctgaagagcagattccagctgagcgtgcccggcggcagcctgctgttcaagcagagccccgtgggccacagcagcatcagcttctggccctacaaggccatcctgagacagagcagagccggcgacaaccaggagtag

SEQ ID NO: 16494 - DNA, 444 bp, Artificial Sequence
  Description of Artificial Sequence: Synthetic coding sequence
atggccggcagaggcaagctgatcgccgtgatcggcgacgaggacaccgtgaccggcttcctgctgggcggcatcggcgagctgaacaagaacagacaccccaacttcctggtggtggagaaggacaccaccatcaacgagatcgaggacaccttcagaagcctgggcagcctgcccggcagcgtggtggaggccaaccccaaccagagagacccccccctgtgggacgagatcgacagcagacagttcctgaacagagacgacatcggcatcatcctgatcaaccagtacatcgccgagatggtgagacacgccctggacgcccaccagcagagcatccccgccgtgctggagatccccagcaaggagcacccctacgacgccgccaaggacagcatcctgagaagagccagaggcatgttcaccgccgaggacctgagatag

SEQ ID NO: 16495 - DNA, 321 bp, Artificial Sequence
  Description of Artificial Sequence: Synthetic coding sequence
atggccgtgaccgccctggccgccagaacctggctgggcgtgtggggcgtgagaaccatgcaggccagaggcttcggcagcgaccagagcgagaacgtggacagaggcgccggcagcatcagagaggccggcggcgccttcggcaagagagagcaggccgaggaggagagatacttcagagcccagagcagagagcagctggccgccctgaagaagcaccacgaggaggagatcgtgcaccacaagaaggagatcgagagactgcagaaggagatcgagagacacaagcagaagatcaagatgctgaagcacgacgactag

SEQ ID NO: 16496 - DNA, 183 bp, Artificial Sequence
  Description of Artificial Sequence: Synthetic coding sequence
atggccgtgaccgccctggccgccagaacctggctgggcgtgtggggcgtgagaaccatgcaggccagaggcttcggcagcgaccagagcgagaacgtggacagaggcgccggcagcatcagagaggccggcggcgccttcggcaagagagagcaggccgaggaggagagatacttcagatag

SEQ ID NO: 16497 - DNA, 216 bp, Artificial Sequence
  Description of Artificial Sequence: Synthetic coding sequence
atggccgtgaccgccctggccgccagaacctggctgggcgtgtggggcgtgagaaccatgcaggccagaggcttcggcagcgaccagagcgagaacgtggacagaggcgccggcagcatcagagaggccggcggcgccttcggcaagagagagcaggccgaggaggagagatacttcagacactacagactgtgcttcgagatcagcctgggctag

SEQ ID NO: 16498 - DNA, 3261 bp, Artificial Sequence
  Description of Artificial Sequence: Synthetic coding sequence
atggagaagtgggaggagctgaacagccaccagcccggcgaggagtacgaccccagcaaggccaccttcgtgaaggtggtgcccacccccaacaacggcagcaccgagctggtggccctgcacagaaacgagggcgaggacggcctggaggtgctgagcttcgagttccagaagatcaagtacagctacgacgccctggagaagaagcagttcctgcccgtggccttccccgtgggcaacgccttcagctactaccagagcaacagaggcttccaggaggacagcgagatcagagccgccgagaagaagttcggcagcaacaaggccgagatggtggtgcccgacttcagcgagctgttcaaggagagagccaccgcccccttcttcgtgttccaggtgttctgcgtgggcctgtggtgcctggacgagtactggtactacagcgtgttcaccctgagcatgctggtggccttcgaggccagcctggtgcagcagcagatgagaaacatgagcgagatcagaaagatgggcaacaagccccacatgatccaggtgtacagaagcagaaagtggagacccatcgccagcgacgagatcgtgcccggcgacatcgtgagcatcggcagaagcccccaggagaacctggtgccctgcgacgtgctgctgctgagaggcagatgcatcgtggacgaggccatgctgaccggcgagagcgtgccccagatgaaggagcccatcgaggacctgagccccgacagagtgctggacctgcaggccgacagcagactgcacgtgatcttcggcggcaccaaggtggtgcagcacatccccccccagaaggccaccaccggcctgaagcccgtggacagcggctgcgtggcctacgtgctgagaaccggcttcaacaccagccagggcaagctgctgagaaccatcctgttcggcgtgaagagagtgaccgccaacaacctggagaccttcatcttcatcctgttcctgctggtgttcgccatcgccgccgccgcctacgtgtggatcgagggcaccaaggaccccagcagaaacagatacaagctgttcctggagtgcaccctgatcctgaccagcgtggtgccccccgagctgcccatcgagctgagcctggccgtgaacaccagcctgatcgccctggccaagctgtacatgtactgcaccgagcccttcagaatccccttcgccggcaaggtggaggtgtgctgcttcgacaagaccggcaccctgaccagcgacagcctggtggtgagaggcgtggccggcctgagagacggcaaggaggtgacccccgtgagcagcatccccgtggagacccacagagccctggccagctgccacagcctgatgcagctggacgacggcaccctggtgggcgaccccctggagaaggccatgctgaccgccgtggactggaccctgaccaaggacgagaaggtgttccccagaagcatcaagacccagggcctgaagatccaccagagattccacttcgccagcgccctgaagagaatgagcgtgctggccagctacgagaagctgggcagcaccgacctgtgctacatcgccgccgtgaagggcgcccccgagaccctgcacagcatgttcagccagtgcccccccgactaccaccacatccacaccgagatcagcagagagggcgccagagtgctggccctgggctacaaggagctgggccacctgacccaccagcaggccagagaggtgaagagagaggccctggagtgcagcctgaagttcgtgggcttcatcgtggtgagctgccccctgaaggccgacagcaaggccgtgatcagagagatccagaacgccagccacagagtggtgatgatcaccggcgacaaccccctgaccgcctgccacgtggcccaggagctgcacttcatcgagaaggcccacaccctgatcctgcagccccccagcgagaagggcagacagtgcgagtggagaagcatcgacggcagcatcgtgctgcccctggccagaggcagccccaaggccctggccctggagtacgccctgtgcctgaccggcgacggcctggcccacctgcaggccaccgacccccagcagctgctgagactgatcccccacgtgcaggtgttcgccagagtggcccccaagcagaaggagttcgtgatcaccagcctgaaggagctgggctacgtgaccctgatgtgcggcgacggcaccaacgacgtgggcgccctgaagcacgccgacgtgggcgtggccctgctggccaacgcccccgagagagtggtggagagaagaagaagacccagagacagccccaccctgagcaacagcggcatcagagccaccagcagaaccgccaagcagagaagcggcctgccccccagcgaggagcagcccaccagccagagagacagactgagccaggtgctgagagacctggaggacgagagcacccccatcgtgaagctgggcgacgccagcatcgccgcccccttcaccagcaagctgagcagcatccagtgcatctgccacgtgatcaagcagggcagatgcaccctggtgaccaccctgcagatgttcaagatcctggccctgaacgccctgatcctggcctacagccagagcgtgctgtacctggagggcgtgaagttcagcgacttccaggccaccctgcagggcctgctgctggccggctgcttcctgttcatcagcagaagcaagcccctgaagaccctgagcagagagagacccctgcccaacatcttcaacctgtacaccatcctgaccgtgatgctgcagttcttcgtgcacttcctgagcctggtgtacctgtacagagaggcccaggccagaagccccgagaagcaggagcagttcgtggacctgtacaaggagttcgagcccagcctggtgaacagcaccgtgtacatcatggccatggccatgcagatggccaccttcgccatcaactacaagggcccccccttcatggagagcctgcccgagaacaagcccctggtgtggagcctggccgtgagcctgctggccatcatcggcctgctgctgggcagcagccccgacttcaacagccagttcggcctggtggacatccccgtggagttcaagctggtgatcgcccaggtgctgctgctggacttctgcctggccctgctggccgacagagtgctgcagttcttcctgggcacccccaagctgaaggtgcccagctag

SEQ ID NO: 16499 - DNA, 3615 bp, Artificial Sequence
  Description of Artificial Sequence: Synthetic coding sequence
atggccgccgccgccgccgtgggcaacgccgtgccctgcggcgccagaccctgcggcgtgagacccgacggccagcccaagcccggcccccagcccagagccctgctggccgccggccccgccctgatcgccaacggcgacgagctggtggccgccgtgtggccctacagaagactggccctgctgagaagactgaccgtgctgcccttcgccggcctgctgtaccccgcctggctgggcgccgccgccgccggctgctggggctggggcagcagctgggtgcagatccccgaggccgccctgctggtgctggccaccatctgcctggcccacgccctgaccgtgctgagcggccactggagcgtgcacgcccactgcgccctgacctgcacccccgagtacgaccccagcaaggccaccttcgtgaaggtggtgcccacccccaacaacggcagcaccgagctggtggccctgcacagaaacgagggcgaggacggcctggaggtgctgagcttcgagttccagaagatcaagtacagctacgacgccctggagaagaagcagttcctgcccgtggccttccccgtgggcaacgccttcagctactaccagagcaacagaggcttccaggaggacagcgagatcagagccgccgagaagaagttcggcagcaacaaggccgagatggtggtgcccgacttcagcgagctgttcaaggagagagccaccgcccccttcttcgtgttccaggtgttctgcgtgggcctgtggtgcctggacgagtactggtactacagcgtgttcaccctgagcatgctggtggccttcgaggccagcctggtgcagcagcagatgagaaacatgagcgagatcagaaagatgggcaacaagccccacatgatccaggtgtacagaagcagaaagtggagacccatcgccagcgacgagatcgtgcccggcgacatcgtgagcatcggcagaagcccccaggagaacctggtgccctgcgacgtgctgctgctgagaggcagatgcatcgtggacgaggccatgctgaccggcgagagcgtgccccagatgaaggagcccatcgaggacctgagccccgacagagtgctggacctgcaggccgacagcagactgcacgtgatcttcggcggcaccaaggtggtgcagcacatccccccccagaaggccaccaccggcctgaagcccgtggacagcggctgcgtggcctacgtgctgagaaccggcttcaacaccagccagggcaagctgctgagaaccatcctgttcggcgtgaagagagtgaccgccaacaacctggagaccttcatcttcatcctgttcctgctggtgttcgccatcgccgccgccgcctacgtgtggatcgagggcaccaaggaccccagcagaaacagatacaagctgttcctggagtgcaccctgatcctgaccagcgtggtgccccccgagctgcccatcgagctgagcctggccgtgaacaccagcctgatcgccctggccaagctgtacatgtactgcaccgagcccttcagaatccccttcgccggcaaggtggaggtgtgctgcttcgacaagaccggcaccctgaccagcgacagcctggtggtgagaggcgtggccggcctgagagacggcaaggaggtgacccccgtgagcagcatccccgtggagacccacagagccctggccagctgccacagcctgatgcagctggacgacggcaccctggtgggcgaccccctggagaaggccatgctgaccgccgtggactggaccctgaccaaggacgagaaggtgttccccagaagcatcaagacccagggcctgaagatccaccagagattccacttcgccagcgccctgaagagaatgagcgtgctggccagctacgagaagctgggcagcaccgacctgtgctacatcgccgccgtgaagggcgcccccgagaccctgcacagcatgttcagccagtgcccccccgactaccaccacatccacaccgagatcagcagagagggcgccagagtgctggccctgggctacaaggagctgggccacctgacccaccagcaggccagagaggtgaagagagaggccctggagtgcagcctgaagttcgtgggcttcatcgtggtgagctgccccctgaaggccgacagcaaggccgtgatcagagagatccagaacgccagccacagagtggtgatgatcaccggcgacaaccccctgaccgcctgccacgtggcccaggagctgcacttcatcgagaaggcccacaccctgatcctgcagccccccagcgagaagggcagacagtgcgagtggagaagcatcgacggcagcatcgtgctgcccctggccagaggcagccccaaggccctggccctggagtacgccctgtgcctgaccggcgacggcctggcccacctgcaggccaccgacccccagcagctgctgagactgatcccccacgtgcaggtgttcgccagagtggcccccaagcagaaggagttcgtgatcaccagcctgaaggagctgggctacgtgaccctgatgtgcggcgacggcaccaacgacgtgggcgccctgaagcacgccgacgtgggcgtggccctgctggccaacgcccccgagagagtggtggagagaagaagaagacccagagacagccccaccctgagcaacagcggcatcagagccaccagcagaaccgccaagcagagaagcggcctgccccccagcgaggagcagcccaccagccagagagacagactgagccaggtgctgagagacctggaggacgagagcacccccatcgtgaagctgggcgacgccagcatcgccgcccccttcaccagcaagctgagcagcatccagtgcatctgccacgtgatcaagcagggcagatgcaccctggtgaccaccctgcagatgttcaagatcctggccctgaacgccctgatcctggcctacagccagagcgtgctgtacctggagggcgtgaagttcagcgacttccaggccaccctgcagggcctgctgctggccggctgcttcctgttcatcagcagaagcaagcccctgaagaccctgagcagagagagacccctgcccaacatcttcaacctgtacaccatcctgaccgtgatgctgcagttcttcgtgcacttcctgagcctggtgtacctgtacagagaggcccaggccagaagccccgagaagcaggagcagttcgtggacctgtacaaggagttcgagcccagcctggtgaacagcaccgtgtacatcatggccatggccatgcagatggccaccttcgccatcaactacaagggcccccccttcatggagagcctgcccgagaacaagcccctggtgtggagcctggccgtgagcctgctggccatcatcggcctgctgctgggcagcagccccgacttcaacagccagttcggcctggtggacatccccgtggagttcaagctggtgatcgcccaggtgctgctgctggacttctgcctggccctgctggccgacagagtgctgcagttcttcctgggcacccccaagctgaaggtgcccagctag

SEQ ID NO: 16500 - DNA, 3681 bp, Artificial Sequence
  Description of Artificial Sequence: Synthetic coding sequence
atggacagagaggagagaaagaccatcaaccagggccaggaggacgagatggagatctacggctacaacctgagcagatggaagctggccatcgtgagcctgggcgtgatctgcagcggcggcttcctgctgctgctgctgtactggatgcccgagtggagagtgaaggccacctgcgtgagagccgccatcaaggactgcgaggtggtgctgctgagaaccaccgacgagttcaagatgtggttctgcgccaagatcagagtgctgagcctggagacctaccccgtgagcagccccaagagcatgagcaacaagctgagcaacggccacgccgtgtgcctgatcgagaaccccaccgaggagaacagacacagaatcagcaagtacagccagaccgagagccagcagatcagatacttcacccaccacagcgtgaagtacttctggaacgacaccatccacaacttcgacttcctgaagggcctggacgagggcgtgagctgcaccagcatctacgagaagcacagcgccggcctgaccaagggcatgcacgcctacagaaagctgctgtacggcgtgaacgagatcgccgtgaaggtgcccagcgtgttcaagctgctgatcaaggaggtgctgaaccccttctacatcttccagctgttcagcgtgatcctgtggagcaccgacgagtactactactacgccctggccatcgtggtgatgagcatcgtgagcatcgtgagcagcctgtacagcatcagaaagcagtacgtgatgctgcacgacatggtggccacccacagcaccgtgagagtgagcgtgtgcagagtgaacgaggagatcgaggagatcttcagcaccgacctggtgcccggcgacgtgatggtgatccccctgaacggcaccatcatgccctgcgacgccgtgctgatcaacggcacctgcatcgtgaacgagagcatgctgaccggcgagagcgtgcccgtgaccaagaccaacctgcccaaccccagcgtggacgtgaagggcatcggcgacgagctgtacaaccccgagacccacaagagacacaccctgttctgcggcaccaccgtgatccagaccagattctacaccggcgagctggtgaaggccatcgtggtgagaaccggcttcagcaccagcaagggccagctggtgagaagcatcctgtaccccaagcccaccgacttcaagctgtacagagacgcctacctgttcctgctgtgcctggtggccgtggccggcatcggcttcatctacaccatcatcaacagcatcctgaacgaggtgcaggtgggcgtgatcatcatcgagagcctggacatcatcaccatcaccgtgccccccgccctgcccgccgccatgaccgccggcatcgtgtacgcccagagaagactgaagaagatcggcatcttctgcatcagcccccagagaatcaacatctgcggccagctgaacctggtgtgcttcgacaagaccggcaccctgaccgaggacggcctggacctgtggggcatccagagagtggagaacgccagattcctgagccccgaggagaacgtgtgcaacgagatgctggtgaagagccagttcgtggcctgcatggccacctgccacagcctgaccaagatcgagggcgtgctgagcggcgaccccctggacctgaagatgttcgaggccatcggctggatcctggaggaggccaccgaggaggagaccgccctgcacaacagaatcatgcccaccgtggtgagaccccccaagcagctgctgcccgagagcacccccgccggcaaccaggagatggagctgttcgagctgcccgccacctacgagatcggcatcgtgagacagttccccttcagcagcgccctgcagagaatgagcgtggtggccagagtgctgggcgacagaaagatggacgcctacatgaagggcgcccccgaggccatcgccggcctgtgcaagcccgagaccgtgcccgtggacttccagaacgtgctggaggacttcaccaagcagggcttcagagtgatcgccctggcccacagaaagctggagagcaagctgacctggcacaaggtgcagaacatcagcagagacgccatcgagaacaacatggacttcatgggcctgatcatcatgcagaacaagctgaagcaggagacccccgccgtgctggaggacctgcacaaggccaacatcagaaccgtgatggtgaccggcgacagcatgctgaccgccgtgagcgtggccagagactgcggcatgatcctgccccaggacaaggtgatcatcgccgaggccctgccccccaaggacggcaaggtggccaagatcaactggcactacgccgacagcctgacccagtgcagccaccccagcgccatcgaccccgaggccatccccgtgaagctggtgcacgacagcctggaggacctgcagatgaccagataccacttcgccatgaacggcaagagcttcagcgtgatcctggagcacttccaggacctggtgcccaagctgatgctgcacggcaccgtgttcgccagaatggcccccgaccagaagacccagctgatcgaggccctgcagaacgtggactacttcgtgggcatgtgcggcgacggcgccaacgactgcggcgccctgaagagagcccacggcggcatcagcctgagcgagctggaggccagcgtggccagccccttcaccagcaagacccccagcatcagctgcgtgcccaacctgatcagagagggcagagccgccctgatcaccagcttctgcgtgttcaagttcatggccctgtacagcatcatccagtacttcagcgtgaccctgctgtacagcatcctgagcaacctgggcgacttccagttcctgttcatcgacctggccatcatcctggtggtggtgttcaccatgagcctgaaccccgcctggaaggagctggtggcccagagaccccccagcggcctgatcagcggcgccctgctgttcagcgtgctgagccagatcatcatctgcatcggcttccagagcctgggcttcttctgggtgaagcagcagccctggtacgaggtgtggcaccccaagagcgacgcctgcaacaccaccggcagcggcttctggaacagcagccacgtggacaacgagaccgagctggacgagcacaacatccagaactacgagaacaccaccgtgttcttcatcagcagcttccagtacctgatcgtggccatcgccttcagcaagggcaagcccttcagacagccctgctacaagaactacttcttcgtgttcagcgtgatcttcctgtacatcttcatcctgttcatcatgctgtaccccgtggccagcgtggaccaggtgctgcagatcgtgtgcgtgccctaccagtggagagtgaccatgctgatcatcgtgctggtgaacgccttcgtgagcatcaccgtggaggagagcgtggacagatggggcaagtgctgcctgccctgggccctgggctgcagaaagaagacccccaaggccaagtacatgtacctggcccaggagctgctggtggaccccgagtggccccccaagccccagaccaccaccgaggccaaggccctggtgaaggagaacggcagctgccagatcatcaccatcacctag

SEQ ID NO: 16501 - DNA, 2151 bp, Artificial Sequence
  Description of Artificial Sequence: Synthetic coding sequence
atggtggccacccacagcaccgtgagagtgagcgtgtgcagagtgaacgaggagatcgaggagatcttcagcaccgacctggtgcccggcgacgtgatggtgatccccctgaacggcaccatcatgccctgcgacgccgtgctgatcaacggcacctgcatcgtgaacgagagcatgctgaccggcgagagcgtgcccgtgaccaagaccaacctgcccaaccccagcgtggacgtgaagggcatcggcgacgagctgtacaaccccgagacccacaagagacacaccctgttctgcggcaccaccgtgatccagaccagattctacaccggcgagctggtgaaggccatcgtggtgagaaccggcttcagcaccagcaagggccagctggtgagaagcatcctgtaccccaagcccaccgacttcaagctgtacagagacgcctacctgttcctgctgtgcctggtggccgtggccggcatcggcttcatctacaccatcatcaacagcatcctgaacgaggtgcaggtgggcgtgatcatcatcgagagcctggacatcatcaccatcaccgtgccccccgccctgcccgccgccatgaccgccggcatcgtgtacgcccagagaagactgaagaagatcggcatcttctgcatcagcccccagagaatcaacatctgcggccagctgaacctggtgtgcttcgacaagaccggcaccctgaccgaggacggcctggacctgtggggcatccagagagtggagaacgccagattcctgagccccgaggagaacgtgtgcaacgagatgctggtgaagagccagttcgtggcctgcatggccacctgccacagcctgaccaagatcgagggcgtgctgagcggcgaccccctggacctgaagatgttcgaggccatcggctggatcctggaggaggccaccgaggaggagaccgccctgcacaacagaatcatgcccaccgtggtgagaccccccaagcagctgctgcccgagagcacccccgccggcaaccaggagatggagctgttcgagctgcccgccacctacgagatcggcatcgtgagacagttccccttcagcagcgccctgcagagaatgagcgtggtggccagagtgctgggcgacagaaagatggacgcctacatgaagggcgcccccgaggccatcgccggcctgtgcaagcccgagaccgtgcccgtggacttccagaacgtgctggaggacttcaccaagcagggcttcagagtgatcgccctggcccacagaaagctggagagcaagctgacctggcacaaggtgcagaacatcagcagagacgccatcgagaacaacatggacttcatgggcctgatcatcatgcagaacaagctgaagcaggagacccccgccgtgctggaggacctgcacaaggccaacatcagaaccgtgatggtgaccggcgacagcatgctgaccgccgtgagcgtggccagagactgcggcatgatcctgccccaggacaaggtgatcatcgccgaggccctgccccccaaggacggcaaggtggccaagatcaactggcactacgccgacagcctgacccagtgcagccaccccagcgccatcgaccccgaggccatccccgtgaagctggtgcacgacagcctggaggacctgcagatgaccagataccacttcgccatgaacggcaagagcttcagcgtgatcctggagcacttccaggacctggtgcccaagctgatgctgcacggcaccgtgttcgccagaatggcccccgaccagaagacccagctgatcgaggccctgcagaacgtggactacttcgtgggcatgtgcggcgacggcgccaacgactgcggcgccctgaagagagcccacggcggcatcagcctgagcgagctggaggccagcgtggccagccccttcaccagcaagacccccagcatcagctgcgtgcccaacctgatcagagagggcagagccgccctgatcaccagcttctgcgagctggccctgttcagcatcgtgacctacagcctggaccacttcatcatcagcatcctgatcagcaacatgctggtgctgttcttcagcgacttccacaactgcgccttctacagcctggtgtag

SEQ ID NO: 16502 - DNA, 3681 bp, Artificial Sequence; identical to SEQ ID NO: 16500
  Description of Artificial Sequence: Synthetic coding sequence

SEQ ID NO: 16503 - DNA, 144 bp, Artificial Sequence
  Description of Artificial Sequence: Synthetic coding sequence
atggacagagaggagagaaagaccatcaaccagggccaggaggacgagatggagatctacggctacaacctgagcagatggaagctggccatcgtgagcctgggcgtgatctgcagcggcggcttcctgctgctgctgctgtag

SEQ ID NO: 16504 - DNA, 312 bp, Artificial Sequence
  Description of Artificial Sequence: Synthetic coding sequence
atggacagagaggagagaaagaccatcaaccagggccaggaggacgagatggagatctacggctacaacctgagcagatggaagctggccatcgtgagcctgggcgtgatctgcagcggcggcttcctgctgctgctgctgtactggatgcccgagtggagagtgaaggccacctgcgtgagagccgccatcaaggactgcgaggtggtgctgctgagaaccaccgacgagttcaagatgtggttctgcgccaagatcagagtgctgagcctggagacctaccccgtgagcagccccaagagcatgagctag

SEQ ID NO: 16505 - DNA, 1731 bp, Artificial Sequence
  Description of Artificial Sequence: Synthetic coding sequence
atgggccacttcgagaagggccagcacgccctgctgaacgagggcgaggagaacgagatggagatcttcggctacagaacccagggctgcagaaagagcctgtgcctggccggcagcatcttcagcttcggcatcctgcccctggtgttctactggagacccgcctggcacgtgtgggcccactgcgtgccctgcagcctgcaggaggccgacaccgtgctgctgagaaccaccgacgagttccagatctacagctggaagaaggtgatctggatctacctgagcgccctgaacagcgccttcggcctgacccccgaccaccccctgatgaccgacgaggagtacatcatcaacagagccatcagaaagcccgacctgaaggtgagatgcatcaaggtgcagaagatcagatacgtgtggaactacctggagggccagttccagaagatcggcagcctggaggactggctgagcagcgccaagatccaccagaagttcggcagcggcctgaccagagaggagcaggagatcagaagactgatctgcggccccaacaccatcgacgtggaggtgacccccatctggaagctgctgatcaaggaggtgctgaaccccttctacatcttccagctgttcagcgtgtgcctgtggttcagcgaggactacaaggagtacgccttcgccatcatcatcatgagcatcatcagcatcagcctgaccgtgtacgacctgagagagcagagcgtgaagctgcaccacctggtggagagccacaacagcatcaccgtgagcgtgtgcggcagaaaggccggcgtgcaggagctggagagcagagtgctggtgcccggcgacctgctgatcctgaccggcaacaaggtgctgatgccctgcgacgccgtgctgatcgagggcagctgcgtggtggacgagggcatgctgaccggcgagagcatccccgtgaccaagacccccctgcccaagatggacagcagcgtgccctggaagacccagagcgaggccgactacaagagacacgtgctgttctgcggcaccgaggtgatccaggccaaggccgcctgcagcggcaccgtgagagccgtggtgctgcagaccggcttcaacaccgccaagggcgacctggtgagaagcatcctgtaccccaagcccgtgaacttccagctgtacagagacgccatcagattcctgctgtgcctggtgggcaccgccaccatcggcatgatctacaccctgtgcgtgtacgtgctgagcggcgagccccccgaggaggtggtgagaaaggccctggacgtgatcaccatcgccgtgccccccgccctgcccgccgccctgaccaccggcatcatctacgcccagagaagactgaagaagagaggcatcttctgcatcagcccccagagaatcaacgtgtgcggccagctgaacctggtgtgcttcgacaagaccggcaccctgaccagagacggcctggacctgtggggcgtggtgagctgcgacagaaacggcttccaggaggtgcacagcttcgccagcggccaggccctgccctggggccccctgtgcgccgccatggccagctgccacagcctgatcctgctggacggcaccatccagggcgaccccctggacctgaagatgttcgaggccaccacctgggtgagcctgtgcagcagcgagaacctgagaagcttcttcaacgccagagccacctag

SEQ ID NO: 16506 - DNA, 3591 bp, Artificial Sequence
  Description of Artificial Sequence: Synthetic coding sequence
atgggccacttcgagaagggccagcacgccctgctgaacgagggcgaggagaacgagatggagatcttcggctacagaacccagggctgcagaaagagcctgtgcctggccggcagcatcttcagcttcggcatcctgcccctggtgttctactggagacccgcctggcacgtgtgggcccactgcgtgccctgcagcctgcaggaggccgacaccgtgctgctgagaaccaccgacgagttccagatctacagctggaagaaggtgatctggatctacctgagcgccctgaacagcgccttcggcctgacccccgaccaccccctgatgaccgacgaggagtacatcatcaacagagccatcagaaagcccgacctgaaggtgagatgcatcaaggtgcagaagatcagatacgtgtggaactacctggagggccagttccagaagatcggcagcctggaggactggctgagcagcgccaagatccaccagaagttcggcagcggcctgaccagagaggagcaggagatcagaagactgatctgcggccccaacaccatcgacgtggaggtgacccccatctggaagctgctgatcaaggaggtgctgaaccccttctacatcttccagctgttcagcgtgtgcctgtggttcagcgaggactacaaggagtacgccttcgccatcatcatcatgagcatcatcagcatcagcctgaccgtgtacgacctgagagagcagagcgtgaagctgcaccacctggtggagagccacaacagcatcaccgtgagcgtgtgcggcagaaaggccggcgtgcaggagctggagagcagagtgctggtgcccggcgacctgctgatcctgaccggcaacaaggtgctgatgccctgcgacgccgtgctgatcgagggcagctgcgtggtggacgagggcatgctgaccggcgagagcatccccgtgaccaagacccccctgcccaagatggacagcagcgtgccctggaagacccagagcgaggccgactacaagagacacgtgctgttctgcggcaccgaggtgatccaggccaaggccgcctgcagcggcaccgtgagagccgtggtgctgcagaccggcttcaacaccgccaagggcgacctggtgagaagcatcctgtaccccaagcccgtgaacttccagctgtacagagacgccatcagattcctgctgtgcctggtgggcaccgccaccatcggcatgatctacaccctgtgcgtgtacgtgctgagcggcgagccccccgaggaggtggtgagaaaggccctggacgtgatcaccatcgccgtgccccccgccctgcccgccgccctgaccaccggcatcatctacgcccagagaagactgaagaagagaggcatcttctgcatcagcccccagagaatcaacgtgtgcggccagctgaacctggtgtgcttcgacaagaccggcaccctgaccagagacggcctggacctgtggggcgtggtgagctgcgacagaaacggcttccaggaggtgcacagcttcgccagcggccaggccctgccctggggccccctgtgcgccgccatggccagctgccacagcctgatcctgctggacggcaccatccagggcgaccccctggacctgaagatgttcgaggccaccacctgggagatggccttcagcggcgacgacttccacatcaagggcgtgcccgcccacgccatggtggtgaagccctgcagaaccgccagccaggtgcccgtggagggcatcgccatcctgcaccagttccccttcagcagcgccctgcagagaatgaccgtgatcgtgcaggagatgggcggcgacagactggccttcatgaagggcgcccccgagagagtggccagcttctgccagcccgagaccgtgcccaccagcttcgtgagcgagctgcagatctacaccacccagggcttcagagtgatcgccctggcctacaagaagctggagaacgaccaccacgccaccaccctgaccagagagaccgtggagagcgacctgatcttcctgggcctgctgatcctggagaacagactgaaggaggagaccaagcccgtgctggaggagctgatcagcgccagaatcagaaccgtgatgatcaccggcgacaacctgcagaccgccatcaccgtggccagaaagagcggcatggtgagcgagagccagaaggtgatcctgatcgaggccaacgagaccaccggcagcagcagcgccagcatcagctggaccctggtggaggagaagaagcacatcatgtacggcaaccaggacaactacatcaacatcagagacgaggtgagcgacaagggcagagagggcagctaccacttcgccctgaccggcaagagcttccacgtgatcagccagcacttcagcagcctgctgcccaagatcctgatcaacggcaccatcttcgccagaatgagccccggccagaagagcagcctggtggaggagttccagaagctggactacttcgtgggcatgtgcggcgacggcgccaacgactgcggcgccctgaagatggcccacgtgggcatcagcctgagcgagcaggaggccagcgtggccagccccttcaccagcaagacccccaacatcgagtgcgtgccccacctgatcaaggagggcagagccgccctggtgaccagcttctgcatgttcaagtacatggccctgtacagcatgatccagtacgtgggcgtgctgctgctgtactgggagaccaacagcctgagcaactaccagttcctgttccaggacctggccatcaccaccctgatcggcgtgaccatgaacctgaacggcgcctaccccaagctggtgcccttcagacccgccggcagactgatcagcccccccctgctgctgagcgtgatcttcaacatcctgctgagcctggccatgcacatcgccggcttcatcctggtgcagagacagccctggtacagcgtggagatccacagcgcctgcaccgtgcagaacgagagcatcagcgagctgaccatgagccccaccgcccccgagaagatggagagcaacagcaccttcaccagcttcgagaacaccaccgtgtggttcctgggcaccatcaactgcatcaccgtggccctggtgttcagcaagggcaagcccttcagacagcccacctacaccaactacatcttcgtgctggtgctgatcatccagctgggcgtgtgcctgttcatcctgttcgccgacatccccgagctgtacagaagactggacctgctgtgcacccccgtgctgtggagagccagcatcgtgatcatgctgagcctgaacttcatcgtgagcctggtggccgaggaggccgtgatcgagaacagagccctgtggatgatgatcaagagatgcttcggctaccagagcaagagccagtacagaatctggcagagagacctggccaacgaccccagctggccccccctgaaccagaccagccacagcgacatgcccgagtgcggcagaggcgtgagctacagcaaccccgtgttcgagagcaacgaggagcagctgtag

SEQ ID NO: 16507 - DNA, 639 bp, Artificial Sequence
  Description of Artificial Sequence: Synthetic coding sequence
atgcacatcgccggcttcatcctggtgcagagacagccctggtacagcgtggagatccacagcgcctgcaccgtgcagaacgagagcatcagcgagctgaccatgagccccaccgcccccgagaagatggagagcaacagcaccttcaccagcttcgagaacaccaccgtgtggttcctgggcaccatcaactgcatcaccgtggccctggtgttcagcaagggcaagcccttcagacagcccacctacaccaactacatcttcgtgctggtgctgatcatccagctgggcgtgtgcctgttcatcctgttcgccgacatccccgagctgtacagaagactggacctgctgtgcacccccgtgctgtggagagccagcatcgtgatcatgctgagcctgaacttcatcgtgagcctggtggccgaggaggccgtgatcgagaacagagccctgtggatgatgatcaagagatgcttcggctaccagagcaagagccagtacagaatctggcagagagacctggccaacgaccccagctggccccccctgaaccagaccagccacagcgacatgcccgagtgcggcagaggcgtgagctacagcaaccccgtgttcgagagcaacgaggagcagctgtag

SEQ ID NO: 16508 - DNA, 3657 bp, Artificial Sequence
  Description of Artificial Sequence: Synthetic coding sequence
atggaggagaacagcaagaaggaccacagagccctgctgaaccagggcgaggaggacgagctggaggtgttcggctacagagaccacaacgtgagaaaggccttctgcctggtggccagcgtgctgacctgcggcggcctgctgctggtgttctactggagaccccagtggagagtgtgggccaactgcatcccctgccccctgcaggaggccgacaccgtgctgctgagaaccaccgacgagttccagagatacatgagaaagaaggtgttctgcctgtacctgagcaccctgaagttccccgtgagcaagaagtgggaggagagcctggtggccgacagacacagcgtgatcaaccaggccctgatcaagcccgagctgaagctgagatgcatggaggtgcagaagatcagatacgtgtggaacgacctggagaagagattccagaaggtgggcctgctggaggacagcaacagctgcagcgacatccaccagaccttcggcctgggcctgaccagcgaggagcaggaggtgagaagactggtgtgcggccccaacgccatcgaggtggagatccagcccatctggaagctgctggtgaagcaggtgctgaaccccttctacgtgttccaggccttcaccctgaccctgtggctgagccagggctacatcgagtacagcgtggccatcatcatcctgaccgtgatcagcatcgtgctgagcgtgtacgacctgagacagcagagcgtgaagctgcacaacctggtggaggaccacaacaaggtgcaggtgaccatcatcgtgaaggacaagggcctggaggagctggagagcagactgctggtgcccggcgacatcctgatcctgcccggcaagttcagcctgccctgcgacgccgtgctgatcgacggcagctgcgtggtgaacgagggcatgctgaccggcgagagcatccccgtgaccaagacccccctgccccagatggagaacaccatgccctggaagtgccacagcctggaggactacagaaagcacgtgctgttctgcggcaccgaggtgatccaggtgaagcccagcggccagggccccgtgagagccgtggtgctgcagaccggctacaacaccgccaagggcgacctggtgagaagcatcctgtaccccagacccctgaacttcaagctgtacagcgacgccttcaagttcatcgtgttcctggcctgcctgggcgtgatgggcttcttctacgccctgggcgtgtacatgtaccacggcgtgccccccaaggacaccgtgaccatggccctgatcctgctgaccgtgaccgtgccccccgtgctgcccgccgccctgaccatcggcaacgtgtacgcccagaagagactgaagaagaagaagatcttctgcatcagcccccagagaatcaacatgtgcggccagatcaacctggtgtgcttcgacaagaccggcaccctgaccgaggacggcctggacctgtggggcaccgtgcccaccgccgacaactgcttccaggaggcccacagcttcgccagcggccaggccgtgccctggagccccctgtgcgccgccatggccagctgccacagcctgatcctgctgaacggcaccatccagggcgaccccctggacctgaagatgttcgagggcaccgcctggaagatggaggactgcatcgtggacagctgcaagttcggcaccagcgtgagcaacatcatcaagcccggccccaaggccagcaagagccccgtggaggccatcatcaccctgtgccagttccccttcagcagcagcctgcagagaatgagcgtgatcgcccagctggccggcgagaaccacttccacgtgtacatgaagggcgcccccgagatggtggccagattctgcagaagcgagaccgtgcccaagaacttcccccaggagctgagaagctacaccgtgcagggcttcagagtgatcgccctggcccacaagaccctgaagatgggcaacctgagcgaggtggagcacctggccagagagaaggtggagagcgagctgaccttcctgggcctgctgatcatggagaacagactgaagaaggagaccaagctggtgctgaaggagctgagcgaggccagaatcagaaccgtgatgatcaccggcgacaacctgcagaccgccatcaccgtggccaagaacagcgagatgatcccccccggcagccaggtgatcatcgtggaggccgacgagcccgaggagttcgtgcccgccagcgtgacctggcagctggtggagaaccaggagaccggccccggcaagaaggagatctacatgcacaccggcaacagcagcacccccagaggcgagggcggcagctgctaccacttcgccatgagcggcaagagctaccaggtgatcttccagcacttcaacagcctgctgcccaagatcctggtgaacggcaccgtgttcgccagaatgagccccggccagaagagcagcctgatcgaggagttccagaagctgaactactacgtgggcatgtgcggcgacggcgccaacgactgcggcgccctgaaggccgcccacgccggcatcagcctgagcgagcaggaggccagcgtggccagccccttcaccagcaagaccaccaacatccagtgcgtgccccacctgatcagagagggcagagccgccctggtgagcagcttcggcgtgttcaagtacctgaccatgtacggcatcatccagttcatcagcgccctgctgctgtactggcagctgcagctgttcggcaactaccagtacctgatgcaggacgtggccatcaccctgatggtgtgcctgaccatgagcagcacccacgcctaccccaagctggccccctacagacccgccggccagctgctgagcccccccctgctgctgagcatcttcctgaacagctgcttcagctgcatcgtgcagatcagcgccttcctgtacgtgaagcagcagccctggtactgcgaggtgtaccagtacagcgagtgcttcctggccaaccagagcaacttcagcaccaacgtgagcctggagagaaactggaccggcaacgccaccctgatccccggcagcatcctgagcttcgagaccaccaccctgtggcccatcaccaccatcaactacatcaccgtggccttcatcttcagcaagggcaagcccttcagaaagcccatctacaccaactacatcttcagcttcctgctgctggccgccctgggcctgaccatcttcatcctgttcagcgacttccaggtgatctacagaggcatggagctgatccccaccatcaccagctggagagtgctgatcctggtggtggccctgacccagttctgcgtggccttcttcgtggaggacagcatcctgcagaaccacgagctgtggctgctgatcaagagagagttcggcttctacagcaagagccagtacagaacctggcagaagaagctggccgaggacagcacctggccccccatcaacagaaccgactacagcggcgacggcaagaacggcttctacatcaacggcggctacgagagccacgagcagatccccaagagaaagctgaagctgggcggccagcccaccgagcagcacttctgggccagactgtag

SEQ ID NO: 16509 - DNA, 3450 bp, Artificial Sequence
  Description of Artificial Sequence: Synthetic coding sequence
atgcccaccatgagaagaaccgtgagcgagatcagaagcagagccgagggctacgagaagaccgacgacgtgagcgagaagaccagcctggccgaccaggaggaggtgagaaccatcttcatcaaccagccccagctgaccaagttctgcaacaaccacgtgagcaccgccaagtacaacatcatcaccttcctgcccagattcctgtacagccagttcagaagagccgccaacagcttcttcctgttcatcgccctgctgcagcagatccccgacgtgagccccaccggcagatacaccaccctggtgcccctgctgttcatcctggccgtggccgccatcaaggagatcatcgaggacatcaagagacacaaggccgacaacgccgtgaacaagaagcagacccaggtgctgagaaacggcgcctgggagatcgtgcactgggagaaggtgaacgtgggcgacatcgtgatcatcaagggcaaggagtacatccccgccgacaccgtgctgctgagcagcagcgagccccaggccatgtgctacatcgagaccagcaacctggacggcgagaccaacctgaagatcagacagggcctgcccgccaccagcgacatcaaggacgtggacagcctgatgagaatcagcggcagaatcgagtgcgagagccccaacagacacctgtacgacttcgtgggcaacatcagactggacggccacggcaccgtgcccctgggcgccgaccagatcctgctgagaggcgcccagctgagaaacacccagtgggtgcacggcatcgtggtgtacaccggccacgacaccaagctgatgcagaacagcaccagcccccccctgaagctgagcaacgtggagagaatcaccaacgtgcagatcctgatcctgttctgcatcctgatcgccatgagcctggtgtgcagcgtgggcagcgccatctggaacagaagacacagcggcaaggactggtacctgaacctgaactacggcggcgccagcaacttcggcctgaacttcctgaccttcatcatcctgttcaacaacctgatccccatcagcctgctggtgaccctggaggtggtgaagttcacccaggcctacttcatcaactgggacctggacatgcactacgagcccaccgacaccgccgccatggccagaaccagcaacctgaacgaggagctgggccaggtgaagtacatcttcagcgacaagaccggcaccctgacctgcaacgtgatgcagttcaagaagtgcaccatcgccggcgtggcctacggccagaacagccagttcggcgacgagaagaccttcagcgacagcagcctgctggagaacctgcagaacaaccaccccaccgcccccatcatctgcgagttcctgaccatgatggccgtgtgccacaccgccgtgcccgagagagagggcgacaagatcatctaccaggccgccagccccgacgagggcgccctggtgagagccgccaagcagctgaacttcgtgttcaccggcagaacccccgacagcgtgatcatcgacagcctgggccaggaggagagatacgagctgctgaacgtgctggagttcaccagcgccagaaagagaatgagcgtgatcgtgagaacccccagcggcaagctgagactgtactgcaagggcgccgacaccgtgatctacgacagactggccgagaccagcaagtacaaggagatcaccctgaagcacctggagcagttcgccaccgagggcctgagaaccctgtgcttcgccgtggccgagatcagcgagagcgacttccaggagtggagagccgtgtaccagagagccagcaccagcgtgcagaacagactgctgaagctggaggagagctacgagctgatcgagaagaacctgcagctgctgggcgccaccgccatcgaggacaagctgcaggaccaggtgcccgagaccatcgagaccctgatgaaggccgacatcaagatctggatcctgaccggcgacaagcaggagaccgccatcaacatcggccacagctgcaagctgctgaagaagaacatgggcatgatcgtgatcaacgagggcagcctggacggcaccagagagaccctgagcagacactgcaccaccctgggcgacgccctgagaaaggagaacgacttcgccctgatcatcgacggcaagaccctgaagtacgccctgaccttcggcgtgagacagtacttcctggacctggccctgagctgcaaggccgtgatctgctgcagagtgagccccctgcagaagagcgaggtggtggagatggtgaagaagcaggtgaaggtggtgaccctggccatcggcgacggcgccaacgacgtgagcatgatccagaccgcccacgtgggcgtgggcatcagcggcaacgagggcctgcaggccgccaacagcagcgactacagcatcgcccagttcaagtacctgaagaacctgctgatgatccacggcgcctggaactacaacagagtgagcaagtgcatcctgtactgcttctacaagaacatcgtgctgtacatcatcgagatctggttcgccttcgtgaacggcttcagcggccagatcctgttcgagagatggtgcatcggcctgtacaacgtgatgttcaccgccatgccccccctgaccctgggcatcttcgagagaagctgcagaaaggagaacatgctgaagtaccccgagctgtacaagaccagccagaacgccctggacttcaacaccaaggtgttctgggtgcactgcctgaacggcctgttccacagcgtgatcctgttctggttccccctgaaggccctgcagtacggcaccgccttcggcaacggcaagaccagcgactacctgctgctgggcaacttcgtgtacaccttcgtggtgatcaccgtgtgcctgaaggccggcctggagaccagctactggacctggttcagccacatcgccatctggggcagcatcgccctgtgggtggtgttcttcggcatctacagcagcctgtggcccgccatccccatggcccccgacatgagcggcgaggccgccatgctgttcagcagcggcgtgttctggatgggcctgctgttcatccccgtggccagcctgctgctggacgtggtgtacaaggtgatcaagagaaccgccttcaagaccctggtggacgaggtgcaggagctggaggccaagagccaggaccccggcgccgtggtgctgggcaagagcctgaccgagagagcccagctgctgaagaacgtgttcaagaagaaccacgtgaacctgtacagaagcgagagcctgcagcagaacctgctgcacggctacgccttcagccaggacgagaacggcatcgtgagccagagcgaggtgatcagagcctacgacaccaccaagcagagacccgacgagtggtag

SEQ ID NO: 16510 - DNA, 3495 bp, Artificial Sequence
  Description of Artificial Sequence: Synthetic coding sequence
atgcccaccatgagaagaaccgtgagcgagatcagaagcagagccgagggctacgagaagaccgacgacgtgagcgagaagaccagcctggccgaccaggaggaggtgagaaccatcttcatcaaccagccccagctgaccaagttctgcaacaaccacgtgagcaccgccaagtacaacatcatcaccttcctgcccagattcctgtacagccagttcagaagagccgccaacagcttcttcctgttcatcgccctgctgcagcagatccccgacgtgagccccaccggcagatacaccaccctggtgcccctgctgttcatcctggccgtggccgccatcaaggagatcatcgaggacatcaagagacacaaggccgacaacgccgtgaacaagaagcagacccaggtgctgagaaacggcgcctgggagatcgtgcactgggagaaggtggccgtgggcgagatcgtgaaggtgaccaacggcgagcacctgcccgccgacctgatcagcctgagcagcagcgagccccaggccatgtgctacatcgagaccagcaacctggacggcgagaccaacctgaagatcagacagggcctgcccgccaccagcgacatcaaggacgtggacagcctgatgagaatcagcggcagaatcgagtgcgagagccccaacagacacctgtacgacttcgtgggcaacatcagactggacggccacggcaccgtgcccctgggcgccgaccagatcctgctgagaggcgcccagctgagaaacacccagtgggtgcacggcatcgtggtgtacaccggccacgacaccaagctgatgcagaacagcaccagcccccccctgaagctgagcaacgtggagagaatcaccaacgtgcagatcctgatcctgttctgcatcctgatcgccatgagcctggtgtgcagcgtgggcagcgccatctggaacagaagacacagcggcaaggactggtacctgaacctgaactacggcggcgccagcaacttcggcctgaacttcctgaccttcatcatcctgttcaacaacctgatccccatcagcctgctggtgaccctggaggtggtgaagttcacccaggcctacttcatcaactgggacctggacatgcactacgagcccaccgacaccgccgccatggccagaaccagcaacctgaacgaggagctgggccaggtgaagtacatcttcagcgacaagaccggcaccctgacctgcaacgtgatgcagttcaagaagtgcaccatcgccggcgtggcctacggccacgtgcccgagcccgaggactacggctgcagccccgacgagtggcagaacagccagttcggcgacgagaagaccttcagcgacagcagcctgctggagaacctgcagaacaaccaccccaccgcccccatcatctgcgagttcctgaccatgatggccgtgtgccacaccgccgtgcccgagagagagggcgacaagatcatctaccaggccgccagccccgacgagggcgccctggtgagagccgccaagcagctgaacttcgtgttcaccggcagaacccccgacagcgtgatcatcgacagcctgggccaggaggagagatacgagctgctgaacgtgctggagttcaccagcgccagaaagagaatgagcgtgatcgtgagaacccccagcggcaagctgagactgtactgcaagggcgccgacaccgtgatctacgacagactggccgagaccagcaagtacaaggagatcaccctgaagcacctggagcagttcgccaccgagggcctgagaaccctgtgcttcgccgtggccgagatcagcgagagcgacttccaggagtggagagccgtgtaccagagagccagcaccagcgtgcagaacagactgctgaagctggaggagagctacgagctgatcgagaagaacctgcagctgctgggcgccaccgccatcgaggacaagctgcaggaccaggtgcccgagaccatcgagaccctgatgaaggccgacatcaagatctggatcctgaccggcgacaagcaggagaccgccatcaacatcggccacagctgcaagctgctgaagaagaacatgggcatgatcgtgatcaacgagggcagcctggacggcaccagagagaccctgagcagacactgcaccaccctgggcgacgccctgagaaaggagaacgacttcgccctgatcatcgacggcaagaccctgaagtacgccctgaccttcggcgtgagacagtacttcctggacctggccctgagctgcaaggccgtgatctgctgcagagtgagccccctgcagaagagcgaggtggtggagatggtgaagaagcaggtgaaggtggtgaccctggccatcggcgacggcgccaacgacgtgagcatgatccagaccgcccacgtgggcgtgggcatcagcggcaacgagggcctgcaggccgccaacagcagcgactacagcatcgcccagttcaagtacctgaagaacctgctgatgatccacggcgcctggaactacaacagagtgagcaagtgcatcctgtactgcttctacaagaacatcgtgctgtacatcatcgagatctggttcgccttcgtgaacggcttcagcggccagatcctgttcgagagatggtgcatcggcctgtacaacgtgatgttcaccgccatgccccccctgaccctgggcatcttcgagagaagctgcagaaaggagaacatgctgaagtaccccgagctgtacaagaccagccagaacgccctggacttcaacaccaaggtgttctgggtgcactgcctgaacggcctgttccacagcgtgatcctgttctggttccccctgaaggccctgcagtacggcaccgccttcggcaacggcaagaccagcgactacctgctgctgggcaacttcgtgtacaccttcgtggtgatcaccgtgtgcctgaaggccggcctggagaccagctactggacctggttcagccacatcgccatctggggcagcatcgccctgtgggtggtgttcttcggcatctacagcagcctgtggcccgccatccccatggcccccgacatgagcggcgaggccgccatgctgttcagcagcggcgtgttctggatgggcctgctgttcatccccgtggccagcctgctgctggacgtggtgtacaaggtgatcaagagaaccgccttcaagaccctggtggacgaggtgcaggagctggaggccaagagccaggaccccggcgccgtggtgctgggcaagagcctgaccgagagagcccagctgctgaagaacgtgttcaagaagaaccacgtgaacctgtacagaagcgagagcctgcagcagaacctgctgcacggctacgccttcagccaggacgagaacggcatcgtgagccagagcgaggtgatcagagcctacgacaccaccaagcagagacccgacgagtggtag

SEQ ID NO: 16511 - DNA, 3579 bp, Artificial Sequence
  Description of Artificial Sequence: Synthetic coding sequence
atgttctgcagcgagaagaagctgagagaggtggagagaatcgtgaaggccaacgacagagagtacaacgagaagttccagtacgccgacaacagaatccacaccagcaagtacaacatcctgaccttcctgcccatcaacctgttcgagcagttccagagagtggccaacgcctacttcctgtgcctgctgatcctgcagctgatccccgagatcagcagcctgacctggttcaccaccatcgtgcccctggtgctggtgatcaccatgaccgccgtgaaggacgccaccgacgactacttcagacacaagagcgacaaccaggtgaacaacagacagagcgaggtgctgatcaacagcaagctgcagaacgagaagtggatgaacgtgaaggtgggcgacatcatcaagctggagaacaaccagttcgtggccgccgacctgctgctgctgagcagcagcgagccccacggcctgtgctacgtggagaccgccgagctggacggcgagaccaacctgaaggtgagacacgccctgagcgtgaccagcgagctgggcgccgacatcagcagactggccggcttcgacggcatcgtggtgtgcgaggtgcccaacaacaagctggacaagttcatgggcatcctgagctggaaggacagcaagcacagcctgaacaacgagaagatcatcctgagaggctgcatcctgagaaacaccagctggtgcttcggcatggtgatcttcgccggccccgacaccaagctgatgcagaacagcggcaagaccaagttcaagagaaccagcatcgacagactgatgaacaccctggtgctgtggatcttcggcttcctgatctgcctgggcatcatcctggccatcggcaacagcatctgggagagccagaccggcgaccagttcagaaccttcctgttctggaacgagggcgagaagagcagcgtgttcagcggcttcctgaccttctggagctacatcatcatcctgaacaccgtggtgcccatcagcctgtacgtgagcgtggaggtgatcagactgggccacagctacttcatcaactgggacagaaagatgtactacagcagaaaggccatccccgccgtggccagaaccaccaccctgaacgaggagctgggccagatcgagtacatcttcagcgacaagaccggcaccctgacccagaacatcatgaccttcaagagatgcagcatcaacggcagaatctacggcgaggtgcacgacgacctggaccagaagaccgagatcacccaggagaaggagcccgtggacttcagcgtgaagagccaggccgacagagagttccagttcttcgaccaccacctgatggagagcatcaagatgggcgaccccaaggtgcacgagttcctgagactgctggccctgtgccacaccgtgatgagcgaggagaacagcgccggcgagctgatctaccaggtgcagagccccgacgagggcgccctggtgaccgccgccagaaacttcggcttcatcttcaagagcagaacccccgagaccatcaccatcgaggagctgggcaccctggtgacctaccagctgctggccttcctggacttcaacaacaccagaaagagaatgagcgtgatcgtgagaaaccccgagggccagatcaagctgtacagcaagggcgccgacaccatcctgttcgagaagctgcaccccagcaacgaggtgctgctgagcctgaccagcgaccacctgagcgagttcgccggcgagggcctgagaaccctggccatcgcctacagagacctggacgacaagtacttcaaggagtggcacaagatgctggaggacgccaacgccgccaccgaggagagagacgagagaatcgccggcctgtacgaggagatcgagagagacctgatgctgctgggcgccaccgccgtggaggacaagctgcaggagggcgtgatcgagaccgtgaccagcctgagcctggccaacatcaagatctgggtgctgaccggcgacaagcaggagaccgccatcaacatcggctacgcctgcaacatgctgaccgacgacatgaacgacgtgttcgtgatcgccggcaacaacgccgtggaggtgagagaggagctgagaaaggccaagcagaacctgttcggccagaacagaaacttcagcaacggccacgtggtgtgcgagaagaagcagcagctggagctggacagcatcgtggaggagaccatcaccggcgactacgccctgatcatcaacggccacagcctggcccacgccctggagagcgacgtgaagaacgacctgctggagctggcctgcatgtgcaagaccgtgatctgctgcagagtgacccccctgcagaaggcccaggtggtggagctggtgaagaagtacagaaacgccgtgaccctggccatcggcgacggcgccaacgacgtgagcatgatcaagagcgcccacatcggcgtgggcatcagcggccaggagggcctgcaggccgtgctggccagcgactacagcttcgcccagttcagatacctgcagagactgctgctggtgcacggcagatggagctacttcagaatgtgcaagttcctgtgctacttcttctacaagaacttcgccttcaccctggtgcacttctggttcggcttcttctgcggcttcagcgcccagaccgtgtacgaccagtggttcatcaccctgttcaacatcgtgtacaccagcctgcccgtgctggccatgggcatcttcgaccaggacgtgagcgaccagaacagcgtggactgcccccagctgtacaagcccggccagctgaacctgctgttcaacaagagaaagttcttcatctgcgtgctgcacggcatctacaccagcctggtgctgttcttcatcccctacggcgccttctacaacgtggccggcgaggacggccagcacatcgccgactaccagagcttcgccgtgaccatggccaccagcctggtgatcgtggtgagcgtgcagatcgccctggacaccagctactggaccttcatcaaccacgtgttcatctggggcagcatcgccatctacttcagcatcctgttcaccatgcacagcaacggcatcttcggcatcttccccaaccagttccccttcgtgggcaacgccagacacagcctgacccagaagtgcatctggctggtgatcctgctgaccaccgtggccagcgtgatgcccgtggtggccttcagattcctgaaggtggacctgtaccccaccctgagcgaccagatcagaagatggcagaaggcccagaagaaggccagaccccccagcagcagaagacccagaaccagaagaagcagcagcagaagaagcggctacgccttcgcccaccaggagggctacggcgagctgatcaccagcggcaagaacatgagagccaagaaccccccccccaccagcggcctggagaagacccactacaacagcaccagctggatcgagaacctgtgcaagaagaccaccgacaccgtgagcagcttcagccaggacaagaccgtgaagctgtag

SEQ ID NO: 16512 - DNA, 162 bp, Artificial Sequence
  Description of Artificial Sequence: Synthetic coding sequence
atgttctgcagcgagaagaagctgagagaggtggagagaatcgtgaaggccaacgacagagagtacaacgagaagttccagtacgccgacaacagaatccacaccagcaagtacaacatcctgaccttcctgcccatcaacctgttcgagcagttccagtag

SEQ ID NO: 16513 - DNA, 3579 bp, Artificial Sequence; identical to SEQ ID NO: 16511
  Description of Artificial Sequence: Synthetic coding sequence

SEQ ID NO: 16514 - DNA, 2736 bp, Artificial Sequence
  Description of Artificial Sequence: Synthetic coding sequence
atggacagcagacccagagccggctgctgcgagtggctgagatgctgcggcggcggcgaggccagacccagaaccgtgtggctgggccaccccgagaagagagaccagagataccccagaaacgtgatcaacaaccagaagtacaacttcttcaccttcctgcccggcgtgctgttcaaccagttcaagtacttcttcaacctgtacttcctgctgctggcctgcagccagttcgtgcccgagatgagactgggcgccctgtacacctactgggtgcccctgggcttcgtgctggccgtgaccgtgatcagagaggccgtggaggagatcagatgctacgtgagagacaaggaggtgaacagccaggtgtacagcagactgaccgccagaggcaccgtggtgggcgtggtgctgtacaccggcagagagctgagaagcgtgatgaacaccagcaaccccagaagcaagatcggcctgttcgacctggaggtgaactgcctgaccaagatcctgttcggcgccctggtggtggtgagcctggtgatggtggccctgcagcacttcgccggcagatggtacctgcagatcatcagattcctgctgctgttcagcaacatcatccccatcagcctgagagtgaacctggacatgggcaagatcgtgtacagctgggtgatcagaagagacagcaagatccccggcaccgtggtgagaagcagcaccatccccgagcagctgggcagaatcagctacctgctgaccgacaagaccggcaccctgacccagaacgagatgatcttcaagagactgcacctgggcaccgtggcctacggcctggacagcatggacgaggtgcagagccacatcttcagcatctacacccagcagagccaggacccccccgcccagaagggccccaccctgaccaccaaggtgagaagaaccatgagcagcagagtgcacgaggccgtgaaggccatcgccctgtgccacaacgtgacccccgtgtacgagagcaacggcgtgaccgaccaggccgaggccgagaagcagtacgaggacagctgcagagtgtaccaggccagcagccccgacgaggtggccctggtgcagtggaccgagagcgtgggcctgaccctggtgggcagagaccagagcagcatgcagctgagaacccccggcgaccagatcctgaacttcaccatcctgcagatcttccccttcacctacgagagcaagagaatgggcatcatcgtgagagacgagagcaccggcgagatcaccttctacatgaagggcgccgacgtggtgatggccggcatcgtgcagtacaacgactggctggaggaggagtgcggcaacatggccagagagggcctgagagtgctggtggtggccaagaagagcctggccgaggagcagtaccaggacttcgaggccagatacgtgcaggccaagctgagcgtgcacgacagaagcctgaaggtggccaccgtgatcgagagcctggagatggagatggagctgctgtgcctgaccggcgtggaggaccagctgcaggccgacgtgagacccaccctggagaccctgagaaacgccggcatcaaggtgtggatgctgaccggcgacaagctggagaccgccacctgcaccgccaagaacgcccacctggtgaccagaaaccaggacatccacgtgttcagactggtgaccaacagaggcgaggcccacctggagctgaacgccttcagaagaaagcacgactgcgccctggtgatcagcggcgacagcctggaggtgtgcctgaagtactacgagtacgagttcatggagctggcctgccagtgccccgccgtggtgtgctgcagatgcgcccccacccagaaggcccagatcgtgagactgctgcaggagagaaccggcaagctgacctgcgccgtgggcgacggcggcaacgacgtgagcatgatccaggagagcgactgcggcgtgggcgtggagggcaaggagggcaagcaggccagcctggccgccgacttcagcatcacccagttcaagcacctgggcagactgctgatggtgcacggcagaaacagctacaagagaagcgccgccctgagccagttcgtgatccacagaagcctgtgcatcagcaccatgcaggccgtgttcagcagcgtgttctacttcgccagcgtgcccctgtaccagggcttcctgatcatcggctacagcaccatctacaccatgttccccgtgttcagcctggtgctggacaaggacgtgaagagcgaggtggccatgctgtaccccgagctgtacaaggacctgctgaagggcagacccctgagctacaagaccttcctgatctgggtgctgatcagcatctaccagggcagcaccatcatgtacggcgccctgctgctgttcgagagcgagttcgtgcacatcgtggccatcagcttcaccagcctgatcctgaccgagctgctgatggtggccctgaccatccagacctggcactggctgatgaccgtggccgagctgctgagcctggcctgctacatcgccagcctggtgttcctgcacgagttcatcgacgtgtacttcatcgccaccctgagcttcctgtggaaggtgagcgtgatcaccctggtgagctgcctgcccctgtacgtgctgaagtacctgagaagaagattcagcccccccagctacagcaagctgaccagctag

SEQ ID NO: 16515 - DNA, 3144 bp, Artificial Sequence
  Description of Artificial Sequence: Synthetic coding sequence
atgaccgacaacatccccctgcagcccgtgagacagaagaagagaatggacagcagacccagagccggctgctgcgagtggctgagatgctgcggcggcggcgaggccagacccagaaccgtgtggctgggccaccccgagaagagagaccagagataccccagaaacgtgatcaacaaccagaagtacaacttcttcaccttcctgcccggcgtgctgttcaaccagttcaagtacttcttcaacctgtacttcctgctgctggcctgcagccagttcgtgcccgagatgagactgggcgccctgtacacctactgggtgcccctgggcttcgtgctggccgtgaccgtgatcagagaggccgtggaggagatcagatgctacgtgagagacaaggaggtgaacagccaggtgtacagcagactgaccgccagaggcaccgtgaaggtgaagagcagcaacatccaggtgggcgacctgatcatcgtggagaagaaccagagagtgcccgccgacatgatcttcctgagaaccagcgagaagaacggcagctgcttcctgagaaccgaccagctggacggcgagaccgactggaagctgagactgcccgtggcctgcacccagagactgcccaccgccgccgacctgctgcagatcagaagctacgtgtacgccgaggagcccaacatcgacatccacaacttcgtgggcaccttcaccagagaggacagcgacccccccatcagcgagagcctgagcatcgagaacaccctgtgggccggcaccgtggtggccagcggcaccgtggtgggcgtggtgctgtacaccggcagagagctgagaagcgtgatgaacaccagcaaccccagaagcaagatcggcctgttcgacctggaggtgaactgcctgaccaagatcctgttcggcgccctggtggtggtgagcctggtgatggtggccctgcagcacttcgccggcagatggtacctgcagatcatcagattcctgctgctgttcagcaacatcatccccatcagcctgagagtgaacctggacatgggcaagatcgtgtacagctgggtgatcagaagagacagcaagatccccggcaccgtggtgagaagcagcaccatccccgagcagctgggcagaatcagctacctgctgaccgacaagaccggcaccctgacccagaacgagatgatcttcaagagactgcacctgggcaccgtggcctacggcctggacagcatggacgaggtgcagagccacatcttcagcatctacacccagcagagccaggacccccccgcccagaagggccccaccctgaccaccaaggtgagaagaaccatgagcagcagagtgcacgaggccgtgaaggccatcgccctgtgccacaacgtgacccccgtgtacgagagcaacggcgtgaccgaccaggccgaggccgagaagcagtacgaggacagctgcagagtgtaccaggccagcagccccgacgaggtggccctggtgcagtggaccgagagcgtgggcctgaccctggtgggcagagaccagagcagcatgcagctgagaacccccggcgaccagatcctgaacttcaccatcctgcagatcttccccttcacctacgagagcaagagaatgggcatcatcgtgagagacgagagcaccggcgagatcaccttctacatgaagggcgccgacgtggtgatggccggcatcgtgcagtacaacgactggctggaggaggagtgcggcaacatggccagagagggcctgagagtgctggtggtggccaagaagagcctggccgaggagcagtaccaggacttcgaggccagatacgtgcaggccaagctgagcgtgcacgacagaagcctgaaggtggccaccgtgatcgagagcctggagatggagatggagctgctgtgcctgaccggcgtggaggaccagctgcaggccgacgtgagacccaccctggagaccctgagaaacgccggcatcaaggtgtggatgctgaccggcgacaagctggagaccgccacctgcaccgccaagaacgcccacctggtgaccagaaaccaggacatccacgtgttcagactggtgaccaacagaggcgaggcccacctggagctgaacgccttcagaagaaagcacgactgcgccctggtgatcagcggcgacagcctggaggtgtgcctgaagtactacgagtacgagttcatggagctggcctgccagtgccccgccgtggtgtgctgcagatgcgcccccacccagaaggcccagatcgtgagactgctgcaggagagaaccggcaagctgacctgcgccgtgggcgacggcggcaacgacgtgagcatgatccaggagagcgactgcggcgtgggcgtggagggcaaggagggcaagcaggccagcctggccgccgacttcagcatcacccagttcaagcacctgggcagactgctgatggtgcacggcagaaacagctacaagagaagcgccgccctgagccagttcgtgatccacagaagcctgtgcatcagcaccatgcaggccgtgttcagcagcgtgttctacttcgccagcgtgcccctgtaccagggcttcctgatcatcggctacagcaccatctacaccatgttccccgtgttcagcctggtgctggacaaggacgtgaagagcgaggtggccatgctgtaccccgagctgtacaaggacctgctgaagggcagacccctgagctacaagaccttcctgatctgggtgctgatcagcatctaccagggcagcaccatcatgtacggcgccctgctgctgttcgagagcgagttcgtgcacatcgtggccatcagcttcaccagcctgatcctgaccgagctgctgatggtggccctgaccatccagacctggcactggctgatgaccgtggccgagctgctgagcctggcctgctacatcgccagcctggtgttcctgcacgagttcatcgacgtgtacttcatcgccaccctgagcttcctgtggaaggtgagcgtgatcaccctggtgagctgcctgcccctgtacgtgctgaagtacctgagaagaagattcagcccccccagctacagcaagctgaccagctag

SEQ ID NO: 16516 - DNA, 2781 bp, Artificial Sequence
  Description of Artificial Sequence: Synthetic coding sequence
atgaccgacaacatccccctgcagcccgtgagacagaagaagagaatggacagcagacccagagccggctgctgcgagtggctgagatgctgcggcggcggcgaggccagacccagaaccgtgtggctgggccaccccgagaagagagaccagagataccccagaaacgtgatcaacaaccagaagtacaacttcttcaccttcctgcccggcgtgctgttcaaccagttcaagtacttcttcaacctgtacttcctgctgctggcctgcagccagttcgtgcccgagatgagactgggcgccctgtacacctactgggtgcccctgggcttcgtgctggccgtgaccgtgatcagagaggccgtggaggagatcagatgctacgtgagagacaaggaggtgaacagccaggtgtacagcagactgaccgccagaggcaccgtggtgggcgtggtgctgtacaccggcagagagctgagaagcgtgatgaacaccagcaaccccagaagcaagatcggcctgttcgacctggaggtgaactgcctgaccaagatcctgttcggcgccctggtggtggtgagcctggtgatggtggccctgcagcacttcgccggcagatggtacctgcagatcatcagattcctgctgctgttcagcaacatcatccccatcagcctgagagtgaacctggacatgggcaagatcgtgtacagctgggtgatcagaagagacagcaagatccccggcaccgtggtgagaagcagcaccatccccgagcagctgggcagaatcagctacctgctgaccgacaagaccggcaccctgacccagaacgagatgatcttcaagagactgcacctgggcaccgtggcctacggcctggacagcatggacgaggtgcagagccacatcttcagcatctacacccagcagagccaggacccccccgcccagaagggccccaccctgaccaccaaggtgagaagaaccatgagcagcagagtgcacgaggccgtgaaggccatcgccctgtgccacaacgtgacccccgtgtacgagagcaacggcgtgaccgaccaggccgaggccgagaagcagtacgaggacagctgcagagtgtaccaggccagcagccccgacgaggtggccctggtgcagtggaccgagagcgtgggcctgaccctggtgggcagagaccagagcagcatgcagctgagaacccccggcgaccagatcctgaacttcaccatcctgcagatcttccccttcacctacgagagcaagagaatgggcatcatcgtgagagacgagagcaccggcgagatcaccttctacatgaagggcgccgacgtggtgatggccggcatcgtgcagtacaacgactggctggaggaggagtgcggcaacatggccagagagggcctgagagtgctggtggtggccaagaagagcctggccgaggagcagtaccaggacttcgaggccagatacgtgcaggccaagctgagcgtgcacgacagaagcctgaaggtggccaccgtgatcgagagcctggagatggagatggagctgctgtgcctgaccggcgtggaggaccagctgcaggccgacgtgagacccaccctggagaccctgagaaacgccggcatcaaggtgtggatgctgaccggcgacaagctggagaccgccacctgcaccgccaagaacgcccacctggtgaccagaaaccaggacatccacgtgttcagactggtgaccaacagaggcgaggcccacctggagctgaacgccttcagaagaaagcacgactgcgccctggtgatcagcggcgacagcctggaggtgtgcctgaagtactacgagtacgagttcatggagctggcctgccagtgccccgccgtggtgtgctgcagatgcgcccccacccagaaggcccagatcgtgagactgctgcaggagagaaccggcaagctgacctgcgccgtgggcgacggcggcaacgacgtgagcatgatccaggagagcgactgcggcgtgggcgtggagggcaaggagggcaagcaggccagcctggccgccgacttcagcatcacccagttcaagcacctgggcagactgctgatggtgcacggcagaaacagctacaagagaagcgccgccctgagccagttcgtgatccacagaagcctgtgcatcagcaccatgcaggccgtgttcagcagcgtgttctacttcgccagcgtgcccctgtaccagggcttcctgatcatcggctacagcaccatctacaccatgttccccgtgttcagcctggtgctggacaaggacgtgaagagcgaggtggccatgctgtaccccgagctgtacaaggacctgctgaagggcagacccctgagctacaagaccttcctgatctgggtgctgatcagcatctaccagggcagcaccatcatgtacggcgccctgctgctgttcgagagcgagttcgtgcacatcgtggccatcagcttcaccagcctgatcctgaccgagctgctgatggtggccctgaccatccagacctggcactggctgatgaccgtggccgagctgctgagcctggcctgctacatcgccagcctggtgttcctgcacgagttcatcgacgtgtacttcatcgccaccctgagcttcctgtggaaggtgagcgtgatcaccctggtgagctgcctgcccctgtacgtgctgaagtacctgagaagaagattcagcccccccagctacagcaagctgaccagctag

SEQ ID NO: 16517 - DNA, 4386 bp, Artificial Sequence
  Description of Artificial Sequence: Synthetic coding sequence
atggccctgagcgtggacagcagctggcacagatggcagtggagagtgagagacggcttcccccactgccccagcgagaccacccccctgctgagccccgagaagggcagacagagctacaacctgacccagcagagagtggtgttccccaacaacagcatcttccaccaggactgggaggaggtgagcagaagataccccggcaacagaacctgcaccaccaagtacaccctgttcaccttcctgcccagaaacctgttcgagcagttccacagatgggccaacctgtacttcctgttcctggtgatcctgaactggatgcccagcatggaggtgttccacagagagatcaccatgctgcccctggccatcgtgctgttcgtgatcatgatcaaggacggcatggaggacttcaagagacacagattcgacaaggccatcaactgcagcaacatcagaatctacgagagaaaggagcagacctacgtgcagaagtgctggaaggacgtgagagtgggcgacttcatccagatgaagtgcaacgagatcgtgcccgccgacatcctgctgctgttcagcagcgaccccaacggcatctgccacctggagaccgccagcctggacggcgagaccaacctgaagcagagatgcgtggtgaagggcttcagccagcaggaggtgcagttcgagcccgagctgttccacaacaccatcgtgtgcgagaagcccaacaaccacctgaacaagttcaagggctacatggagcaccccgaccagaccagaaccggcttcggctgcgagagcctgctgctgagaggctgcaccatcagaaacaccgagatggccgtgggcatcgtgatctacgccggccacgagaccaaggccatgctgaacaacagcggccccagatacaagagaagcaagatcgagagaagaatgaacatcgacatcttcttctgcatcggcatcctgatcctgatgtgcctgatcggcgccgtgggccacagcatctggaacggcaccttcgaggagcacccccccttcgacgtgcccgacgccaacggcagcttcctgcccagcgccctgggcggcttctacatgttcctgaccatgatcatcctgctgcaggtgctgatccccatcagcctgtacgtgagcatcgagctggtgaagctgggccaggtgttcttcctgagcaacgacctggacctgtacgacgaggagaccgacctgagcatccagtgcagagccctgaacatcgccgaggacctgggccagatccagtacatcttcagcgacaagaccggcaccctgaccgagaacaagatggtgttcagaagatgcaccatcatgggcagcgagtacagccaccaggagaacgccaagagactggagacccccaaggagctggacagcgacggcgaggagtggacccagtaccagtgcctgagcttcagcgccagatgggcccaggaccccgccaccatgagaagccagaagggcgcccagcccctgagaagaagccagagcgccagagtgcccatccagggccactacagacagagaagcatgggccacagagagagcagccagccccccgtggccttcagcagcagcatcgagaaggacgtgacccccgacaagaacctgctgaccaaggtgagagacgccgccctgtggctggagaccctgagcgacagcagacccgccaaggccagcctgagcaccaccagcagcatcgccgacttcttcctggccctgaccatctgcaacagcgtgatggtgagcaccaccaccgagcccagacagagagtgaccatcaagcccagcagcaaggccctgggcaccagcctggagaagatccagcagctgttccagaagctgaagctgctgagcctgagccagagcttcagcagcaccgcccccagcgacaccgacctgggcgagagcctgggcgccaacgtggccaccaccgacagcgacgagagagacgacgccagcgtgtgcagcggcggcgacagcaccgacgacggcggctacagaagcagcatgtgggaccagggcgacatcctggagagcggcagcggcaccagcctggaggaggccctggaggcccccgccaccgacctggccagacccgagttctgctacgaggccgagagccccgacgaggccgccctggtgcacgccgcccacgcctacagcttcaccctggtgagcagaacccccgagcaggtgaccgtgagactgccccagggcacctgcctgaccttcagcctgctgtgcaccctgggcttcgacagcgtgagaaagagaatgagcgtggtggtgagacaccccctgaccggcgagatcgtggtgtacaccaagggcgccgacagcgtgatcatggacctgctggaggaccccgcctgcgtgcccgacatcaacatggagaagaagctgagaaagatcagagccagaacccagaagcacctggacctgtacgccagagacggcctgagaaccctgtgcatcgccaagaaggtggtgagcgaggaggacttcagaagatgggccagcttcagaagagaggccgaggccagcctggacaacagagacgagctgctgatggagaccgcccagcacctggagaaccagctgaccctgctgggcgccaccggcatcgaggacagactgcaggagggcgtgcccgacaccatcgccaccctgagagaggccggcatccagctgtgggtgctgaccggcgacaagcaggagaccgccgtgaacatcgcccacagctgcagactgctgaaccagaccgacaccgtgtacaccatcaacaccgagaaccaggagacctgcgagagcatcctgaactgcgccctggaggagctgaagcagttcagagagctgcagaagcccgacagaaagctgttcggcttcagactgcccagcaagacccccagcatcaccagcgaggccgtggtgcccgaggccggcctggtgatcgacggcaagaccctgaacgccatcttccagggcaagctggagaagaagttcctggagctgacccagtactgcagaagcgtgctgtgctgcagaagcacccccctgcagaagagcatgatcgtgaagctggtgagagacaagctgagagtgatgaccctgagcatcggcgacggcgccaacgacgtgagcatgatccaggccgccgacatcggcatcggcatcagcggccaggagggcatgcaggccgtgatgagcagcgacttcgccatcaccagattcaagcacctgaagaagctgctgctggtgcacggccactggtgctacagcagactggccagaatggtggtgtactacctgtacaagaacgtgtgctacgtgaacctgctgttctggtaccagttcttctgcggcttcagcagcagcaccatgatcgactactggcagatgatcttcttcaacctgttcttcaccagcctgccccccctggtgttcggcgtgctggacaaggacatcagcgccgagaccctgctggccctgcccgagctgtacaagagcggccagaacagcgagtgctacaacctgagcaccttctggatcagcatggtggacgccttctaccagagcctgatctgcttcttcatcccctacctggcctacaagggcagcgacatcgacgtgttcaccttcggcacccccatcaacaccatcagcctgaccaccatcctgctgcaccaggccatggagatgaagacctggaccatcttccacggcgtggtgctgctgggcagcttcctgatgtacttcctggtgagcctgctgtacaacgccacctgcgtgatctgcaacagccccaccaacccctactgggtgatggagggccagctgagcaaccccaccttctacctggtgtgcttcctgacccccgtggtggccctgctgcccagatacttcttcctgagcctgcagggcacctgcggcaagagcctgatcagcaaggcccagaagatcgacaagctgccccccgacaagagaaacctggagatccagagctggagaagcagacagagacccgcccccgtgcccgaggtggccagacccacccaccaccccgtgagcagcatcaccggccaggacttcagcgccagcacccccaagagcagcaacccccccaagagaaagcacgtggaggagagcgtgctgcacgagcagagatgcggcaccgagtgcatgagagacgacagctgcagcggcgacagcagcgcccagctgagcagcggcgagcacctgctgggccccaacagaatcatggcctacagcagaggccagaccgacatgtgcagatgcagcaagagaagcagccacagaagaagccagagcagcctgaccatctag

SEQ ID NO: 16518 - DNA, 4281 bp, Artificial Sequence
  Description of Artificial Sequence: Synthetic coding sequence
atgaccgaggccctgcagtgggccagataccactggagaagactgatcagaggcgccaccagagacgacgacagcggcccctacaactacagcagcctgctggcctgcggcagaaagagcagccagacccccaagctgagcggcagacacagaatcgtggtgccccacatccagcccttcaaggacgagtacgagaagttcagcggcgcctacgtgaacaacagaatcagaaccaccaagtacaccctgctgaacttcgtgcccagaaacctgttcgagcagttccacagagccgccaacctgtacttcctgttcctggtggtgctgaactgggtgcccctggtggaggccttccagaaggagatcaccatgctgcccctggtggtggtgctgaccatcatcgccatcaaggacggcctggaggactacagaaagtacaagatcgacaagcagatcaacaacctgatcaccaaggtgtacagcagaaaggagaagaagtacatcgacagatgctggaaggacgtgaccgtgggcgacttcatcagactgagctgcaacgaggtgatccccgccgacatggtgctgctgttcagcaccgaccccgacggcatctgccacatcgagaccagcggcctggacggcgagagcaacctgaagcagagacaggtggtgagaggctacgccgagcaggacagcgaggtggaccccgagaagttcagcagcagaatcgagtgcgagagccccaacaacgacctgagcagattcagaggcttcctggagcacagcaacaaggagagagtgggcctgagcaaggagaacctgctgctgagaggctgcaccatcagaaacaccgaggccgtggtgggcatcgtggtgtacgccggccacgagaccaaggccatgctgaacaacagcggccccagatacaagagaagcaagctggagagaagagccaacaccgacgtgctgtggtgcgtgatgctgctggtgatcatgtgcctgaccggcgccgtgggccacggcatctggctgagcagatacgagaagatgcacttcttcaacgtgcccgagcccgacggccacatcatcagccccctgctggccggcttctacatgttctggaccatgatcatcctgctgcaggtgctgatccccatcagcctgtacgtgagcatcgagatcgtgaagctgggccagatctacttcatccagagcgacgtggacttctacaacgagaagatggacagcatcgtgcagtgcagagccctgaacatcgccgaggacctgggccagatccagtacctgttcagcgacaagaccggcaccctgaccgagaacaagatggtgttcagaagatgcagcgtggccggcttcgactactgccacgaggagaacgccagaagactggagagctaccaggaggccgtgagcgaggacgaggacttcatcgacaccgtgagcggcagcctgagcaacatggccaagcccagagcccccagctgcagaaccgtgcacaacggccccctgggcaacaagcccagcaaccacctggccggcagcagcttcaccctgggcagcggcgagggcgccagcgaggtgccccacagcagacaggccgccttcagcagccccatcgagaccgacgtggtgcccgacaccagactgctggacaagttcagccagatcacccccagactgttcatgcccctggacgagaccatccagaacccccccatggagaccctgtacatcatcgacttcttcatcgccctggccatctgcaacaccgtggtggtgagcgcccccaaccagcccagacagaagatcagacaccccagcctgggcggcctgcccatcaagagcctggaggagatcaagagcctgttccagagatggagcgtgagaagaagcagcagccccagcctgaacagcggcaaggagcccagcagcggcgtgcccaacgccttcgtgagcagactgcccctgttcagcagaatgaagcccgccagccccgtggaggaggaggtgagccaggtgtgcgagagcccccagtgcagcagcagcagcgcctgctgcaccgagaccgagaagcagcacggcgacgccggcctgctgaacggcaaggccgagagcctgcccggccagcccctggcctgcaacctgtgctacgaggccgagagccccgacgaggccgccctggtgtacgccgccagagcctaccagtgcaccctgagaagcagaacccccgagcaggtgatggtggacttcgccgccctgggccccctgaccttccagctgctgcacatcctgcccttcgacagcgtgagaaagagaatgagcgtggtggtgagacaccccctgagcaaccaggtggtggtgtacaccaagggcgccgacagcgtgatcatggagctgctgagcgtggccagccccgacggcgccagcctggagaagcagcagatgatcgtgagagagaagacccagaagcacctggacgactacgccaagcagggcctgagaaccctgtgcatcgccaagaaggtgatgagcgacaccgagtacgccgagtggctgagaaaccacttcctggccgagaccagcatcgacaacagagaggagctgctgctggagagcgccatgagactggagaacaagctgaccctgctgggcgccaccggcatcgaggacagactgcaggagggcgtgcccgagagcatcgaggccctgcacaaggccggcatcaagatctggatgctgaccggcgacaagcaggagaccgccgtgaacatcgcctacgcctgcaagctgctggagcccgacgacaagctgttcatcctgaacacccagagcaaggacgcctgcggcatgctgatgagcaccatcctgaaggagctgcagaagaagacccaggccctgcccgagcaggtgagcctgagcgaggacctgctgcagccccccgtgcccagagacagcggcctgagagccggcctgatcatcaccggcaagaccctggagttcgccctgcaggagagcctgcagaagcagttcctggagctgaccagctggtgccaggccgtggtgtgctgcagagccacccccctgcagaagagcgaggtggtgaagctggtgagaagccacctgcaggtgatgaccctggccatcggcgacggcgccaacgacgtgagcatgatccaggtggccgacatcggcatcggcgtgagcggccaggagggcatgcaggccgtgatggccagcgacttcgccgtgagccagttcaagcacctgagcaagctgctgctggtgcacggccactggtgctacaccagactgagcaacatgatcctgtacttcttctacaagaacgtggcctacgtgaacctgctgttctggtaccagttcttctgcggcttcagcggcaccagcatgaccgactactgggtgctgatcttcttcaacctgctgttcaccagcgccccccccgtgatctacggcgtgctggagaaggacgtgagcgccgagaccctgatgcagctgcccgagctgtacagaagcggccagaagagcgaggcctacctgccccacaccttctggatcaccctgctggacgccttctaccagagcctggtgtgcttcttcgtgccctacttcacctaccagggcagcgacaccgacatcttcgccttcggcaaccccctgaacaccgccgccctgttcatcgtgctgctgcacctggtgatcgagagcaagagcctgacctggatccacctgctggtgatcatcggcagcatcctgagctacttcctgttcgccatcgtgttcggcgccatgtgcgtgacctgcaacccccccagcaacccctactggatcatgcaggagcacatgctggaccccgtgttctacctggtgtgcatcctgaccaccagcatcgccctgctgcccagattcgtgtacagagtgctgcagggcagcctgttccccagccccatcctgagagccaagcacttcgacagactgacccccgaggagagaaccaaggccctgaagaagtggagaggcgccggcaagatgaaccaggtgaccagcaagtacgccaaccagagcgccggcaagagcggcagaagacccatgcccggccccagcgccgtgttcgccatgaagagcgccagcagctgcgccatcgagcagggcaacctgagcctgtgcgagaccgccctggaccagggctacagcgagaccaaggccttcgagatggccggccccagcaagggcaaggagagctag

SEQ ID NO: 16519 - DNA, 1608 bp, Artificial Sequence
  Description of Artificial Sequence: Synthetic coding sequence
atgaccgaggccctgcagtgggccagataccactggagaagactgatcagaggcgccaccagagacgacgacagcggcccctacaactacagcagcctgctggcctgcggcagaaagagcagccagacccccaagctgagcggcagacacagaatcgtggtgccccacatccagcccttcaaggacgagtacgagaagttcagcggcgcctacgtgaacaacagaatcagaaccaccaagtacaccctgctgaacttcgtgcccagaaacctgttcgagcagttccacagagccgccaacctgtacttcctgttcctggtggtgctgaactgggtgcccctggtggaggccttccagaaggagatcaccatgctgcccctggtggtggtgctgaccatcatcgccatcaaggacggcctggaggactacagaaagtacaagatcgacaagcagatcaacaacctgatcaccaaggtgtacagcagaaaggagaagaagtacatcgacagatgctggaaggacgtgaccgtgggcgacttcatcagactgagctgcaacgaggtgatccccgccgacatggtgctgctgttcagcaccgaccccgacggcatctgccacatcgagaccagcggcctggacggcgagagcaacctgaagcagagacaggtggtgagaggctacgccgagcaggacagcgaggtggaccccgagaagttcagcagcagaatcgagtgcgagagccccaacaacgacctgagcagattcagaggcttcctggagcacagcaacaaggagagagtgggcctgagcaaggagaacctgctgctgagaggctgcaccatcagaaacaccgaggccgtggtgggcatcgtggtgtacgccggccacgagaccaaggccatgctgaacaacagcggccccagatacaagagaagcaagctggagagaagagccaacaccgacgtgctgtggtgcgtgatgctgctggtgatcatgtgcctgaccggcgccgtgggccacggcatctggctgagcagatacgagaagatgcacttcttcaacgtgcccgagcccgacggccacatcatcagccccctgctggccggcttctacatgttctggaccatgatcatcctgctgcagctgggccagatctacttcatccagagcgacgtggacttctacaacgagaagatggacagcatcgtgcagtgcagagccctgaacatcgccgaggacctgggccagatccagtacctgttcagcgacaagaccggcaccctgaccgagaacaagatggtgttcagaagatgcagcgtggccggcttcgactactgccacgaggagaacgccagaagactggagagctaccaggaggccgtgagcgaggacgaggacttcatcgacaccgtgagcggcagcctgagcaacatggccaagcccagagcccccagctgcagaaccgtgcacaacggccccctgggcaacaagcccagcaaccacctggccggcagcagcttcaccctgggcagcggcgagggcgccagcgaggtgccccacagcagacaggccgccttcagcagccccatcgtgagcatgaacgcctag

SEQ ID NO: 16520 - DNA, 3399 bp, Artificial Sequence
  Description of Artificial Sequence: Synthetic coding sequence
atgcagatggtgcccagcctgccccccgccagcgagtgcgccggcgaggagaagagagtgggcaccagaaccgtgttcgtgggcaaccaccccgtgagcgagaccgaggcctacatcgcccagagattctgcgacaacagaatcgtgagcagcaagtacaccctgtggaacttcctgcccaagaacctgttcgagcagttcagaagaatcgccaacttctacttcctgatcatcttcctggtgcaggtgaccgtggacacccccaccagccccgtgaccagcggcctgcccctgttcttcgtgatcaccgtgaccgccatcaagcagggctacgaggactgcctgagacacagagccgacaacgaggtgaacaagagcaccgtgtacatcatcgagaacgccaagagagtgagaaaggagagcgagaagatcaaggtgggcgacgtggtggaggtgcaggccgacgagaccttcccctgcgacctgatcctgctgagcagctgcaccaccgacggcacctgctacgtgaccaccgccagcctggacggcgagagcaactgcaagacccactacgccgtgagagacaccatcgccctgtgcaccgccgagagcatcgacaccctgagagccgccatcgagtgcgagcagccccagcccgacctgtacaagttcgtgggcagaatcaacatctacagcaacagcctggaggccgtggccagaagcctgggccccgagaacctgctgctgaagggcgccaccctgaagaacaccgagaagatctacggcgtggccgtgtacaccggcatggagaccaagatggccctgaactaccagggcaagagccagaagagaagcgccgtggagaagagcatcaacgccttcctgatcgtgtacctgttcatcctgctgaccaaggccgccgtgtgcaccaccctgaagtacgtgtggcagagcaccccctacaacgacgagccctggtacaaccagaagacccagaaggagagagagaccctgaaggtgctgaagatgttcaccgacttcctgagcttcatggtgctgttcaacttcatcatccccgtgagcatgtacgtgaccgtggagatgcagaagttcctgggcagcttcttcatcagctgggacaaggacttctacgacgaggagatcaacgagggcgccctggtgaacaccagcgacctgaacgaggagctgggccaggtggactacgtgttcaccgacaagaccggcaccctgaccgagaacagcatggagttcatcgagtgctgcatcgacggccacaagtacaagggcgtgacccaggaggtggacggcctgagccagaccgacggcaccctgacctacttcgacaaggtggacaagaacagagaggagctgttcctgagagccctgtgcctgtgccacaccgtggagatcaagaccaacgacgccgtggacggcgccaccgagagcgccgagctgacctacatcagcagcagccccgacgagatcgccctggtgaagggcgccaagagatacggcttcaccttcctgggcaacagaaacggctacatgagagtggagaaccagagaaaggagatcgaggagtacgagctgctgcacaccctgaacttcgacgccgtgagaagaagaatgagcgtgatcgtgaagacccaggagggcgacatcctgctgttctgcaagggcgccgacagcgccgtgttccccagagtgcagaaccacgagatcgagctgaccaaggtgcacgtggagagaaacgccatggacggctacagaaccctgtgcgtggccttcaaggagatcgcccccgacgactacgagagaatcaacagacagctgatcgaggccaagatggccctgcaggacagagaggagaagatggagaaggtgttcgacgacatcgagaccaacatgaacctgatcggcgccaccgccgtggaggacaagctgcaggaccaggccgccgagaccatcgaggccctgcacgccgccggcctgaaggtgtgggtgctgaccggcgacaagatggagaccgccaagagcacctgctacgcctgcagactgttccagaccaacaccgagctgctggagctgaccaccaagaccatcgaggagagcgagagaaaggaggacagactgcacgagctgctgatcgagtacagaaagaagctgctgcacgagttccccaagagcaccagaagcttcaagaaggcctggaccgagcaccaggagtacggcctgatcatcgacggcagcaccctgagcctgatcctgaacagcagccaggacagcagcagcaacaactacaagagcatcttcctgcagatctgcatgaagtgcaccgccgtgctgtgctgcagaatggcccccctgcagaaggcccagatcgtgagaatggtgaagaacctgaagggcagccccatcaccctgagcatcggcgacggcgccaacgacgtgagcatgatcctggagagccacgtgggcatcggcatcaagggcaaggagggcagacaggccgccagaaacagcgactacagcgtgcccaagttcaagcacctgaagaagctgctgctggcccacggccacctgtactacgtgagaatcgcccacctggtgcagtacttcttctacaagaacctgtgcttcatcctgccccagttcctgtaccagttcttctgcggcttcagccagcagcccctgtacgacgccgcctacctgaccatgtacaacatctgcttcaccagcctgcccatcctggcctacagcctgctggagcagcacatcaacatcgacaccctgaccagcgaccccagactgtacatgaagatcagcggcaacgccatgctgcagctgggccccttcctgtactggaccttcctggccgccttcgagggcaccgtgttcttcttcggcacctacttcctgttccagaccgccagcctggaggagaacggcaaggtgtacggcaactggaccttcggcaccatcgtgttcaccgtgctggtgttcaccgtgaccctgaagctggccctggacaccagattctggacctggatcaaccacttcgtgatctggggcagcctggccttctacgtgttcttcagcttcttctggggcggcatcatctggcccttcctgaagcagcagagaatgtacttcgtgttcgcccagatgctgagcagcgtgagcacctggctggccatcatcctgctgatcttcatcagcctgttccccgagatcctgctgatcgtgctgaagaacgtgagaagaagaagcgccagaagaaacctgagctgcagaagagccagcgacagcctgagcgccagacccagcgtgagacccctgctgctgagaaccttcagcgacgagagcaacgtgctgtag

SEQ ID NO: 16521 - DNA, 3327 bp, Artificial Sequence
  Description of Artificial Sequence: Synthetic coding sequence
atgcagatggtgcccagcctgccccccgccagcgagtgcgccggcgaggagaagagagtgggcaccagaaccgtgttcgtgggcaaccaccccgtgagcgagaccgaggcctacatcgcccagagattctgcgacaacagaatcgtgagcagcaagtacaccctgtggaacttcctgcccaagaacctgttcgagcagttcagaagaatcgccaacttctacttcctgatcatcttcctggtgcaggtgaccgtggacacccccaccagccccgtgaccagcggcctgcccctgttcttcgtgatcaccgtgaccgccatcaagcagggctacgaggactgcctgagacacagagccgacaacgaggtgaacaagagcaccgtgtacatcatcgagaacgccaagagagtgagaaaggagagcgagaagatcaaggtgggcgacgtggtggaggtgcaggccgacgagaccttcccctgcgacctgatcctgctgagcagctgcaccaccgacggcacctgctacgtgaccaccgccagcctggacggcgagagcaactgcaagacccactacgccgtgagagacaccatcgccctgtgcaccgccgagagcatcgacaccctgagagccgccatcgagtgcgagcagccccagcccgacctgtacaagttcgtgggcagaatcaacatctacagcaacagcctggaggccgtggccagaagcctgggccccgagaacctgctgctgaagggcgccaccctgaagaacaccgagaagatctacggcgtggccgtgtacaccggcatggagaccaagatggccctgaactaccagggcaagagccagaagagaagcgccgtggagaagagcatcaacgccttcctgatcgtgtacctgttcatcctgctgaccaaggccgccgtgtgcaccaccctgaagtacgtgtggcagagcaccccctacaacgacgagccctggtacaaccagaagacccagaaggagagagagaccctgaaggtgctgaagatgttcaccgacttcctgagcttcatggtgctgttcaacttcatcatccccgtgagcatgtacgtgaccgtggagatgcagaagttcctgggcagcttcttcatcagctgggacaaggacttctacgacgaggagatcaacgagggcgccctggtgaacaccagcgacctgaacgaggagctgggccaggtggactacgtgttcaccgacaagaccggcaccctgaccgagaacagcatggagttcatcgagtgctgcatcgacggccacaagtacaagggcgtgacccaggaggtggacggcctgagccagaccgacggcaccctgacctacttcgacaaggtggacaagaacagagaggagctgttcctgagagccctgtgcctgtgccacaccgtggagatcaagaccaacgacgccgtggacggcgccaccgagagcgccgagctgacctacatcagcagcagccccgacgagatcgccctggtgaagggcgccaagagatacggcttcaccttcctgggcaacagaaacggctacatgagagtggagaaccagagaaaggagatcgaggagtacgagctgctgcacaccctgaacttcgacgccgtgagaagaagaatgagcgtgatcgtgaagacccaggagggcgacatcctgctgttctgcaagggcgccgacagcgccgtgttccccagagtgcagaaccacgagatcgagctgaccaaggtgcacgtggagagaaacgccatggacggctacagaaccctgtgcgtggccttcaaggagatcgcccccgacgactacgagagaatcaacagacagctgatcgaggccaagatggccctgcaggacagagaggagaagatggagaaggtgttcgacgacatcgagaccaacatgaacctgatcggcgccaccgccgtggaggacaagctgcaggaccaggccgccgagaccatcgaggccctgcacgccgccggcctgaaggtgtgggtgctgaccggcgacaagatggagaccgccaagagcacctgctacgcctgcagactgttccagaccaacaccgagctgctggagctgaccaccaagaccatcgaggagagcgagagaaaggaggacagactgcacgagctgctgatcgagtacagaaagaagctgctgcacgagttccccaagagcaccagaagcttcaagaaggcctggaccgagcaccaggagtacggcctgatcatcgacggcagcaccctgagcctgatcctgaacagcagccaggacagcagcagcaacaactacaagagcatcttcctgcagatctgcatgaagtgcaccgccgtgctgtgctgcagaatggcccccctgcagaaggcccagatcgtgagaatggtgaagaacctgaagggcagccccatcaccctgagcatcggcgacggcgccaacgacgtgagcatgatcctggagagccacgtgggcatcggcatcaagggcaaggagggcagacaggccgccagaaacagcgactacagcgtgcccaagttcaagcacctgaagaagctgctgctggcccacggccacctgtactacgtgagaatcgcccacctggtgcagtacttcttctacaagaacctgtgcttcatcctgccccagttcctgtaccagttcttctgcggcttcagccagcagcccctgtacgacgccgcctacctgaccatgtacaacatctgcttcaccagcctgcccatcctggcctacagcctgctggagcagcacatcaacatcgacaccctgaccagcgaccccagactgtacatgaagatcagcggcaacgccatgctgcagctgggccccttcctgtactggaccttcctggccgccttcgagggcaccgtgttcttcttcggcacctacttcctgttccagaccgccagcctggaggagaacggcaaggtgtacggcaactggaccttcggcaccatcgtgttcaccgtgctggtgttcaccgtgaccctgaagctggccctggacaccagattctggacctggatcaaccacttcgtgatctggggcagcctggccttctacgtgttcttcagcttcttctggggcggcatcatctggcccttcctgaagcagcagagaatgtacttcgtgttcgcccagatgctgagcagcgtgagcacctggctggccatcatcctgctgatcttcatcagcctgttccccgagatcctgctgatcgtgctgaagaacgtgagaagaagaagcgccagagtgcaccacctgatcagcagcagcgcctag

SEQ ID NO: 16522 - DNA, 3360 bp, Artificial Sequence
  Description of Artificial Sequence: Synthetic coding sequence
atgcagatggtgcccagcctgccccccgccagcgagtgcgccggcgaggagaagagagtgggcaccagaaccgtgttcgtgggcaaccaccccgtgagcgagaccgaggcctacatcgcccagagattctgcgacaacagaatcgtgagcagcaagtacaccctgtggaacttcctgcccaagaacctgttcgagcagttcagaagaatcgccaacttctacttcctgatcatcttcctggtgcaggtgaccgtggacacccccaccagccccgtgaccagcggcctgcccctgttcttcgtgatcaccgtgaccgccatcaagcagggctacgaggactgcctgagacacagagccgacaacgaggtgaacaagagcaccgtgtacatcatcgagaacgccaagagagtgagaaaggagagcgagaagatcaaggtgggcgacgtggtggaggtgcaggccgacgagaccttcccctgcgacctgatcctgctgagcagctgcaccaccgacggcacctgctacgtgaccaccgccagcctggacggcgagagcaactgcaagacccactacgccgtgagagacaccatcgccctgtgcaccgccgagagcatcgacaccctgagagccgccatcgagtgcgagcagccccagcccgacctgtacaagttcgtgggcagaatcaacatctacagcaacagcctggaggccgtggccagaagcctgggccccgagaacctgctgctgaagggcgccaccctgaagaacaccgagaagatctacggcgtggccgtgtacaccggcatggagaccaagatggccctgaactaccagggcaagagccagaagagaagcgccgtggagaagagcatcaacgccttcctgatcgtgtacctgttcatcctgctgaccaaggccgccgtgtgcaccaccctgaagtacgtgtggcagagcaccccctacaacgacgagccctggtacaaccagaagacccagaaggagagagagaccctgaaggtgctgaagatgttcaccgacttcctgagcttcatggtgctgttcaacttcatcatccccgtgagcatgtacgtgaccgtggagatgcagaagttcctgggcagcttcttcatcagctgggacaaggacttctacgacgaggagatcaacgagggcgccctggtgaacaccagcgacctgaacgaggagctgggccaggtggactacgtgttcaccgacaagaccggcaccctgaccgagaacagcatggagttcatcgagtgctgcatcgacggccacaagtacaagggcgtgacccaggaggtggacggcctgagccagaccgacggcaccctgacctacttcgacaaggtggacaagaacagagaggagctgttcctgagagccctgtgcctgtgccacaccgtggagatcaagaccaacgacgccgtggacggcgccaccgagagcgccgagctgacctacatcagcagcagccccgacgagatcgccctggtgaagggcgccaagagatacggcttcaccttcctgggcaacagaaacggctacatgagagtggagaaccagagaaaggagatcgaggagtacgagctgctgcacaccctgaacttcgacgccgtgagaagaagaatgagcgtgatcgtgaagacccaggagggcgacatcctgctgttctgcaagggcgccgacagcgccgtgttccccagagtgcagaaccacgagatcgagctgaccaaggtgcacgtggagagaaacgccatggacggctacagaaccctgtgcgtggccttcaaggagatcgcccccgacgactacgagagaatcaacagacagctgatcgaggccaagatggccctgcaggacagagaggagaagatggagaaggtgttcgacgacatcgagaccaacatgaacctgatcggcgccaccgccgtggaggacaagctgcaggaccaggccgccgagaccatcgaggccctgcacgccgccggcctgaaggtgtgggtgctgaccggcgacaagatggagaccgccaagagcacctgctacgcctgcagactgttccagaccaacaccgagctgctggagctgaccaccaagaccatcgaggagagcgagagaaaggaggacagactgcacgagctgctgatcgagtacagaaagaagctgctgcacgagttccccaagagcaccagaagcttcaagaaggcctggaccgagcaccaggagtacggcctgatcatcgacggcagcaccctgagcctgatcctgaacagcagccaggacagcagcagcaacaactacaagagcatcttcctgcagatctgcatgaagtgcaccgccgtgctgtgctgcagaatggcccccctgcagaaggcccagatcgtgagaatggtgaagaacctgaagggcagccccatcaccctgagcatcggcgacggcgccaacgacgtgagcatgatcctggagagccacgtgggcatcggcatcaagggcaaggagggcagacaggccgccagaaacagcgactacagcgtgcccaagttcaagcacctgaagaagctgctgctggcccacggccacctgtactacgtgagaatcgcccacctggtgcagtacttcttctacaagaacctgtgcttcatcctgccccagttcctgtaccagttcttctgcggcttcagccagcagcccctgtacgacgccgcctacctgaccatgtacaacatctgcttcaccagcctgcccatcctggcctacagcctgctggagcagcacatcaacatcgacaccctgaccagcgaccccagactgtacatgaagatcagcggcaacgccatgctgcagctgggccccttcctgtactggaccttcctggccgccttcgagggcaccgtgttcttcttcggcacctacttcctgttccagaccgccagcctggaggagaacggcaaggtgtacggcaactggaccttcggcaccatcgtgttcaccgtgctggtgttcaccgtgaccctgaagctggccctggacaccagattctggacctggatcaaccacttcgtgatctggggcagcctggccttctacgtgttcttcagcttcttctggggcggcatcatctggcccttcctgaagcagcagagaatgtacttcgtgttcgcccagatgctgagcagcgtgagcacctggctggccatcatcctgctgatcttcatcagcctgttccccgagatcctgctgatcgtgctgaagaacgtgagaagaagaagcgccagaaaccccaacctggagctgcccatgctgctgagctacaagcacaccgacagcggctacagctag

SEQ ID NO: 16523 - DNA, 3387 bp, Artificial Sequence
  Description of Artificial Sequence: Synthetic coding sequence
atgcagatggtgcccagcctgccccccgccagcgagtgcgccggcgaggagaagagagtgggcaccagaaccgtgttcgtgggcaaccaccccgtgagcgagaccgaggcctacatcgcccagagattctgcgacaacagaatcgtgagcagcaagtacaccctgtggaacttcctgcccaagaacctgttcgagcagttcagaagaatcgccaacttctacttcctgatcatcttcctggtgcaggtgaccgtggacacccccaccagccccgtgaccagcggcctgcccctgttcttcgtgatcaccgtgaccgccatcaagcagggctacgaggactgcctgagacacagagccgacaacgaggtgaacaagagcaccgtgtacatcatcgagaacgccaagagagtgagaaaggagagcgagaagatcaaggtgggcgacgtggtggaggtgcaggccgacgagaccttcccctgcgacctgatcctgctgagcagctgcaccaccgacggcacctgctacgtgaccaccgccagcctggacggcgagagcaactgcaagacccactacgccgtgagagacaccatcgccctgtgcaccgccgagagcatcgacaccctgagagccgccatcgagtgcgagcagccccagcccgacctgtacaagttcgtgggcagaatcaacatctacagcaacagcctggaggccgtggccagaagcctgggccccgagaacctgctgctgaagggcgccaccctgaagaacaccgagaagatctacggcgtggccgtgtacaccggcatggagaccaagatggccctgaactaccagggcaagagccagaagagaagcgccgtggagaagagcatcaacgccttcctgatcgtgtacctgttcatcctgctgaccaaggccgccgtgtgcaccaccctgaagtacgtgtggcagagcaccccctacaacgacgagccctggtacaaccagaagacccagaaggagagagagaccctgaaggtgctgaagatgttcaccgacttcctgagcttcatggtgctgttcaacttcatcatccccgtgagcatgtacgtgaccgtggagatgcagaagttcctgggcagcttcttcatcagctgggacaaggacttctacgacgaggagatcaacgagggcgccctggtgaacaccagcgacctgaacgaggagctgggccaggtggactacgtgttcaccgacaagaccggcaccctgaccgagaacagcatggagttcatcgagtgctgcatcgacggccacaagtacaagggcgtgacccaggaggtggacggcctgagccagaccgacggcaccctgacctacttcgacaaggtggacaagaacagagaggagctgttcctgagagccctgtgcctgtgccacaccgtggagatcaagaccaacgacgccgtggacggcgccaccgagagcgccgagctgacctacatcagcagcagccccgacgagatcgccctggtgaagggcgccaagagatacggcttcaccttcctgggcaacagaaacggctacatgagagtggagaaccagagaaaggagatcgaggagtacgagctgctgcacaccctgaacttcgacgccgtgagaagaagaatgagcgtgatcgtgaagacccaggagggcgacatcctgctgttctgcaagggcgccgacagcgccgtgttccccagagtgcagaaccacgagatcgagctgaccaaggtgcacgtggagagaaacgccatggacggctacagaaccctgtgcgtggccttcaaggagatcgcccccgacgactacgagagaatcaacagacagctgatcgaggccaagatggccctgcaggacagagaggagaagatggagaaggtgttcgacgacatcgagaccaacatgaacctgatcggcgccaccgccgtggaggacaagctgcaggaccaggccgccgagaccatcgaggccctgcacgccgccggcctgaaggtgtgggtgctgaccggcgacaagatggagaccgccaagagcacctgctacgcctgcagactgttccagaccaacaccgagctgctggagctgaccaccaagaccatcgaggagagcgagagaaaggaggacagactgcacgagctgctgatcgagtacagaaagaagctgctgcacgagttccccaagagcaccagaagcttcaagaaggcctggaccgagcaccaggagtacggcctgatcatcgacggcagcaccctgagcctgatcctgaacagcagccaggacagcagcagcaacaactacaagagcatcttcctgcagatctgcatgaagtgcaccgccgtgctgtgctgcagaatggcccccctgcagaaggcccagatcgtgagaatggtgaagaacctgaagggcagccccatcaccctgagcatcggcgacggcgccaacgacgtgagcatgatcctggagagccacgtgggcatcggcatcaagggcaaggagggcagacaggccgccagaaacagcgactacagcgtgcccaagttcaagcacctgaagaagctgctgctggcccacggccacctgtactacgtgagaatcgcccacctggtgcagtacttcttctacaagaacctgtgcttcatcctgccccagttcctgtaccagttcttctgcggcttcagccagcagcccctgtacgacgccgcctacctgaccatgtacaacatctgcttcaccagcctgcccatcctggcctacagcctgctggagcagcacatcaacatcgacaccctgaccagcgaccccagactgtacatgaagatcagcggcaacgccatgctgcagctgggccccttcctgtactggaccttcctggccgccttcgagggcaccgtgttcttcttcggcacctacttcctgttccagaccgccagcctggaggagaacggcaaggtgtacggcaactggaccttcggcaccatcgtgttcaccgtgctggtgttcaccgtgaccctgaagctggccctggacaccagattctggacctggatcaaccacttcgtgatctggggcagcctggccttctacgtgttcttcagcttcttctggggcggcatcatctggcccttcctgaagcagcagagaatgtacttcgtgttcgcccagatgctgagcagcgtgagcacctggctggccatcatcctgctgatcttcatcagcctgttccccgagatcctgctgatcgtgctgaagaacgtgagaagaagaagcgccagagtgaccaagagactgcccagcagcggcaccagcgccatcttcatgctgagccagaccagcagcaaccacagcttcagctggagcgagtag

SEQ ID NO: 16524 - DNA, 3342 bp, Artificial Sequence
  Description of Artificial Sequence: Synthetic coding sequence
atgttcagaagaagcctgaacagattctgcgccggcgaggagaagagagtgggcaccagaaccgtgttcgtgggcaaccaccccgtgagcgagaccgaggcctacatcgcccagagattctgcgacaacagaatcgtgagcagcaagtacaccctgtggaacttcctgcccaagaacctgttcgagcagttcagaagaatcgccaacttctacttcctgatcatcttcctggtgcaggtgaccgtggacacccccaccagccccgtgaccagcggcctgcccctgttcttcgtgatcaccgtgaccgccatcaagcagggctacgaggactgcctgagacacagagccgacaacgaggtgaacaagagcaccgtgtacatcatcgagaacgccaagagagtgagaaaggagagcgagaagatcaaggtgggcgacgtggtggaggtgcaggccgacgagaccttcccctgcgacctgatcctgctgagcagctgcaccaccgacggcacctgctacgtgaccaccgccagcctggacggcgagagcaactgcaagacccactacgccgtgagagacaccatcgccctgtgcaccgccgagagcatcgacaccctgagagccgccatcgagtgcgagcagccccagcccgacctgtacaagttcgtgggcagaatcaacatctacagcaacagcctggaggccgtggccagaagcctgggccccgagaacctgctgctgaagggcgccaccctgaagaacaccgagaagatctacggcgtggccgtgtacaccggcatggagaccaagatggccctgaactaccagggcaagagccagaagagaagcgccgtggagaagagcatcaacgccttcctgatcgtgtacctgttcatcctgctgaccaaggccgccgtgtgcaccaccctgaagtacgtgtggcagagcaccccctacaacgacgagccctggtacaaccagaagacccagaaggagagagagaccctgaaggtgctgaagatgttcaccgacttcctgagcttcatggtgctgttcaacttcatcatccccgtgagcatgtacgtgaccgtggagatgcagaagttcctgggcagcttcttcatcagctgggacaaggacttctacgacgaggagatcaacgagggcgccctggtgaacaccagcgacctgaacgaggagctgggccaggtggactacgtgttcaccgacaagaccggcaccctgaccgagaacagcatggagttcatcgagtgctgcatcgacggccacaagtacaagggcgtgacccaggaggtggacggcctgagccagaccgacggcaccctgacctacttcgacaaggtggacaagaacagagaggagctgttcctgagagccctgtgcctgtgccacaccgtggagatcaagaccaacgacgccgtggacggcgccaccgagagcgccgagctgacctacatcagcagcagccccgacgagatcgccctggtgaagggcgccaagagatacggcttcaccttcctgggcaacagaaacggctacatgagagtggagaaccagagaaaggagatcgaggagtacgagctgctgcacaccctgaacttcgacgccgtgagaagaagaatgagcgtgatcgtgaagacccaggagggcgacatcctgctgttctgcaagggcgccgacagcgccgtgttccccagagtgcagaaccacgagatcgagctgaccaaggtgcacgtggagagaaacgccatggacggctacagaaccctgtgcgtggccttcaaggagatcgcccccgacgactacgagagaatcaacagacagctgatcgaggccaagatggccctgcaggacagagaggagaagatggagaaggtgttcgacgacatcgagaccaacatgaacctgatcggcgccaccgccgtggaggacaagctgcaggaccaggccgccgagaccatcgaggccctgcacgccgccggcctgaaggtgtgggtgctgaccggcgacaagatggagaccgccaagagcacctgctacgcctgcagactgttccagaccaacaccgagctgctggagctgaccaccaagaccatcgaggagagcgagagaaaggaggacagactgcacgagctgctgatcgagtacagaaagaagctgctgcacgagttccccaagagcaccagaagcttcaagaaggcctggaccgagcaccaggagtacggcctgatcatcgacggcagcaccctgagcctgatcctgaacagcagccaggacagcagcagcaacaactacaagagcatcttcctgcagatctgcatgaagtgcaccgccgtgctgtgctgcagaatggcccccctgcagaaggcccagatcgtgagaatggtgaagaacctgaagggcagccccatcaccctgagcatcggcgacggcgccaacgacgtgagcatgatcctggagagccacgtgggcatcggcaaggagggcagacaggccgccagaaacagcgactacagcgtgcccaagttcaagcacctgaagaagctgctgctggcccacggccacctgtactacgtgagaatcgcccacctggtgcagtacttcttctacaagaacctgtgcttcatcctgccccagttcctgtaccagttcttctgcggcttcagccagcagcccctgtacgacgccgcctacctgaccatgtacaacatctgcttcaccagcctgcccatcctggcctacagcctgctggagcagcacatcaacatcgacaccctgaccagcgaccccagactgtacatgaagatcagcggcaacgccatgctgcagctgggccccttcctgtactggaccttcctggccgccttcgagggcaccgtgttcttcttcggcacctacttcctgttccagaccgccagcctggaggagaacggcaaggtgtacggcaactggaccttcggcaccatcgtgttcaccgtgctggtgttcaccgtgaccctgaagctggccctggacaccagattctggacctggatcaaccacttcgtgatctggggcagcctggccttctacgtgttcttcagcttcttctggggcggcatcatctggcccttcctgaagcagcagagaatgtacttcgtgttcgcccagatgctgagcagcgtgagcacctggctggccatcatcctgctgatcttcatcagcctgttccccgagatcctgctgatcgtgctgaagaacgtgagaagaagaagcgccagaaaccccaacctggagctgcccatgctgctgagctacaagcacaccgacagcggctacagctag

SEQ ID NO: 16525 - DNA, 609 bp, Artificial Sequence
  Description of Artificial Sequence: Synthetic coding sequence
tgagagtgctgcatcgacggccacaagtacaagggcgtgacccaggaggtggacggcctgagccagaccgacggcaccctgacctacttcgacaaggtggacaagaacagagaggagctgttcctgagagccctgtgcctgtgccacaccgtggagatcaagaccaacgacgccgtggacggcgccaccgagagcgccgagctgacctacatcagcagcagccccgacgagatcgccctggtgaagggcgccaagagatacgagctgctgcacaccctgaacttcgacgccgtgagaagaagaatgagcgtgatcgtgaagacccaggagggcgacatcctgctgttctgcaagggcgccgacagcgccgtgttccccagagtgcagaaccacgagatcgagctgaccaaggtgcacgtggagagaaacgccatggacggctacagaaccctgtgcgtggccttcaaggagatcgcccccgacgactacgagagaatcaacagacagctgatcgaggccaagatggccctgcaggacagagaggagaagatggagaaggtgttcgacgacatcgagaccaacatgaacctgatcggcgccaccgcctag

SEQ ID NO: 16526 - DNA, 498 bp, Artificial Sequence
  Description of Artificial Sequence: Synthetic coding sequence
tgagagggcaccgtgttcttcttcggcacctacttcctgttccagaccgccagcctggaggagaacggcaaggtgtacggcaactggaccttcggcaccatcgtgttcaccgtgctggtgttcaccgtgaccctgaagctggccctggacaccagattctggacctggatcaaccacttcgtgatctggggcagcctggccttctacgtgttcttcagcttcttctggggcggcatcatctggcccttcctgaagcagcagagaatgtacttcgtgttcgcccagatgctgagcagcgtgagcacctggctggccatcatcctgctgatcttcatcagcctgttccccgagatcctgctgatcgtgctgaagaacgtgagaagaagaagcgccagaagaaacctgagctgcagaagagccagcgacagcctgagcgccagacccagcgtgagacccctgctgctgagaaccttcagcgacgagagcaacgtgctgtag

SEQ ID NO: 16527 - DNA, 519 bp, Artificial Sequence
  Description of Artificial Sequence: Synthetic coding sequence
accctgaccagcgaccccagactgtacatgaagatcagcggcaacgccatgctgcagctgggccccttcctgtactggaccttcctggccgccttcgagggcaccgtgttcttcttcggcacctacttcctgttccagaccgccagcctggaggagaacggcaaggtgtacggcaactggaccttcggcaccatcgtgttcaccgtgctggtgttcaccgtgaccctgaagctggccctggacaccagattctggacctggatcaaccacttcgtgatctggggcagcctggccttctacgtgttcttcagcttcttctggggcggcatcatctggcccttcctgaagcagcagagaatgtacttcgtgttcgcccagatgctgagcagcgtgagcacctggctggccatcatcctgctgatcttcatcagcctgttccccgagatcctgctgatcgtgctgaagaacgtgagaagaagaagcgccagagtgcaccacctgatcagcagcagcgcctag

SEQ ID NO: 16528 - DNA, 357 bp, Artificial Sequence
  Description of Artificial Sequence: Synthetic coding sequence
atgaccagccagagccagggcatccaccagctgctgcaggccgagaagagagccaaggacaagctggaggaggccaagaagagaaagggcaagagactgaagcaggccaaggaggaggccatggtggagatcgaccagtacagaatgcagagagacaaggagttcagactgaagcagagcaagatcatgggcagccagaacaacctgagcgacgagatcgaggagcagaccctgggcaagatccaggagctgaacggccactacaacaagtacatggagagcgtgatgaaccagctgctgagcatggtgtgcgacatgaagcccgagatccacgtgaactacagagccaccaactag

SEQ ID NO: 16529 - DNA, 180 bp, Artificial Sequence
  Description of Artificial Sequence: Synthetic coding sequence
atgaccagccagagccagggcatccaccagctgctgcaggccgagaagagagccaaggacaagctggaggaggccaagaagatcctgcacctgctgttcctgaagagaagagactgggactgcttctggaagagaaaggccatcgaggccagccagggcggcagcaacggcagaaactag

SEQ ID NO: 16530 - DNA, 375 bp, Artificial Sequence
  Description of Artificial Sequence: Synthetic coding sequence
atgaccagccagagccagggcatccaccagctgctgcaggccgagaagagagccaaggacaagctggaggaggccaagaagaagaccggcaccgccagcggcaagggcaagagactgaagcaggccaaggaggaggccatggtggagatcgaccagtacagaatgcagagagacaaggagttcagactgaagcagagcaagatcatgggcagccagaacaacctgagcgacgagatcgaggagcagaccctgggcaagatccaggagctgaacggccactacaacaagtacatggagagcgtgatgaaccagctgctgagcatggtgtgcgacatgaagcccgagatccacgtgaactacagagccaccaactag

SEQ ID NO: 16531 - DNA, 357 bp, Artificial Sequence; identical to SEQ ID NO: 16528
  Description of Artificial Sequence: Synthetic coding sequence

SEQ ID NO: 16532 - DNA, 375 bp, Artificial Sequence; identical to SEQ ID NO: 16530
  Description of Artificial Sequence: Synthetic coding sequence

SEQ ID NO: 16533 - DNA, 360 bp, Artificial Sequence
  Description of Artificial Sequence: Synthetic coding sequence
atggccggcagaggcaagctgatcgccgtgatcggcgacgaggacaccgtgaccggcttcctgctgggcggcatcggcgagctgaacaagaacagacaccccaacttcctggtggtggagaaggacaccaccatcaacgagatcgaggacaccttcagacagttcctgaacagagacgacatcggcatcatcctgatcaaccagtacatcgccgagatggtgagacacgccctggacgcccaccagcagagcatccccgccgtgctggagatccccagcaaggagcacccctacgacgccgccaaggacagcatcctgagaagagccagaggcatgttcaccgccgaggacctgagatag

SEQ ID NO: 16534 - DNA, 681 bp, Artificial Sequence
  Description of Artificial Sequence: Synthetic coding sequence
atggccctgagcgacgtggacgtgaagaagcagatcaagcacatgatggccttcatcgagcaggaggccaacgagaaggccgaggagatcgacgccaaggccgaggaggagttcaacatcgagaagggcagactggtgcagacccagagactgaagatcatggagtactacgagaagaaggagaagcagatcgagcagcagaagaagatcctgatgagcaccatgagaaaccaggccagactgaaggtgctgagagccagaaacgacctgatcagcgacctgctgagcgaggccaagctgagactgagcagaatcgtggaggaccccgaggtgtaccagggcctgctggacaagctggtgctgcagggcctgctgagactgctggagcccgtgatgatcgtgagatgcagaccccaggacctgctgctggtggaggccgccgtgcagaaggccatccccgagtacatgaccatcagccagaagcacgtggaggtgcagatcgacaaggaggcctacctggccgtgaacgccgccggcggcgtggaggtgtacagcggcaaccagagaatcaaggtgagcaacaccctggagagcagactggacctgagcgccaagcagaagatgcccgagatcagaatggccctgttcggcgccaacaccaacagaaagttcttcatctag

SEQ ID NO: 16535 - DNA, 681 bp, Artificial Sequence; identical to SEQ ID NO: 16534
  Description of Artificial Sequence: Synthetic coding sequence

SEQ ID NO: 16536 - DNA, 999 bp, Artificial Sequence
  Description of Artificial Sequence: Synthetic coding sequence
atggccgccgtgttcctggtgaccctgtacgagtacagccccctgttctacatcgccgtggtgttcacctgcttcatcgtgaccaccggcctggtgctgggctggttcggctgggacgtgcccgtgatcctgagaaacagcgaggagacccagttcagcaccagagtgttcaagaagcagatgagacaggtgaagaaccccttcggcctggagatcaccaaccccagcagcgccagcatcaccaccggcatcaccctgaccaccgactgcctggaggacagcctgctgacctgctactggggctgcagcgtgcagaagctgtacgaggccctgcagaagcacgtgtactgcttcagaatcagcaccccccaggccctggaggacgccctgtacagcgagtacctgtaccaggagcagtacttcatcaagaaggacagcaaggaggagatctactgccagctgcccagagacaccaagatcgaggacttcggcaccgtgcccagaagcagataccccctggtggccctgctgaccctggccgacgaggacgacagagagatctacgacatcatcagcatggtgagcgtgatccacatccccgacagaacctacaagctgagctgcagaatcctgtaccagtacctgctgctggcccagggccagttccacgacctgaagcagctgttcatgagcgccaacaacaacttcacccccagcaacaacagcagcagcgaggagaagaacaccgacagaagcctgctggagaaggtgggcctgagcgagagcgaggtggagcccagcgaggagaacagcaaggactgcgtggtgtgccagaacggcaccgtgaactgggtgctgctgccctgcagacacacctgcctgtgcgacggctgcgtgaagtacttccagcagtgccccatgtgcagacagttcgtgcaggagagcttcgccctgtgcagccagaaggagcaggacaaggacaagcccaagaccctgtag

SEQ ID NO: 16537 - DNA, 744 bp, Artificial Sequence
  Description of Artificial Sequence: Synthetic coding sequence
atgagcggcaaggacagaatcgagatcttccccagcagaatggcccagaccatcatgaaggccagactgaagggcgcccagaccggcagaaacctgctgaagaagaagagcgacgccctgaccctgagattcagacagatcctgaagaagatcatcgagaccaagatgctgatgggcgaggtgatgagagaggccgccttcagcctggccgaggccaagttcaccgccggcgacttcagcaccaccgtgatccagaacgtgaacaaggcccaggtgaagatcagagccaagaaggacaacgtggccggcgtgaccctgcccgtgttcgagcactaccacgagggcaccgacagctacgagctgaccggcctggccagaggcggcgagcagctggccaagctgaagagaaactacgccaaggccgtggagctgctggtggagctggccagcctgcagaccagcttcgtgaccctggacgaggccatcaagatcaccaacagaagagtgaacgccatcgagcacgtgatcatccccagaatcgagagaaccctggcctacatcatcaccgagctggacgagagagagagagaggagttctacagactgaagaagatccaggagaagaagaagatcctgaaggagaagagcgagaaggacctggagcagagaagagccgccggcgaggtgctggagcccgccaacctgctggccgaggagaaggacgaggacctgctgttcgagtag

SEQ ID NO: 16538 - DNA, 219 bp, Artificial Sequence
  Description of Artificial Sequence: Synthetic coding sequence
atgagcggcaaggacagaatcgagatcttccccagcagaatggcccagaccatcatgaaggccagactgaagggcgcccagaccggcagaaacctgctgaagaagaagagcgacgccctgaccctgagattcagacagatcctgaagaagatcatcgagaccaagatgctgatgggcgaggtgatgagagaggccgccttcagcctggccgaggcctag

SEQ ID NO: 16539 - DNA, 1053 bp, Artificial Sequence
  Description of Artificial Sequence: Synthetic coding sequence
atgctggagggcgccgagctgtacttcaacgtggaccacggctacctggagggcctggtgagaggctgcaaggccagcctgctgacccagcaggactacatcaacctggtgcagtgcgagaccctggaggacctgaagatccacctgcagaccaccgactacggcaacttcctggccaaccacaccaaccccctgaccgtgagcaagatcgacaccgagatgagaaagagactgtgcggcgagttcgagtacttcagaaaccacagcctggagcccctgagcaccttcctgacctacatgacctgcagctacatgatcgacaacgtgatcctgctgatgaacggcgccctgcagaagaagagcgtgaaggagatcctgggcaagtgccaccccctgggcagattcaccgagatggaggccgtgaacatcgccgagacccccagcgacctgttcaacgccatcctgatcgagacccccctggcccccttcttccaggactgcatgagcgagaacgccctggacgagctgaacatcgagctgctgagaaacaagctgtacaagagctacctggaggccttctacaagttctgcaagaaccacggcgacgtgaccgccgaggtgatgtgccccatcctggagttcgaggccgacagaagagccttcatcatcaccctgaacagcttcggcaccgagctgagcaaggaggacagagagaccctgtaccccaccttcggcaagctgtaccccgagggcctgagactgctggcccaggccgaggacttcgaccagatgaagaacgtggccgaccactacggcgtgtacaagcccctgttcgaggccgtgggcggcagcggcggcaagaccctggaggacgtgttctacgagagagaggtgcagatgaacgtgctggccttcaacagacagttccactacggcgtgttctacgcctacgtgaagctgaaggagcaggagatcagaaacatcgtgtggatcgccgagtgcatcagccagagacacagaaccaagatcaacagctacatccccatcctgtag

SEQ ID NO: 16540 - DNA, 111 bp, Artificial Sequence
  Description of Artificial Sequence: Synthetic coding sequence
atgctggagggcgccgagctgtacttcaacgtggaccacggctacctggagggcctggtgagaggctgcaaggccagcctgctgacccagcaggactacatcaacctgtag

SEQ ID NO: 16541 - DNA, 132 bp, Artificial Sequence
  Description of Artificial Sequence: Synthetic coding sequence
atgctggagggcgccgagctgtacttcaacgtggaccacggctacctggagggcctggtgagaggctgcaaggccagcctgctgacccagcaggactacatcaacctggtgcagtgcgagaccctggagtag

SEQ ID NO: 16542 - DNA, 1284 bp, Artificial Sequence
  Description of Artificial Sequence: Synthetic coding sequence
atgagcgagttctggctgatcagcgcccccggcgacaaggagaacctgcaggccctggagagaatgaacaccgtgaccagcaagagcaacctgagctacaacaccaagttcgccatccccgacttcaaggtgggcaccctggacagcctggtgggcctgagcgacgagctgggcaagctggacaccttcgccgagagcctgatcagaagaatggcccagagcgtggtggaggtgatggaggacagcaagggcaaggtgcaggagcacctgctggccaacggcgtggacctgaccagcttcgtgacccacttcgagtgggacatggccaagtaccccgtgaagcagcccctggtgagcgtggtggacaccatcgccaagcagctggcccagatcgagatggacctgaagagcagaaccgccgcctacaacaccctgaagaccaacctggagaacctggagaagaagagcatgggcaacctgttcaccagaaccctgagcgacatcgtgagcaaggaggacttcgtgctggacagcgagtacctggtgaccctgctggtgatcgtgcccaagcccaactacagccagtggcagaagacctacgagagcctgagcgacatggtggtgcccagaagcaccaagctgatcaccgaggacaaggagggcggcctgttcaccgtgaccctgttcagaaaggtgatcgaggacttcaagaccaaggccaaggagaacaagttcaccgtgagagagttctactacgacgagaaggagatcgagagagagagagaggagatggccagactgctgagcgacaagaagcagcagtaccagaccagctgcgtggccctgaagaagggcagcagcaccttccccgaccacaaggtgaaggtgacccccctgggcaaccccgacagacccgccgccggccagaccgacagagagagagagagcgagggcgagggcgagggccccctgctgagatggctgaaggtgaacttcagcgaggccttcatcgcctggatccacatcaaggccctgagagtgttcgtggagagcgtgctgagatacggcctgcccgtgaacttccaggccgtgctgctgcagccccacaagaagagcagcaccaagagactgagagaggtgctgaacagcgtgttcagacacctggacgaggtggccgccaccagcatcctggacgccagcgtggagatccccggcctgcagctgaacaaccaggactacttcccctacgtgtacttccacatcgacctgagcctgctggactag

SEQ ID NO: 16543 - DNA, 1146 bp, Artificial Sequence
  Description of Artificial Sequence: Synthetic coding sequence
atgagcgagttctggctgatcagcgcccccggcgacaaggagaacctgcaggccctggagagaatgaacaccgtgaccagcaagagcaacctgagctacaacaccaagttcgccatccccgacttcaaggtgggcaccctggacagcctggtgggcctgagcgacgagctgggcaagctggacaccttcgccgagagcctgatcagaagaatggcccagagcgtggtggaggtgatggaggacagcaagggcaaggtgcaggagcacctgctggccaacggcgtggacctgaccagcttcgtgacccacttcgagtgggacatggccaagtaccccgtgaagcagcccctggtgagcgtggtggacaccatcgccaagcagctggcccagatcgagatggacctgaagagcagaaccgccgcctacaacaccctgaagaccaacctggagaacctggagaagaagagcatgggcaacctgttcaccagaaccctgagcgacatcgtgagcaaggaggacttcgtgctggacagcgagtacctggtgaccctgctggtgatcgtgcccaagcccaactacagccagtggcagaagacctacgagagcctgagcgacatggtggtgcccagaagcaccaagctgatcaccgaggacaaggagggcggcctgttcaccgtgaccctgttcagaaaggtgatcgaggacttcaagaccaaggccaaggagaacaagttcaccgtgagagagttctactacgacgagaaggagatcgagagagagagagaggagatggccagactgctgagcgacaagaagcagcagtacggccccctgctgagatggctgaaggtgaacttcagcgaggccttcatcgcctggatccacatcaaggccctgagagtgttcgtggagagcgtgctgagatacggcctgcccgtgaacttccaggccgtgctgctgcagccccacaagaagagcagcaccaagagactgagagaggtgctgaacagcgtgttcagacacctggacgaggtggccgccaccagcatcctggacgccagcgtggagatccccggcctgcagctgaacaaccaggactacttcccctacgtgtacttccacatcgacctgagcctgctggactag

SEQ ID NO: 16544 - DNA, 1398 bp, Artificial Sequence
  Description of Artificial Sequence: Synthetic coding sequence
atgaccaagatggacatcagaggcgccgtggacgccgccgtgcccaccaacatcatcgccgccaaggccgccgaggtgagagccaacaaggtgaactggcagagctacctgcagggccagatgatcagcgccgaggactgcgagttcatccagagattcgagatgaagagaagccccgaggagaagcaggagatgctgcagaccgagggcagccagtgcgccaagaccttcatcaacctgatgacccacatctgcaaggagcagaccgtgcagtacatcctgaccatggtggacgacatgctgcaggagaaccaccagagagtgagcatcttcttcgactacgccagatgcagcaagaacaccgcctggccctacttcctgcccatgctgaacagacaggaccccttcaccgtgcacatggccgccagaatcatcgccaagctggccgcctggggcaaggagctgatggagggcagcgacctgaactactacttcaactggatcaagacccagctgagcagccagagcagccagtacgtgcagtgcgtggccggctgcctgcagctgatgctgagagtgaacgagtacagattcgcctgggtggaggccgacggcgtgaactgcatcatgggcgtgctgagcaacaagtgcggcttccagctgcagtaccagatgatcttcagcatctggctgctggccttcagcccccagatgtgcgagcacctgagaagatacaacatcatccccgtgctgagcgacatcctgcaggagagcgtgaaggagaaggtgaccagaatcatcctggccgccttcagaaacttcctggagaagagcaccgagagagagaccagacaggagtacgccctggccatgatccagtgcaaggtgctgaagcagctggagaacctggagcagcagaagtacgacgacgaggacatcagcgaggacatcaagttcctgctggagaagctgggcgagagcgtgcaggacctgagcagcttcgacgagtacagcagcgagctgaagagcggcagactggagtggagccccgtgcacaagagcgagaagttctggagagagaacgccgtgagactgaacgagaagaactacgagctgctgaagatcctgaccaagctgctggaggtgagcgacgacccccaggtgctggccgtggccgcccacgacgtgggcgagtacgtgagacactaccccagaggcaagagagtgatcgagcagctgggcggcaagcagctggtgatgaaccacatgcaccacgaggaccagcaggtgagatacaacgccctgctggccgtgcagaagctgatggtgcacaactgggagtacctgggcaagcagctgcagagcgagcagccccagaccgccgccgccagaagctag

SEQ ID NO: 16545 - DNA, 1452 bp, Artificial Sequence
  Description of Artificial Sequence: Synthetic coding sequence
atgaccaagatggacatcagaggcgccgtggacgccgccgtgcccaccaacatcatcgccgccaaggccgccgaggtgagagccaacaaggtgaactggcagagctacctgcagggccagatgatcagcgccgaggactgcgagttcatccagagattcgagatgaagagaagccccgaggagaagcaggagatgctgcagaccgagggcagccagtgcgccaagaccttcatcaacctgatgacccacatctgcaaggagcagaccgtgcagtacatcctgaccatggtggacgacatgctgcaggagaaccaccagagagtgagcatcttcttcgactacgccagatgcagcaagaacaccgcctggccctacttcctgcccatgctgaacagacaggaccccttcaccgtgcacatggccgccagaatcatcgccaagctggccgcctggggcaaggagctgatggagggcagcgacctgaactactacttcaactggatcaagacccagctgagcagccagaagctgagaggcagcggcgtggccgtggagaccggcaccgtgagcagcagcgacagcagccagtacgtgcagtgcgtggccggctgcctgcagctgatgctgagagtgaacgagtacagattcgcctgggtggaggccgacggcgtgaactgcatcatgggcgtgctgagcaacaagtgcggcttccagctgcagtaccagatgatcttcagcatctggctgctggccttcagcccccagatgtgcgagcacctgagaagatacaacatcatccccgtgctgagcgacatcctgcaggagagcgtgaaggagaaggtgaccagaatcatcctggccgccttcagaaacttcctggagaagagcaccgagagagagaccagacaggagtacgccctggccatgatccagtgcaaggtgctgaagcagctggagaacctggagcagcagaagtacgacgacgaggacatcagcgaggacatcaagttcctgctggagaagctgggcgagagcgtgcaggacctgagcagcttcgacgagtacagcagcgagctgaagagcggcagactggagtggagccccgtgcacaagagcgagaagttctggagagagaacgccgtgagactgaacgagaagaactacgagctgctgaagatcctgaccaagctgctggaggtgagcgacgacccccaggtgctggccgtggccgcccacgacgtgggcgagtacgtgagacactaccccagaggcaagagagtgatcgagcagctgggcggcaagcagctggtgatgaaccacatgcaccacgaggaccagcaggtgagatacaacgccctgctggccgtgcagaagctgatggtgcacaactgggagtacctgggcaagcagctgcagagcgagcagccccagaccgccgccgccagaagctag

SEQ ID NO: 16546 - DNA, 1452 bp, Artificial Sequence; identical to SEQ ID NO: 16545
  Description of Artificial Sequence: Synthetic coding sequence

SEQ ID NO: 16547 - DNA, 309 bp, Artificial Sequence
  Description of Artificial Sequence: Synthetic coding sequence
atgaccaagatggacatcagaggcgccgtggacgccgccgtgcccaccaacatcatcgccgccaaggccgccgaggtgagagccaacaaggtgaactggcagagctacctgcagggccagatgatcagcgccgaggactgcgagttcatccagagattcgagatgaagagaagccccgaggagaagcaggagatgctgcagaccgagggcagccagtgcgccaagaccttcatcaacctgatgacccacatctgcaaggagcagaccgtgcagtacatcctgaccatggtggacgacatgctgcagtag

SEQ ID NO: 16548 - DNA, 306 bp, Artificial Sequence
  Description of Artificial Sequence: Synthetic coding sequence
atgaccaagatggacatcagaggcgccgtggacgccgccgtgcccaccaacatcatcgccgccaaggccgccgaggtgagagccaacaaggtgaactggcagagctacctgcagggccagatgatcagcgccgaggactgcgagttcatccagagattcgagatgaagagaagccccgaggagaagcaggagatgctgcagaccgagggcagccagtgcgccaagaccttcatcaacctgatgacccacatctgcaaggagcagaccgtgcagtacatcctgaccatggtggacgacatgctgtag

SEQ ID NO: 16549 - DNA, 873 bp, Artificial Sequence
  Description of Artificial Sequence: Synthetic coding sequence
atgggcgacggcggcgccgagagagacagaggccccgccagaagagccgagagcggcggcggcggcggcagatgcggcgacagaagcggcgccggcgacctgagagccgacggcggcggccacagccccaccgaggtggccggcaccagcgccagcagccccgccggcagcagagagagcggcgccgacagcgacggccagcccggccccggcgaggccgaccactgcagaagaatcctggtgagagacgccaagggcaccatcagagagatcgtgctgcccaagggcctggacctggacagacccaagagaaccagaaccagcttcaccgccgagcagctgtacagactggagatggagttccagagatgccagtacgtggtgggcagagagagaaccgagctggccagacagctgaacctgagcgagacccaggtgaaggtgtggttccagaacagaagaaccaagcagaagaaggaccagagcagagacctggagaagagagccagcagcagcgccagcgaggccttcgccaccagcaacatcctgagactgctggagcagggcagactgctgagcgtgcccagagcccccagcctgctggccctgacccccagcctgcccggcctgcccgccagccacagaggcaccagcctgggcgaccccagaaacagcagccccagactgaaccccctgagcagcgccagcgccagcccccccctgcccccccccctgcccgccgtgtgcttcagcagcgcccccctgctggacctgcccgccggctacgagctgggcagcagcgccttcgagccctacagctggctggagagaaaggtgggcagcgccagcagctgcaagaaggccaacacctag

SEQ ID NO: 16550 - DNA, 1491 bp, Artificial Sequence
  Description of Artificial Sequence: Synthetic coding sequence
atggccatggagatcgacagcagacccggcggcctgcccggcagcagctgcaacctgggcgccgccagagagcacatgcaggccgtgaccagaaactacatcacccaccccagagtgacctacagaaccgtgtgcagcgtgaacggccccctggtggtgctggacagagtgaagttcgcccagtacgccgagatcgtgcacttcaccctgcccgacggcacccagagaagcggccaggtgctggaggtggccggcaccaaggccatcgtgcaggtgttcgagggcaccagcggcatcgacgccagaaagaccacctgcgagttcaccggcgacatcctgagaacccccgtgagcgaggacatgctgggcagagtgttcaacggcagcggcaagcccatcgacaagggccccgtggtgatggccgaggacttcctggacatcaacggccagcccatcaacccccacagcagaatctaccccgaggagatgatccagaccggcatcagccccatcgacgtgatgaacagcatcgccagaggccagaagatccccatcttcagcgccgccggcctgccccacaacgagatcgccgcccagatctgcagacaggccggcctggtgaagaagagcaaggccgtgctggactaccacgacgacaacttcgccatcgtgttcgccgccatgggcgtgaacatggagaccgccagattcttcaagagcgacttcgagcagaacggcaccatgggcaacgtgtgcctgttcctgaacctggccaacgaccccaccatcgagagaatcatcacccccagactggccctgaccaccgccgagttcctggcctaccagtgcgagaagcacgtgctggtgatcctgaccgacatgagcagctacgccgaggccctgagagaggtgagcgccgccagagaggaggtgcccggcagaagaggcttccccggctacatgtacaccgacctggccaccatctacgagagagccggcagagtggaggacatcacccaccccatccccgacctgaccggcttcatcaccgagggccagatctacgtggacagacagctgcacaacagacagatctacccccccatcaacgtgctgcccagcctgagcagactgatgaagagcgccatcggcgagggcatgaccagaaaggaccacggcgacgtgagcaaccagctgtacgcctgctacgccatcggcaaggacgtgcaggccatgaaggccgtggtgggcgaggaggccctgaccagcgaggacctgctgtacctggagttcctgcagaagttcgagaagaacttcatcaaccagggcccctacgagaacagaagcgtgttcgagagcctggacctgggctggaagctgctgagaatcttccccaaggagatgctgaagagaatcccccaggccgtgatcgacgagttctacagcagagagggcgccctgcaggacctggcccccgacaccgccctgtag

SEQ ID NO: 16551 - DNA, 1467 bp, Artificial Sequence
  Description of Artificial Sequence: Synthetic coding sequence
atgcaggccgtgaccagaaactacatcacccaccccagagtgacctacagaaccgtgtgcagcgtgaacggccccctggtggtgctggacagagtgaagttcgcccagtacgccgagatcgtgcacttcaccctgcccgacggcacccagagaagcggccaggtgctggaggtggccggcaccaaggccatcgtgcaggtgttcgagggcaccagcggcatcgacgccagaaagaccacctgcgagttcaccggcgacatcctgagaacccccgtgagcgaggacatgctgggcagagtgttcaacggcagcggcaagcccatcgacaagggccccgtggtgatggccgaggacttcctggacatcaacggccagcccatcaacccccacagcagaatctaccccgaggagatgatccagaccggcatcagccccatcgacgtgatgaacagcatcgccagaggccagaagatccccatcttcagcgccgccggcctgccccacaacgagatcgccgcccagatctgcagacaggccggcctggtgaagaagagcaaggccgtgctggactaccacgacgacaacttcgccatcgtgttcgccgccatgggcgtgaacatggagaccgccagattcttcaagagcgacttcgagcagaacggcaccatgggcaacgtgtgcctgttcctgaacctggccaacgaccccaccatcgagagaatcatcacccccagactggccctgaccaccgccgagttcctggcctaccagtgcgagaagcacgtgctggtgatcctgaccgacatgagcagctacgccgaggccctgagagaggtgagcgccgccagagaggaggtgcccggcagaagaggcttccccggctacatgtacaccgacctggccaccatctacgagagagccggcagagtggagggcagaggcggcagcatcacccagatccccatcctgaccatgcccaacgacgacatcacccaccccatccccgacctgaccggcttcatcaccgagggccagatctacgtggacagacagctgcacaacagacagatctacccccccatcaacgtgctgcccagcctgagcagactgatgaagagcgccatcggcgagggcatgaccagaaaggaccacggcgacgtgagcaaccagctgtacgcctgctacgccatcggcaaggacgtgcaggccatgaaggccgtggtgggcgaggaggccctgaccagcgaggacctgctgtacctggagttcctgcagaagttcgagaagaacttcatcaaccagggcccctacgagaacagaagcgtgttcgagagcctggacctgggctggaagctgctgagaatcttccccaaggagatgctgaagagaatcccccaggccgtgatcgacgagttctacagcagagagggcgccctgcaggacctggcccccgacaccgccctgtag

SEQ ID NO: 16552 - DNA, 1536 bp, Artificial Sequence
  Description of Artificial Sequence: Synthetic coding sequence
atggccctgagagccatgagaggcatcgtgaacggcgccgcccccgagctgcccgtgcccaccggcggccccgccgtgggcgccagagagcaggccctggccgtgagcagaaactacctgagccagcccagactgacctacaagaccgtgagcggcgtgaacggccccctggtgatcctggaccacgtgaagttccccagatacgccgagatcgtgcacctgaccctgcccgacggcaccaagagaagcggccaggtgctggaggtgagcggcagcaaggccgtggtgcaggtgttcgagggcaccagcggcatcgacgccaagaagaccagctgcgagttcaccggcgacatcctgagaacccccgtgagcgaggacatgctgggcagagtgttcaacggcagcggcaagcccatcgacagaggccccgtggtgctggccgaggacttcctggacatcatgggccagcccatcaacccccagtgcagaatctaccccgaggagatgatccagaccggcatcagcgccatcgacggcatgaacagcatcgccagaggccagaagatccccatcttcagcgccgccggcctgccccacaacgagatcgccgcccagatctgcagacaggccggcctggtgaagaagagcaaggacgtggtggactacagcgaggagaacttcgccatcgtgttcgccgccatgggcgtgaacatggagaccgccagattcttcaagagcgacttcgaggagaacggcagcatggacaacgtgtgcctgttcctgaacctggccaacgaccccaccatcgagagaatcatcacccccagactggccctgaccaccgccgagttcctggcctaccagtgcgagaagcacgtgctggtgatcctgaccgacatgagcagctacgccgaggccctgagagaggtgagcgccgccagagaggaggtgcccggcagaagaggcttccccggctacatgtacaccgacctggccaccatctacgagagagccggcagagtggagggcagaaacggcagcatcacccagatccccatcctgaccatgcccaacgacgacatcacccaccccatccccgacctgaccggctacatcaccgagggccagatctacgtggacagacagctgcacaacagacagatctacccccccatcaacgtgctgcccagcctgagcagactgatgaagagcgccatcggcgagggcatgaccagaaaggaccacgccgacgtgagcaaccagctgtacgcctgctacgccatcggcaaggacgtgcaggccatgaaggccgtggtgggcgaggaggccctgaccagcgacgacctgctgtacctggagttcctgcagaagttcgagagaaacttcatcgcccagggcccctacgagaacagaaccgtgttcgagaccctggacatcggctggcagctgctgagaatcttccccaaggagatgctgaagagaatcccccagagcaccctgagcgagttctaccccagagacagcgccaagcactag

SEQ ID NO: 16553 - DNA, 1158 bp, Artificial Sequence
  Description of Artificial Sequence: Synthetic coding sequence
atgctgggcagagtgttcaacggcagcggcaagcccatcgacagaggccccgtggtgctggccgaggacttcctggacatcatgggccagcccatcaacccccagtgcagaatctaccccgaggagatgatccagaccggcatcagcgccatcgacggcatgaacagcatcgccagaggccagaagatccccatcttcagcgccgccggcctgccccacaacgagatcgccgcccagatctgcagacaggccggcctggtgaagaagagcaaggacgtggtggactacagcgaggagaacttcgccatcgtgttcgccgccatgggcgtgaacatggagaccgccagattcttcaagagcgacttcgaggagaacggcagcatggacaacgtgtgcctgttcctgaacctggccaacgaccccaccatcgagagaatcatcacccccagactggccctgaccaccgccgagttcctggcctaccagtgcgagaagcacgtgctggtgatcctgaccgacatgagcagctacgccgaggccctgagagaggtgagcgccgccagagaggaggtgcccggcagaagaggcttccccggctacatgtacaccgacctggccaccatctacgagagagccggcagagtggagggcagaaacggcagcatcacccagatccccatcctgaccatgcccaacgacgacatcacccaccccatccccgacctgaccggctacatcaccgagggccagatctacgtggacagacagctgcacaacagacagatctacccccccatcaacgtgctgcccagcctgagcagactgatgaagagcgccatcggcgagggcatgaccagaaaggaccacgccgacgtgagcaaccagctgtacgcctgctacgccatcggcaaggacgtgcaggccatgaaggccgtggtgggcgaggaggccctgaccagcgacgacctgctgtacctggagttcctgcagaagttcgagagaaacttcatcgcccagggcccctacgagaacagaaccgtgttcgagaccctggacatcggctggcagctgctgagaatcttccccaaggagatgctgaagagaatcccccagagcaccctgagcgagttctaccccagagacagcgccaagcactag

SEQ ID NO: 16554 - DNA, 1854 bp, Artificial Sequence
  Description of Artificial Sequence: Synthetic coding sequence
atggacttcagcaagctgcccaagatcctggacgaggacaaggagagcaccttcggctacgtgcacggcgtgagcggccccgtggtgaccgcctgcgacatggccggcgccgccatgtacgagctggtgagagtgggccacagcgagctggtgggcgagatcatcagactggagggcgacatggccaccatccaggtgtacgaggagaccagcggcgtgagcgtgggcgaccccgtgctgagaaccggcaagcccctgagcgtggagctgggccccggcatcatgggcgccatcttcgacggcatccagagacccctgagcgacatcagcagccagacccagagcatctacatccccagaggcgtgaacgtgagcgccctgagcagagacatcaagtgggacttcaccccctgcaagaacctgagagtgggcagccacatcaccggcggcgacatctacggcatcgtgagcgagaacagcctgatcaagcacaagatcatgctgccccccagaaacagaggcaccgtgacctacatcgccccccccggcaactacgacaccagcgacgtggtgctggagctggagttcgagggcgtgaaggagaagttcaccatggtgcaggtgtggcccgtgagacaggtgagacccgtgaccgagaagctgcccgccaaccaccccctgctgaccggccagagagtgctggacgccctgttcccctgcgtgcagggcggcaccaccgccatccccggcgccttcggctgcggcaagaccgtgatcagccagagcctgagcaagtacagcaacagcgacgtgatcatctacgtgggctgcggcgagagaggcaacgagatgagcgaggtgctgagagacttccccgagctgaccatggaggtggacggcaaggtggagagcatcatgaagagaaccgccctggtggccaacaccagcaacatgcccgtggccgccagagaggccagcatctacaccggcatcaccctgagcgagtacttcagagacatgggctaccacgtgagcatgatggccgacagcaccagcagatgggccgaggccctgagagagatcagcggcagactggccgagatgcccgccgacagcggctaccccgcctacctgggcgccagactggccagcttctacgagagagccggcagagtgaagtgcctgggcaaccccgagagagagggcagcgtgagcatcgtgggcgccgtgagcccccccggcggcgacttcagcgaccccgtgaccagcgccaccctgggcatcgtgcaggtgttctggggcctggacaagaagctggcccagagaaagcacttccccagcgtgaactggctgatcagctacagcaagtacatgagagccctggacgagtactacgacaagcacttcaccgagttcgtgcccctgagaaccaaggccaaggagatcctgcaggaggaggaggacctggccgagatcgtgcagctggtgggcaaggccagcctggccgagaccgacaagatcaccctggaggtggccaagctgatcaaggacgacttcctgcagcagaacggctacaccccctacgacagattctgccccttctacaagaccgtgggcatgctgagcaacatgatcgccttctacgacatggccagaagagccgtggagaccaccgcccagagcgacaacaagatcacctggagcatcatcagagagcacatgggcgacatcctgtacaagctgagcagcatgaagttcaaggaccccctgaaggacggcgaggccaagatcaagagcgactacgcccagctgctggaggacatgcagaacgccttcagaagcctggaggactag

SEQ ID NO: 16555 - DNA, 666 bp, Artificial Sequence
  Description of Artificial Sequence: Synthetic coding sequence
atggacttcagcaagctgcccaagatcctggacgaggacaaggagagcaccttcggctacgtgcacggcgtgagcggccccgtggtgaccgcctgcgacatggccggcgccgccatgtacgagctggtgagagtgggccacagcgagctggtgggcgagatcatcagactggagggcgacatggccaccatccaggtgtacgaggagaccagcggcgtgagcgtgggcgaccccgtgctgagaaccggcaagcccctgagcgtggagctgggccccggcatcatgggcgccatcttcgacggcatccagagacccctgagcgacatcagcagccagacccagagcatctacatccccagaggcgtgaacgtgagcgccctgagcagagacatcaagtgggacttcaccccctgcaagaacctgagagtgggcagccacatcaccggcggcgacatctacggcatcgtgagcgagaacagcctgatcaagcacaagatcatgctgccccccagaaacagaggcaccgtgacctacatcgccccccccggcaactacgacaccagcgacgtggtgctggagctggagttcgagggcgtgaaggagaagttcaccatggtgcaggtgtggcccgtgagacaggtgagacccgtgaccgagaagctgtag

SEQ ID NO: 16556 - DNA, 1755 bp, Artificial Sequence
  Description of Artificial Sequence: Synthetic coding sequence
atggccggcgccgccatgtacgagctggtgagagtgggccacagcgagctggtgggcgagatcatcagactggagggcgacatggccaccatccaggtgtacgaggagaccagcggcgtgagcgtgggcgaccccgtgctgagaaccggcaagcccctgagcgtggagctgggccccggcatcatgggcgccatcttcgacggcatccagagacccctgagcgacatcagcagccagacccagagcatctacatccccagaggcgtgaacgtgagcgccctgagcagagacatcaagtgggacttcaccccctgcaagaacctgagagtgggcagccacatcaccggcggcgacatctacggcatcgtgagcgagaacagcctgatcaagcacaagatcatgctgccccccagaaacagaggcaccgtgacctacatcgccccccccggcaactacgacaccagcgacgtggtgctggagctggagttcgagggcgtgaaggagaagttcaccatggtgcaggtgtggcccgtgagacaggtgagacccgtgaccgagaagctgcccgccaaccaccccctgctgaccggccagagagtgctggacgccctgttcccctgcgtgcagggcggcaccaccgccatccccggcgccttcggctgcggcaagaccgtgatcagccagagcctgagcaagtacagcaacagcgacgtgatcatctacgtgggctgcggcgagagaggcaacgagatgagcgaggtgctgagagacttccccgagctgaccatggaggtggacggcaaggtggagagcatcatgaagagaaccgccctggtggccaacaccagcaacatgcccgtggccgccagagaggccagcatctacaccggcatcaccctgagcgagtacttcagagacatgggctaccacgtgagcatgatggccgacagcaccagcagatgggccgaggccctgagagagatcagcggcagactggccgagatgcccgccgacagcggctaccccgcctacctgggcgccagactggccagcttctacgagagagccggcagagtgaagtgcctgggcaaccccgagagagagggcagcgtgagcatcgtgggcgccgtgagcccccccggcggcgacttcagcgaccccgtgaccagcgccaccctgggcatcgtgcaggtgttctggggcctggacaagaagctggcccagagaaagcacttccccagcgtgaactggctgatcagctacagcaagtacatgagagccctggacgagtactacgacaagcacttcaccgagttcgtgcccctgagaaccaaggccaaggagatcctgcaggaggaggaggacctggccgagatcgtgcagctggtgggcaaggccagcctggccgagaccgacaagatcaccctggaggtggccaagctgatcaaggacgacttcctgcagcagaacggctacaccccctacgacagattctgccccttctacaagaccgtgggcatgctgagcaacatgatcgccttctacgacatggccagaagagccgtggagaccaccgcccagagcgacaacaagatcacctggagcatcatcagagagcacatgggcgacatcctgtacaagctgagcagcatgaagttcaaggaccccctgaaggacggcgaggccaagatcaagagcgactacgcccagctgctggaggacatgcagaacgccttcagaagcctggaggactag

SEQ ID NO: 16557 - DNA, 1005 bp, Artificial Sequence
  Description of Artificial Sequence: Synthetic coding sequence
atgagcgaggtgctgagagacttccccgagctgaccatggaggtggacggcaaggtggagagcatcatgaagagaaccgccctggtggccaacaccagcaacatgcccgtggccgccagagaggccagcatctacaccggcatcaccctgagcgagtacttcagagacatgggctaccacgtgagcatgatggccgacagcaccagcagatgggccgaggccctgagagagatcagcggcagactggccgagatgcccgccgacagcggctaccccgcctacctgggcgccagactggccagcttctacgagagagccggcagagtgaagtgcctgggcaaccccgagagagagggcagcgtgagcatcgtgggcgccgtgagcccccccggcggcgacttcagcgaccccgtgaccagcgccaccctgggcatcgtgcaggtgttctggggcctggacaagaagctggcccagagaaagcacttccccagcgtgaactggctgatcagctacagcaagtacatgagagccctggacgagtactacgacaagcacttcaccgagttcgtgcccctgagaaccaaggccaaggagatcctgcaggaggaggaggacctggccgagatcgtgcagctggtgggcaaggccagcctggccgagaccgacaagatcaccctggaggtggccaagctgatcaaggacgacttcctgcagcagaacggctacaccccctacgacagattctgccccttctacaagaccgtgggcatgctgagcaacatgatcgccttctacgacatggccagaagagccgtggagaccaccgcccagagcgacaacaagatcacctggagcatcatcagagagcacatgggcgacatcctgtacaagctgagcagcatgaagttcaaggaccccctgaaggacggcgaggccaagatcaagagcgactacgcccagctgctggaggacatgcagaacgccttcagaagcctggaggactag

SEQ ID NO: 16558 - DNA, 246 bp, Artificial Sequence
  Description of Artificial Sequence: Synthetic coding sequence
atggcctaccacggcctgaccgtgcccctgatcgtgatgagcgtgttctggggcttcgtgggcttcctggtgccctggttcatccccaagggccccaacagaggcgtgatcatcaccatgctggtgacctgcagcgtgtgctgctacctgttctggctgatcgccatcctggcccagctgaaccccctgttcggcccccagctgaagaacgagaccatctggtacctgaagtaccactggccctag

SEQ ID NO: 16559 - DNA, 246 bp, Artificial Sequence; identical to SEQ ID NO: 16558
  Description of Artificial Sequence: Synthetic coding sequence

SEQ ID NO: 16560 - DNA, 1413 bp, Artificial Sequence
  Description of Artificial Sequence: Synthetic coding sequence
atgatggccgccatggccaccgccagagtgagaatgggccccagatgcgcccaggccctgtggagaatgccctggctgcccgtgttcctgagcctggccgccgccgccgccgccgccgccgccgagcagcaggtgcccctggtgctgtggagcagcgacagagacctgtgggcccccgccgccgacacccacgagggccacatcaccagcgacctgcagctgagcacctacctggaccccgccctggagctgggccccagaaacgtgctgctgttcctgcaggacaagctgagcatcgaggacttcaccgcctacggcggcgtgttcggcaacaagcaggacagcgccttcagcaacctggagaacgccctggacctggcccccagcagcctggtgctgcccgccgtggactggtacgccgtgagcaccctgaccacctacctgcaggagaagctgggcgccagccccctgcacgtggacctggccaccctgagagagctgaagctgaacgccagcctgcccgccctgctgctgatcagactgccctacaccgccagcagcggcctgatggcccccagagaggtgctgaccggcaacgacgaggtgatcggccaggtgctgagcaccctgaagagcgaggacgtgccctacaccgccgccctgaccgccgtgagacccagcagagtggccagagacgtggccgtggtggccggcggcctgggcagacagctgctgcagaagcagcccgtgagccccgtgatccacccccccgtgagctacaacgacaccgcccccagaatcctgttctgggcccagaacttcagcgtggcctacaaggaccagtgggaggacctgacccccctgaccttcggcgtgcaggagctgaacctgaccggcagcttctggaacgacagcttcgccagactgagcctgacctacgagagactgttcggcaccaccgtgaccttcaagttcatcctggccaacagactgtaccccgtgagcgccagacactggttcaccatggagagactggaggtgcacagcaacggcagcgtggcctacttcaacgccagccaggtgaccggccccagcatctacagcttccactgcgagtacgtgagcagcctgagcaagaagggcagcctgctggtggccagaacccagcccagcccctggcagatgatgctgcaggacttccagatccaggccttcaacgtgatgggcgagcagttcagctacgccagcgactgcgccagcttcttcagccccggcatctggatgggcctgctgaccagcctgttcatgctgttcatcttcacctacggcctgcacatgatcctgagcctgaagaccatggacagattcgacgaccacaagggccccaccatcagcctgacccagatcgtgtag

SEQ ID NO: 16561 - DNA, 822 bp, Artificial Sequence
  Description of Artificial Sequence: Synthetic coding sequence
atgatggccgccatggccaccgccagagtgagaatgggccccagatgcgcccaggccctgtggagaatgccctggctgcccgtgttcctgagcctggccgccgccgccgccgccgccgccgccgagcagcaggtgcccctggtgctgtggagcagcgacagagacctgtgggcccccgccgccgacacccacgagggccacatcaccagcgacctgcagctgagcacctacctggaccccgccctggagctgggccccagaaacgtgctgctgttcctgcaggacaagctgagcatcgaggacttcaccgcctacggcggcgtgttcggcaacaagcaggacagcgccttcagcaacctggagaacgccctggacctggcccccagcagcctggtgctgcccgccgtggactggtacgccgtgagcaccctgaccacctacctgcaggagaagctgggcgccagccccctgcacgtggccagagacgtggccgtggtggccggcggcctgggcagacagctgctgcagaagcagcccgtgagccccgtgatccacccccccgtgagctacaacgacaccgcccccagaatcctgttctgggcccagaacttcagcgtggcctacaaggaccagtgggaggacctgacccccctgaccttcggcgtgcaggagctgaacctgaccggcagcttctggaacgacagcttcgccagattcatcctggccaacagactgtaccccgtgagcgccagacactggttcaccatggagagactggaggtgcacagcaacggcagcgtggcctacttcaacgccagctag

SEQ ID NO: 16562 - DNA, 885 bp, Artificial Sequence
  Description of Artificial Sequence: Synthetic coding sequence
atgaaggccaccagccccgccacctgcagcagcggcctgatggcccccagagaggtgctgaccggcaacgacgaggtgatcggccaggtgctgagcaccctgaagagcgaggacgtgccctacaccgccgccctgaccgccgtgagacccagcagagtggccagagacgtggccgtggtggccggcggcctgggcagacagctgctgcagaagcagcccgtgagccccgtgatccacccccccgtgagctacaacgacaccgcccccagaatcctgttctgggcccagaacttcagcgtggcctacaaggaccagtgggaggacctgacccccctgaccttcggcgtgcaggagctgaacctgaccggcagcttctggaacgacagcttcgccagactgagcctgacctacgagagactgttcggcaccaccgtgaccttcaagttcatcctggccaacagactgtaccccgtgagcgccagacactggttcaccatggagagactggaggtgcacagcaacggcagcgtggcctacttcaacgccagccaggtgaccggccccagcatctacagcttccactgcgagtacgtgagcagcctgagcaagaagggcagcctgctggtggccagaacccagcccagcccctggcagatgatgctgcaggacttccagatccaggccttcaacgtgatgggcgagcagttcagctacgccagcgactgcgccagcttcttcagccccggcatctggatgggcctgctgaccagcctgttcatgctgttcatcttcacctacggcctgcacatgatcctgagcctgaagaccatggacagattcgacgaccacaagggccccaccatcagcctgacccagatcgtgtag

SEQ ID NO: 16563 - DNA, 693 bp, Artificial Sequence
  Description of Artificial Sequence: Synthetic coding sequence
atgatggccgccatggccaccgccagagtgagaatgggccccagatgcgcccaggccctgtggagaatgccctggctgcccgtgttcctgagcctggccgccgccgccgccgccgccgccgccgagcagcaggtgcccctggtgctgtggagcagcgacagagacctgtgggcccccgccgccgacacccacgagggccacatcaccagcgacctgcagctgagcacctacctggaccccgccctggagctgggccccagaaacgtgctgctgttcctgcaggacaagctgagcatcgaggacttcaccgcctacggcggcgtgttcggcaacaagcaggacagcgccttcagcaacctggagaacgccctggacctggcccccagcagcctggtgctgcccgccgtggactggtacgccgtgagcaccctgaccacctacctgcaggagaagctgggcgccagccccctgcacgtggacctggccaccctgagagagctgaagctgaacgccagcctgcccgccctgctgctgatcagactgccctacaccgccagcagcggcctgatggcccccagagaggtgctgaccgacgaggtgatcggccaggtgctgagcaccctgaagagcgaggacgtgccctacaccgccgccctgaccgccgtgagacccagcagagtggccagagactag

SEQ ID NO: 16564 - DNA, 675 bp, Artificial Sequence
  Description of Artificial Sequence: Synthetic coding sequence
atgagactgtggaaggccagagtgctgaagctggtgctgaagaccgccaaggacagcagactgggcctgaacagcaagtggctgagcctgaagctgggcgacgccggcaaccccagaagcctggccatcagattcatcctgaccaactacaacaagctgagcatccagagctggttcagcctgagaagagtggagatcatcagcaacaacagcatccaggccgtgttcaaccccaccggcgtgtacgcccccagcggctacagctacagatgccagagagtgggcagcctgcagcaggaccaggccctgctgctgcccagcgacaccgacgacggcagcagcctgtgggaggtgaccttcatcgacttccagatccagggcttcgccatcaagggcggcagattcaccaaggcccaggactgcgccagcagcttcagccccgccttcctgatcggcctggccatgagcctgatcctgctgctggtgctggcctacgccctgcacatgctgatctacctgagatacctggaccagcagtacgacctgatcgccagccccgcccacttcagccagctgaaggccagagacaccgccgaggagaaggagctgctgagaagccagggcgccgagtgctacaagctgagaagccagcagatcagcaagatctacgtgtag

SEQ ID NO: 16565 - DNA, 675 bp, Artificial Sequence; identical to SEQ ID NO: 16564
  Description of Artificial Sequence: Synthetic coding sequence

SEQ ID NO: 16566 - DNA, 3327 bp, Artificial Sequence
  Description of Artificial Sequence: Synthetic coding sequence
atgttcctgggcctgggcagattcagcagactggtgctgtggttcgccgccttcagaaagctgctgggccaccacggcctggccagcgccaagttcctgtggtgcctgtgcctgctgagcgtgatgagcctgccccagcaggtgtggaccctgccctacaagatcggcgtggtgggcccctgggcctgcgacagcctgttcagcaaggccctgcccgaggtggccgccagactggccatcgagagaatcaacagagaccccagcttcgacctgagctacagcttcgagtacgtgatcctgaacgaggactgccagaccagcagagccctgagcagcttcatcagccaccaccagatggccagcggcttcatcggccccaccaaccccggctactgcgaggccgccagcctgctgggcaacagctgggacaagggcatcttcagctgggcctgcgtgaactacgagctggacaacaagatcagctaccccaccttcagcagaaccctgcccagccccatcagagtgctggtgaccgtgatgaagtacttccagtgggcccacgccggcgtgatcagcagcgacgaggacatctgggtgcacaccgccaacagagtggccagcgccctgagaagccacggcctgcccgtgggcgtggtgctgaccaccggccaggacagccagagcatgagaaaggccctgcagagaatccaccaggccgacagaatcagaatcatcatcatgtgcatgcacagcgccctgatcggcggcgagacccagatgcacctgctggagtgcgcccacgacctgaagatgaccgacggcacctacgtgttcgtgccctacgacgccctgctgtacagcctgccctacaagcacaccccctacagagtgctgagaaacaaccccaagctgagagaggcctacgacgccgtgctgaccatcaccgtggagagccaggagaagaccttctaccaggccttcaccgaggccgccgccagaggcgagatccccgagaagctggagttcgaccaggtgagccccctgttcggcaccatctacaacagcatctacttcatcgcccaggccatgaacaacgccatgaaggagaacggccaggccggcgccgccagcctggtgcagcacagcagaaacatgcagttccacggcttcaaccagctgatgagaaccgacagcaacggcaacggcatcagcgagtacgtgatcctggacaccaacctgaaggagtgggagctgcacagcacctacaccgtggacatggagatggagctgctgagattcggcggcacccccatccacttccccggcggcagaccccccagagccgacgccaagtgctggttcgccgagggcaagatctgccacggcggcatcgaccccgccttcgccatgatggtgtgcctgaccctgctgatcgccctgctgagcatcaacggcttcgcctacttcatcagaagaagaatcaacaagatccagctgatcaagggccccaacagaatcctgctgaccctggaggacgtgaccttcatcaacccccacttcggcagcaagagaggcagcagagccagcgtgagcttccagatcaccagcgaggtgcagagcggcagaagccccagactgagcttcagcagcggcagcctgacccccgccacctacgagaacagcaacatcgccatctacgagggcgactgggtgtggctgaagaagttcagcctgggcgacttcggcgacctgaagagcatcaagagcagagccagcgacgtgttcgagatgatgaaggacctgagacacgagaacatcaaccccctgctgggcttcttctacgacagcggcatgttcgccatcgtgaccgagttctgcagcagaggcagcctggaggacatcctgaccaaccaggacgtgaagctggactggatgttcaagagcagcctgctgctggacctgatcaagggcatgaagtacctgcaccacagagagttcgtgcacggcagactgaagagcagaaactgcgtggtggacggcagattcgtgctgaaggtgaccgactacggcttcaacgacatcctggagatgctgagactgagcgaggaggagagcagcatggaggagctgctgtggaccgcccccgagctgctgagagcccccagaggcagcagactgggcagcttcgccggcgacgtgtacagcttcgccatcatcatgcaggaggtgatggtgagaggcacccccttctgcatgatggacctgcccgcccaggagatcatcaacagactgaagaagcccccccccgtgtacagacccgtggtgccccccgagcacgccccccccgagtgcctgcagctgatgaagcagtgctgggccgaggccgccgagcagagacccaccttcgacgagatcttcaaccagttcaagaccttcaacaagggcaagaagaccaacatcatcgacagcatgctgagaatgctggagcagtacagcagcaacctggaggacctgatcagagagagaaccgaggagctggagatcgagaagcagaagaccgagaagctgctgacccagatgctgccccccagcgtggccgagagcctgaagaagggctgcaccgtggagcccgagggcttcgacctggtgaccctgtacttcagcgacatcgtgggcttcaccaccatcagcgccatgagcgagcccatcgaggtggtggacctgctgaacgacctgtacaccctgttcgacgccatcatcggcagccacgacgtgtacaaggtggagaccatcggcgacgcctacatggtggccagcggcctgcccaagagaaacggcagcagacacgccgccgagatcgccaacatgagcctggacatcctgagcagcgtgggcaccttcaagatgagacacatgcccgaggtgcccgtgagaatcagaatcggcctgcacagcggccccgtggtggccggcgtggtgggcctgaccatgcccagatactgcctgttcggcgacaccgtgaacaccgccagcagaatggagagcaccggcctgccctacagaatccacgtgagcctgagcaccgtgaccatcctgcagaacctgagcgagggctacgaggtggagctgagaggcagaaccgagctgaagggcaagggcaccgaggagaccttctggctgatcggcaagaagggcttcatgaagcccctgcccgtgcccccccccgtggacaaggacggccaggtgggccacggcctgcagcccgtggagatcgccgccttccagagaagaaaggccgagagacagctggtgagaaacaagccctag

SEQ ID NO: 16567 - DNA, 1062 bp, Artificial Sequence
  Description of Artificial Sequence: Synthetic coding sequence
atgagaagacagctgagaagcagaagagcccccagcttcccctacagctacagatacagactggacgaccccgacgaggccaaccagaactacctggccgacgaggaggaggaggccgaggaggaggccagagtgaccgtggtgcccaagagcgaggaggaggaggaggaggaggagaaggaggaggaggaggaggaggagaaggaggaggaggagggccagggccagcccaccggcaacgcctggtggcagaagctgcagatcatgagcgagtacctgtgggaccccgagagaagaatgttcctggccagaaccggcctgatcctgctgatctacttcttcttctacgccagcctggccgccgtgatcaccctgtgcatgtacaccctgttcctgaccatcagcccctacatccccaccttcaccgagagagtgaagccccccggcgtgatgatcagacccttcgcccacagcctgaacttcaacttcaacgtgagcgagcccgacacctggcagcactacgtgatcagcctgaacggcttcctgcagggctacaacgacagcctgcaggaggagatgaacgtggactgcccccccggccagtacttcatccaggacggcaacgaggacgaggacaagaaggcctgccagttcaagagaagcttcctgaagaactgcagcggcctggaggaccccaccttcggctacagcaccggccagccctgcatcctgctgaagatgaacagaatcgtgggcttcagacccgagctgggcgaccccgtgaaggtgagctgcaaggtgcagagaggcgacgagaacgacatcagaagcatcagctactaccccgagagcgccagcttcgacctgagatactacccctactacggcaagctgacccacgtgaactacaccagccccctggtggccatgcacttcaccgacgtggtgaagaaccaggccgtgcccgtgcagtgccagctgaagggcaagggcgtgatcaacgacgtgatcaacgacagattcgtgggcagagtgatcttcaccctgaacatcgagacctag

SEQ ID NO: 16568 - DNA, 945 bp, Artificial Sequence
  Description of Artificial Sequence: Synthetic coding sequence
atgagaagacagctgagaagcagaagagcccccagcttcccctacagctacagatacagactggacgaccccgacgaggccaaccagaactacctggccgacgaggaggaggaggccgaggaggaggccagagtgaccgtggtgcccaagagcgaggaggaggaggaggaggaggagaaggaggaggaggaggaggaggagaaggaggaggaggagggccagggccagcccaccggcaacgcctggtggcagaagctgcagatcatgagcgagtacctgtgggaccccgagagaagaatgttcctggccagaaccggccagagctggagagtgatgatcagacccttcgcccacagcctgaacttcaacttcaacgtgagcgagcccgacacctggcagcactacgtgatcagcctgaacggcttcctgcagggctacaacgacagcctgcaggaggagatgaacgtggactgcccccccggccagtacttcatccaggacggcaacgaggacgaggacaagaaggcctgccagttcaagagaagcttcctgaagaactgcagcggcctggaggaccccaccttcggctacagcaccggccagccctgcatcctgctgaagatgaacagaatcgtgggcttcagacccgagctgggcgaccccgtgaaggtgagctgcaaggtgcagagaggcgacgagaacgacatcagaagcatcagctactaccccgagagcgccagcttcgacctgagatactacccctactacggcaagctgacccacgtgaactacaccagccccctggtggccatgcacttcaccgacgtggtgaagaaccaggccgtgcccgtgcagtgccagctgaagggcaagggcgtgatcaacgacgtgatcaacgacagattcgtgggcagagtgatcttcaccctgaacatcgagacctag

SEQ ID NO: 16569 - DNA, 381 bp, Artificial Sequence
  Description of Artificial Sequence: Synthetic coding sequence
atggtggacgagaacgacatcagagccctgaacgtgagacactacagagaccacatcggcgtggtgagccaggagcccgtgctgttcggcaccaccatcagcaacaacatcaagtacggcagagacgacgtgaccgacgaggagatggagagagccgccagagaggccaacgcctacgacttcatcatggagttccccaacaagttcaacaccctggtgggcgagaagggcgcccagatgagcggcggccagaagcagagaatcgccatcgccagagccctggtgagaaaccccaagatcctgatcctggacgaggccaccagcgccctggacagcgagagcaagagcgccgtgcaggccgccctggagaagaagaagtag

SEQ ID NO: 16570 - DNA, 2439 bp, Artificial Sequence
  Description of Artificial Sequence: Synthetic coding sequence
atggtggacgagaacgacatcagagccctgaacgtgagacactacagagaccacatcggcgtggtgagccaggagcccgtgctgttcggcaccaccatcagcaacaacatcaagtacggcagagacgacgtgaccgacgaggagatggagagagccgccagagaggccaacgcctacgacttcatcatggagttccccaacaagttcaacaccctggtgggcgagaagggcgcccagatgagcggcggccagaagcagagaatcgccatcgccagagccctggtgagaaaccccaagatcctgatcctggacgaggccaccagcgccctggacagcgagagcaagagcgccgtgcaggccgccctggagaaggccagcaagggcagaaccaccatcgtggtggcccacagactgagcaccatcagaagcgccgacctgatcgtgaccctgaaggacggcatgctggccgagaagggcgcccacgccgagctgatggccaagagaggcctgtactacagcctggtgatgagccaggacatcaagaaggccgacgagcagatggagagcatgacctacagcaccgagagaaagaccaacagcctgcccctgcacagcgtgaagagcatcaagagcgacttcatcgacaaggccgaggagagcacccagagcaaggagatcagcctgcccgaggtgagcctgctgaagatcctgaagctgaacaagcccgagtggcccttcgtggtgctgggcaccctggccagcgtgctgaacggcaccgtgcaccccgtgttcagcatcatcttcgccaagatcatcaccatgttcggcaacaacgacaagaccaccctgaagcacgacgccgagatctacagcatgatcttcgtgatcctgggcgtgatctgcttcgtgagctacttcatgcagggcctgttctacggcagagccggcgagatcctgaccatgagactgagacacctggccttcaaggccatgctgtaccaggacatcgcctggttcgacgagaaggagaacagcaccggcggcctgaccaccatcctggccatcgacatcgcccagatccagggcgccaccggcagcagaatcggcgtgctgacccagaacgccaccaacatgggcctgagcgtgatcatcagcttcatctacggctgggagatgaccttcctgatcctgagcatcgcccccgtgctggccgtgaccggcatgatcgagaccgccgccatgaccggcttcgccaacaaggacaagcaggagctgaagcacgccggcaagatcgccaccgaggccctggagaacatcagaaccatcgtgagcctgaccagagagaaggccttcgagcagatgtacgaggagatgctgcagacccagcacagaaacaccagcaagaaggcccagatcatcggcagctgctacgccttcagccacgccttcatctacttcgcctacgccgccggcttcagattcggcgcctacctgatccaggccggcagaatgacccccgagggcatgttcatcgtgttcaccgccatcgcctacggcgccatggccatcggcgagaccctggtgctggcccccgagtacagcaaggccaagagcggcgccgcccacctgttcgccctgctggagaagaagcccaacatcgacagcagaagccaggagggcaagaagcccgacacctgcgagggcaacctggagttcagagaggtgagcttcttctacccctgcagacccgacgtgttcatcctgagaggcctgagcctgagcatcgagagaggcaagaccgtggccttcgtgggcagcagcggctgcggcaagagcaccagcgtgcagctgctgcagagactgtacgaccccgtgcagggccaggtgctgttcgacggcgtggacgccaaggagctgaacgtgcagtggctgagaagccagatcgccatcgtgccccaggagcccgtgctgttcaactgcagcatcgccgagaacatcgcctacggcgacaacagcagagtggtgcccctggacgagatcaaggaggccgccaacgccgccaacatccacagcttcatcgagggcctgcccgagaagtacaacacccaggtgggcctgaagggcgcccagctgagcggcggccagaagcagagactggccatcgccagagccctgctgcagaagcccaagatcctgctgctggacgaggccaccagcgccctggacaacgacagcgagaaggtggtgcagcacgccctggacaaggccagaaccggcagaacctgcctggtggtgacccacagactgagcgccatccagaacgccgacctgatcgtggtgctgcacaacggcaagatcaaggagcagggcacccaccaggagctgctgagaaacagagacatctacttcaagctggtgaacgcccagagcgtgcagtag

SEQ ID NO: 16571 - DNA, 3774 bp, Artificial Sequence
  Description of Artificial Sequence: Synthetic coding sequence
atggagaacagcgagagagccgaggagatgcaggagaactaccagagaaacggcaccgccgaggagcagcccaagctgagaaaggaggccgtgggcagcatcgagatcttcagattcgccgacggcctggacatcaccctgatgatcctgggcatcctggccagcctggtgaacggcgcctgcctgcccctgatgcccctggtgctgggcgagatgagcgacaacctgatcagcggctgcctggtgcagaccaacaccaccaactaccagaactgcacccagagccaggagaagctgaacgaggacatgaccctgctgaccctgtactacgtgggcatcggcgtggccgccctgatcttcggctacatccagatcagcctgtggatcatcaccgccgccagacagaccaagagaatcagaaagcagttcttccacagcgtgctggcccaggacatcggctggttcgacagctgcgacatcggcgagctgaacaccagaatgaccgacgacatcgacaagatcagcgacggcatcggcgacaagatcgccctgctgttccagaacatgagcaccttcagcatcggcctggccgtgggcctggtgaagggctggaagctgaccctggtgaccctgagcaccagccccctgatcatggccagcgccgccgcctgcagcagaatggtgatcagcctgaccagcaaggagctgagcgcctacagcaaggccggcgccgtggccgaggaggtgctgagcagcatcagaaccgtgatcgccttcagagcccaggagaaggagctgcagagatacacccagaacctgaaggacgccaaggacttcggcatcaagagaaccatcgccagcaaggtgagcctgggcgccgtgtacttcttcatgaacggcacctacggcctggccttctggtacggcaccagcctgatcctgaacggcgagcccggctacaccatcggcaccgtgctggccgtgttcttcagcgtgatccacagcagctactgcatcggcgccgccgtgccccacttcgagaccttcgccatcgccagaggcgccgccttccacatcttccaggtgatcgacaagaagcccagcatcgacaacttcagcaccgccggctacaagcccgagagcatcgagggcaccgtggagttcaagaacgtgagcttcaactaccccagcagacccagcatcaagatcctgaagggcctgaacctgagaatcaagagcggcgagaccgtggccctggtgggcctgaacggcagcggcaagagcaccgtggtgcagctgctgcagagactgtacgaccccgacgacggcttcatcatggtggacgagaacgacatcagagccctgaacgtgagacactacagagaccacatcggcgtggtgagccaggagcccgtgctgttcggcaccaccatcagcaacaacatcaagtacggcagagacgacgtgaccgacgaggagatggagagagccgccagagaggccaacgcctacgacttcatcatggagttccccaacaagttcaacaccctggtgggcgagaagggcgcccagatgagcggcggccagaagcagagaatcgccatcgccagagccctggtgagaaaccccaagatcctgatcctggacgaggccaccagcgccctggacagcgagagcaagagcgccgtgcaggccgccctggagaaggccagcaagggcagaaccaccatcgtggtggcccacagactgagcaccatcagaagcgccgacctgatcgtgaccctgaaggacggcatgctggccgagaagggcgcccacgccgagctgatggccaagagaggcctgtactacagcctggtgatgagccaggacatcaagaaggccgacgagcagatggagagcatgacctacagcaccgagagaaagaccaacagcctgcccctgcacagcgtgaagagcatcaagagcgacttcatcgacaaggccgaggagagcacccagagcaaggagatcagcctgcccgaggtgagcctgctgaagatcctgaagctgaacaagcccgagtggcccttcgtggtgctgggcaccctggccagcgtgctgaacggcaccgtgcaccccgtgttcagcatcatcttcgccaagatcatcaccatgttcggcaacaacgacaagaccaccctgaagcacgacgccgagatctacagcatgatcttcgtgatcctgggcgtgatctgcttcgtgagctacttcatgcagggcctgttctacggcagagccggcgagatcctgaccatgagactgagacacctggccttcaaggccatgctgtaccaggacatcgcctggttcgacgagaaggagaacagcaccggcggcctgaccaccatcctggccatcgacatcgcccagatccagggcgccaccggcagcagaatcggcgtgctgacccagaacgccaccaacatgggcctgagcgtgatcatcagcttcatctacggctgggagatgaccttcctgatcctgagcatcgcccccgtgctggccgtgaccggcatgatcgagaccgccgccatgaccggcttcgccaacaaggacaagcaggagctgaagcacgccggcaagatcgccaccgaggccctggagaacatcagaaccatcgtgagcctgaccagagagaaggccttcgagcagatgtacgaggagatgctgcagacccagcacagaaacaccagcaagaaggcccagatcatcggcagctgctacgccttcagccacgccttcatctacttcgcctacgccgccggcttcagattcggcgcctacctgatccaggccggcagaatgacccccgagggcatgttcatcgtgttcaccgccatcgcctacggcgccatggccatcggcgagaccctggtgctggcccccgagtacagcaaggccaagagcggcgccgcccacctgttcgccctgctggagaagaagcccaacatcgacagcagaagccaggagggcaagaagcccgacacctgcgagggcaacctggagttcagagaggtgagcttcttctacccctgcagacccgacgtgttcatcctgagaggcctgagcctgagcatcgagagaggcaagaccgtggccttcgtgggcagcagcggctgcggcaagagcaccagcgtgcagctgctgcagagactgtacgaccccgtgcagggccaggtgctgttcgacggcgtggacgccaaggagctgaacgtgcagtggctgagaagccagatcgccatcgtgccccaggagcccgtgctgttcaactgcagcatcgccgagaacatcgcctacggcgacaacagcagagtggtgcccctggacgagatcaaggaggccgccaacgccgccaacatccacagcttcatcgagggcctgcccgagaagtacaacacccaggtgggcctgaagggcgcccagctgagcggcggccagaagcagagactggccatcgccagagccctgctgcagaagcccaagatcctgctgctggacgaggccaccagcgccctggacaacgacagcgagaaggtggtgcagcacgccctggacaaggccagaaccggcagaacctgcctggtggtgacccacagactgagcgccatccagaacgccgacctgatcgtggtgctgcacaacggcaagatcaaggagcagggcacccaccaggagctgctgagaaacagagacatctacttcaagctggtgaacgcccagagcgtgcagtag

SEQ ID NO: 16572 - DNA, 396 bp, Artificial Sequence
  Description of Artificial Sequence: Synthetic coding sequence
atggtggacgagaacgacatcagagccctgaacgtgagacactacagagaccacatcggcgtggtgagccaggagcccgtgctgttcggcaccaccatcagcaacaacatcaagtacggcagagacgacgtgaccgacgaggagatggagagagccgccagagaggccaacgcctacgacttcatcatggagttccccaacaagttcaacaccctggtgggcgagaagggcgcccagatgagcggcggccagaagcagagaatcgccatcgccagagccctggtgagaaaccccaagatcctgatcctggacgaggccaccagcgccctggacagcgagagcaagagcgccgtgcaggccgccctggagaaggacacccccagatacagcttctag

SEQ ID NO: 16573 - DNA, 4749 bp, Artificial Sequence
  Description of Artificial Sequence: Synthetic coding sequence
atgcccctggccttctgcggcagcgagaaccacagcgccgcctacagagtggaccagggcgtgctgaacaacggctgcttcgtggacgccctgaacgtggtgccccacgtgttcctgctgttcatcaccttccccatcctgttcatcggctggggcagccagagcagcaaggtgcacatccaccacagcacctggctgcacttccccggccacaacctgagatggatcctgaccttcatgctgctgttcgtgctggtgtgcgagatcgccgagggcatcctgagcgacggcgtgaccgagagccaccacctgcacctgtacatgcccgccggcatggccttcatggccgccgtgaccagcgtggtgtactaccacaacatcgagaccagcaacttccccaagctgctgatcgccctgctggtgtactggaccctggccttcatcaccaagaccatcaagttcgtgaagttcctggaccacgccatcggcttcagccagctgagattctgcctgaccggcctgctggtgatcctgtacggcatgctgctgctggtggaggtgaacgtgatcagagtgagaagatacatcttcttcaagacccccagagaggtgaagccccccgaggacctgcaggacctgggcgtgagattcctgcagcccttcgtgaacctgctgagcaagggcacctactggtggatgaacgccttcatcaagaccgcccacaagaagcccatcgacctgagagccatcggcaagctgcccatcgccatgagagccctgaccaactaccagagactgtgcgaggccttcgacgcccaggtgagaaaggacatccagggcacccagggcgccagagccatctggcaggccctgagccacgccttcggcagaagactggtgctgagcagcaccttcagaatcctggccgacctgctgggcttcgccggccccctgtgcatcttcggcatcgtggaccacctgggcaaggagaacgacgtgttccagcccaagacccagttcctgggcgtgtacttcgtgagcagccaggagttcctggccaacgcctacgtgctggccgtgctgctgttcctggccctgctgctgcagagaaccttcctgcaggccagctactacgtggccatcgagaccggcatcaacctgagaggcgccatccagaccaagatctacaacaagatcatgcacctgagcaccagcaacctgagcatgggcgagatgaccgccggccagatctgcaacctggtggccatcgacaccaaccagctgatgtggttcttcttcctgtgccccaacctgtgggccatgcccgtgcagatcatcgtgggcgtgatcctgctgtactacatcctgggcgtgagcgccctgatcggcgccgccgtgatcatcctgctggcccccgtgcagtacttcgtggccaccaagctgagccaggcccagagaagcaccctggagtacagcaacgagagactgaagcagaccaacgagatgctgagaggcatcaagctgctgaagctgtacgcctgggagaacatcttcagaaccagagtggagaccaccagaagaaaggagatgaccagcctgagagccttcgccatctacaccagcatcagcatcttcatgaacaccgccatccccatcgccgccgtgctgatcaccttcgtgggccacgtgagcttcttcaaggaggccgacttcagccccagcgtggccttcgccagcctgagcctgttccacatcctggtgacccccctgttcctgctgagcagcgtggtgagaagcaccgtgaaggccctggtgagcgtgcagaagctgagcgagttcctgagcagcgccgagatcagagaggagcagtgcgccccccacgagcccaccccccagggccccgccagcaagtaccaggccgtgcccctgagagtggtgaacagaaagagacccgccagagaggactgcagaggcctgaccggccccctgcagagcctggtgcccagcgccgacggcgacgccgacaactgctgcgtgcagatcatgggcggctacttcacctggacccccgacggcatccccaccctgagcaacatcaccatcagaatccccagaggccagctgaccatgatcgtgggccaggtgggctgcggcaagagcagcctgctgctggccgccctgggcgagatgcagaaggtgagcggcgccgtgttctggagcagcagcctgcccgacagcgagatcggcgaggaccccagccccgagagagagaccgccaccgacctggacatcagaaagagaggccccgtggcctacgccagccagaagccctggctgctgaacgccaccgtggaggagaacatcatcttcgagagccccttcaacaagcagagatacaagatggtgatcgaggcctgcagcctgcagcccgacatcgacatcctgccccacggcgaccagacccagatcggcgagagaggcatcaacctgagcggcggccagagacagagaatcagcgtggccagagccctgtaccagcacgccaacgtggtgttcctggacgaccccttcagcgccctggacatccacctgagcgaccacctgatgcaggccggcatcctggagctgctgagagacgacaagagaaccgtggtgctggtgacccacaagctgcagtacctgccccacgccgactggatcatcgccatgaaggacggcaccatccagagagagggcaccctgaaggacttccagagaagcgagtgccagctgttcgagcactggaagaccctgatgaacagacaggaccaggagctggagaaggagaccgtgaccgagagaaaggccaccgagcccccccagggcctgagcagagccatgagcagcagagacggcctgctgcaggacgaggaggaggaggaggaggaggccgccgagagcgaggaggacgacaacctgagcagcatgctgcaccagagagccgagatcccctggagagcctgcgccaagtacctgagcagcgccggcatcctgctgctgagcctgctggtgttcagccagctgctgaagcacatggtgctggtggccatcgactactggctggccaagtggaccgacagcgccctgaccctgacccccgccgccagaaactgcagcctgagccaggagtgcaccctggaccagaccgtgtacgccatggtgttcaccgtgctgtgcagcctgggcatcgtgctgtgcctggtgaccagcgtgaccgtggagtggaccggcctgaaggtggccaagagactgcacagaagcctgctgaacagaatcatcctggcccccatgagattcttcgagaccacccccctgggcagcatcctgaacagattcagcagcgactgcaacaccatcgaccagcacatccccagcaccctggagtgcctgagcagaagcaccctgctgtgcgtgagcgccctggccgtgatcagctacgtgacccccgtgttcctggtggccctgctgcccctggccatcgtgtgctacttcatccagaagtacttcagagtggccagcagagacctgcagcagctggacgacaccacccagctgcccctgctgagccacttcgccgagaccgtggagggcctgaccaccatcagagccttcagatacgaggccagattccagcagaagctgctggagtacaccgacagcaacaacatcgccagcctgttcctgaccgccgccaacagatggctggaggtgagaatggagtacatcggcgcctgcgtggtgctgatcgccgccgtgaccagcatcagcaacagcctgcacagagagctgagcgccggcctggtgggcctgggcctgacctacgccctgatggtgagcaactacctgaactggatggtgagaaacctggccgacatggagctgcagctgggcgccgtgaagagaatccacggcctgctgaagaccgaggccgagagctacgagggcctgctggcccccagcctgatccccaagaactggcccgaccagggcaagatccagatccagaacctgagcgtgagatacgacagcagcctgaagcccgtgctgaagcacgtgaacgccctgatcgcccccggccagaagatcggcatctgcggcagaaccggcagcggcaagagcagcttcagcctggccttcttcagaatggtggacaccttcgagggccacatcatcatcgacggcatcgacatcgccaagctgcccctgcacaccctgagaagcagactgagcatcatcctgcaggaccccgtgctgttcagcggcaccatcagattcaacctggaccccgagagaaagtgcagcgacagcaccctgtgggaggccctggagatcgcccagctgaagctggtggtgaaggccctgcccggcggcctggacgccatcatcaccgagggcggcgagaacttcagccagggccagagacagctgttctgcctggccagagccttcgtgagaaagaccagcatcttcatcatggacgaggccaccgccagcatcgacatggccaccgagaacatcctgcagaaggtggtgatgaccgccttcgccgacagaaccgtggtgaccatcgcccacagagtgcacaccatcctgagcgccgacctggtgatcgtgctgaagagaggcgccatcctggagttcgacaagcccgagaagctgctgagcagaaaggacagcgtgttcgccagcttcgtgagagccgacaagtag

SEQ ID NO: 16574 - DNA, 3036 bp, Artificial Sequence
  Description of Artificial Sequence: Synthetic coding sequence
agaagccagctgagccccagccccgccagagccagagccgccatgcccctggccttctgcggcagcgagaaccacagcgccgcctacagagtggaccagggcgtgctgaacaacggctgcttcgtggacgccctgaacgtggtgccccacgtgttcctgctgttcatcaccttccccatcctgttcatcggctggggcagccagagcagcaaggtgcacatccaccacagcacctggctgcacttccccggccacaacctgagatggatcctgaccttcatgctgctgttcgtgctggtgtgcgagatcgccgagggcatcctgagcgacggcgtgaccgagagccaccacctgcacctgtacatgcccgccggcatggccttcatggccgccgtgaccagcgtggtgtactaccacaacatcgagaccagcaacttccccaagctgctgatcgccctgctggtgtactggaccctggccttcatcaccaagaccatcaagttcgtgaagttcctggaccacgccatcggcttcagccagctgagattctgcctgaccggcctgctggtgatcctgtacggcatgctgctgctggtggaggtgaacgtgatcagagtgagaagatacatcttcttcaagacccccagagaggtgaagccccccgaggacctgcaggacctgggcgtgagattcctgcagcccttcgtgaacctgctgagcaagggcacctactggtggatgaacgccttcatcaagaccgcccacaagaagcccatcgacctgagagccatcggcaagctgcccatcgccatgagagccctgaccaactaccagagactgtgcgaggccttcgacgcccaggtgagaaaggacatccagggcacccagggcgccagagccatctggcaggccctgagccacgccttcggcagaagactggtgctgagcagcaccttcagaatcctggccgacctgctgggcttcgccggccccctgtgcatcttcggcatcgtggaccacctgggcaaggagaacgacgtgttccagcccaagacccagttcctgggcgtgtacttcgtgagcagccaggagttcctggccaacgcctacgtgctggccgtgctgctgttcctggccctgctgctgcagagaaccttcctgcaggccagctactacgtggccatcgagaccggcatcaacctgagaggcgccatccagaccaagatctacaacaagatcatgcacctgagcaccagcaacctgagcatgggcgagatgaccgccggccagatctgcaacctggtggccatcgacaccaaccagctgatgtggttcttcttcctgtgccccaacctgtgggccatgcccgtgcagatcatcgtgggcgtgatcctgctgtactacatcctgggcgtgagcgccctgatcggcgccgccgtgatcatcctgctggcccccgtgcagtacttcgtggccaccaagctgagccaggcccagagaagcaccctggagtacagcaacgagagactgaagcagaccaacgagatgctgagaggcatcaagctgctgaagctgtacgcctgggagaacatcttcagaaccagagtggagaccaccagaagaaaggagatgaccagcctgagagccttcgccatctacaccagcatcagcatcttcatgaacaccgccatccccatcgccgccgtgctgatcaccttcgtgggccacgtgagcttcttcaaggaggccgacttcagccccagcgtggccttcgccagcctgagcctgttccacatcctggtgacccccctgttcctgctgagcagcgtggtgagaagcaccgtgaaggccctggtgagcgccgagatcagagaggagcagtgcgccccccacgagcccaccccccagggccccgccagcaagtaccaggccgtgcccctgagagtggtgaacagaaagagacccgccagagaggactgcagaggcctgaccggccccctgcagagcctggtgcccagcgccgacggcgacgccgacaactgctgcgtgcagatcatgggcggctacttcacctggacccccgacggcatccccaccctgagcaacatcaccatcagaatccccagaggccagctgaccatgatcgtgggccaggtgggctgcggcaagagcagcctgctgctggccgccctgggcgagatgcagaaggtgagcggcgccgtgttctggagcagcctgcccgacagcgagatcggcgaggaccccagccccgagagagagaccgccaccgacctggacatcagaaagagaggccccgtggcctacgccagccagaagccctggctgctgaacgccaccgtggaggagaacatcatcttcgagagccccttcaacaagcagagatacaagatggtgatcgaggcctgcagcctgcagcccgacatcgacatcctgccccacggcgaccagacccagatcggcgagagaggcatcaacctgagcggcggccagagacagagaatcagcgtggccagagccctgtaccagcacgccaacgtggtgttcctggacgaccccttcagcgccctggacatccacctgagcgaccacctgatgcaggccggcatcctggagctgctgagagacgacaagagaaccgtggtgctggtgacccacaagctgcagtacctgccccacgccgactggatcatcgccatgaaggacggcaccatccagagagagggcaccctgaaggacttccagagaagcgagtgccagctgttcgagcactggaagaccctgatgaacagacaggaccaggagctggagaagagaagacagctgagagccagaagaatgaccacctgcagaccctgctgcaccagcgtgctgagaagccacggcgagcccgcccccagcacctgccccccccccgccagctgcagctgcagatgctggagcagccacagctgcagcagcacctggagctggtggcccagcaccaccggctggcccagcggccccaccgccccctag

SEQ ID NO: 16575 - DNA, 4746 bp, Artificial Sequence
  Description of Artificial Sequence: Synthetic coding sequence
atgcccctggccttctgcggcagcgagaaccacagcgccgcctacagagtggaccagggcgtgctgaacaacggctgcttcgtggacgccctgaacgtggtgccccacgtgttcctgctgttcatcaccttccccatcctgttcatcggctggggcagccagagcagcaaggtgcacatccaccacagcacctggctgcacttccccggccacaacctgagatggatcctgaccttcatgctgctgttcgtgctggtgtgcgagatcgccgagggcatcctgagcgacggcgtgaccgagagccaccacctgcacctgtacatgcccgccggcatggccttcatggccgccgtgaccagcgtggtgtactaccacaacatcgagaccagcaacttccccaagctgctgatcgccctgctggtgtactggaccctggccttcatcaccaagaccatcaagttcgtgaagttcctggaccacgccatcggcttcagccagctgagattctgcctgaccggcctgctggtgatcctgtacggcatgctgctgctggtggaggtgaacgtgatcagagtgagaagatacatcttcttcaagacccccagagaggtgaagccccccgaggacctgcaggacctgggcgtgagattcctgcagcccttcgtgaacctgctgagcaagggcacctactggtggatgaacgccttcatcaagaccgcccacaagaagcccatcgacctgagagccatcggcaagctgcccatcgccatgagagccctgaccaactaccagagactgtgcgaggccttcgacgcccaggtgagaaaggacatccagggcacccagggcgccagagccatctggcaggccctgagccacgccttcggcagaagactggtgctgagcagcaccttcagaatcctggccgacctgctgggcttcgccggccccctgtgcatcttcggcatcgtggaccacctgggcaaggagaacgacgtgttccagcccaagacccagttcctgggcgtgtacttcgtgagcagccaggagttcctggccaacgcctacgtgctggccgtgctgctgttcctggccctgctgctgcagagaaccttcctgcaggccagctactacgtggccatcgagaccggcatcaacctgagaggcgccatccagaccaagatctacaacaagatcatgcacctgagcaccagcaacctgagcatgggcgagatgaccgccggccagatctgcaacctggtggccatcgacaccaaccagctgatgtggttcttcttcctgtgccccaacctgtgggccatgcccgtgcagatcatcgtgggcgtgatcctgctgtactacatcctgggcgtgagcgccctgatcggcgccgccgtgatcatcctgctggcccccgtgcagtacttcgtggccaccaagctgagccaggcccagagaagcaccctggagtacagcaacgagagactgaagcagaccaacgagatgctgagaggcatcaagctgctgaagctgtacgcctgggagaacatcttcagaaccagagtggagaccaccagaagaaaggagatgaccagcctgagagccttcgccatctacaccagcatcagcatcttcatgaacaccgccatccccatcgccgccgtgctgatcaccttcgtgggccacgtgagcttcttcaaggaggccgacttcagccccagcgtggccttcgccagcctgagcctgttccacatcctggtgacccccctgttcctgctgagcagcgtggtgagaagcaccgtgaaggccctggtgagcgtgcagaagctgagcgagttcctgagcagcgccgagatcagagaggagcagtgcgccccccacgagcccaccccccagggccccgccagcaagtaccaggccgtgcccctgagagtggtgaacagaaagagacccgccagagaggactgcagaggcctgaccggccccctgcagagcctggtgcccagcgccgacggcgacgccgacaactgctgcgtgcagatcatgggcggctacttcacctggacccccgacggcatccccaccctgagcaacatcaccatcagaatccccagaggccagctgaccatgatcgtgggccaggtgggctgcggcaagagcagcctgctgctggccgccctgggcgagatgcagaaggtgagcggcgccgtgttctggagcagcctgcccgacagcgagatcggcgaggaccccagccccgagagagagaccgccaccgacctggacatcagaaagagaggccccgtggcctacgccagccagaagccctggctgctgaacgccaccgtggaggagaacatcatcttcgagagccccttcaacaagcagagatacaagatggtgatcgaggcctgcagcctgcagcccgacatcgacatcctgccccacggcgaccagacccagatcggcgagagaggcatcaacctgagcggcggccagagacagagaatcagcgtggccagagccctgtaccagcacgccaacgtggtgttcctggacgaccccttcagcgccctggacatccacctgagcgaccacctgatgcaggccggcatcctggagctgctgagagacgacaagagaaccgtggtgctggtgacccacaagctgcagtacctgccccacgccgactggatcatcgccatgaaggacggcaccatccagagagagggcaccctgaaggacttccagagaagcgagtgccagctgttcgagcactggaagaccctgatgaacagacaggaccaggagctggagaaggagaccgtgaccgagagaaaggccaccgagcccccccagggcctgagcagagccatgagcagcagagacggcctgctgcaggacgaggaggaggaggaggaggaggccgccgagagcgaggaggacgacaacctgagcagcatgctgcaccagagagccgagatcccctggagagcctgcgccaagtacctgagcagcgccggcatcctgctgctgagcctgctggtgttcagccagctgctgaagcacatggtgctggtggccatcgactactggctggccaagtggaccgacagcgccctgaccctgacccccgccgccagaaactgcagcctgagccaggagtgcaccctggaccagaccgtgtacgccatggtgttcaccgtgctgtgcagcctgggcatcgtgctgtgcctggtgaccagcgtgaccgtggagtggaccggcctgaaggtggccaagagactgcacagaagcctgctgaacagaatcatcctggcccccatgagattcttcgagaccacccccctgggcagcatcctgaacagattcagcagcgactgcaacaccatcgaccagcacatccccagcaccctggagtgcctgagcagaagcaccctgctgtgcgtgagcgccctggccgtgatcagctacgtgacccccgtgttcctggtggccctgctgcccctggccatcgtgtgctacttcatccagaagtacttcagagtggccagcagagacctgcagcagctggacgacaccacccagctgcccctgctgagccacttcgccgagaccgtggagggcctgaccaccatcagagccttcagatacgaggccagattccagcagaagctgctggagtacaccgacagcaacaacatcgccagcctgttcctgaccgccgccaacagatggctggaggtgagaatggagtacatcggcgcctgcgtggtgctgatcgccgccgtgaccagcatcagcaacagcctgcacagagagctgagcgccggcctggtgggcctgggcctgacctacgccctgatggtgagcaactacctgaactggatggtgagaaacctggccgacatggagctgcagctgggcgccgtgaagagaatccacggcctgctgaagaccgaggccgagagctacgagggcctgctggcccccagcctgatccccaagaactggcccgaccagggcaagatccagatccagaacctgagcgtgagatacgacagcagcctgaagcccgtgctgaagcacgtgaacgccctgatcgcccccggccagaagatcggcatctgcggcagaaccggcagcggcaagagcagcttcagcctggccttcttcagaatggtggacaccttcgagggccacatcatcatcgacggcatcgacatcgccaagctgcccctgcacaccctgagaagcagactgagcatcatcctgcaggaccccgtgctgttcagcggcaccatcagattcaacctggaccccgagagaaagtgcagcgacagcaccctgtgggaggccctggagatcgcccagctgaagctggtggtgaaggccctgcccggcggcctggacgccatcatcaccgagggcggcgagaacttcagccagggccagagacagctgttctgcctggccagagccttcgtgagaaagaccagcatcttcatcatggacgaggccaccgccagcatcgacatggccaccgagaacatcctgcagaaggtggtgatgaccgccttcgccgacagaaccgtggtgaccatcgcccacagagtgcacaccatcctgagcgccgacctggtgatcgtgctgaagagaggcgccatcctggagttcgacaagcccgagaagctgctgagcagaaaggacagcgtgttcgccagcttcgtgagagccgacaagtag

SEQ ID NO: 16576 - DNA, 2994 bp, Artificial Sequence
  Description of Artificial Sequence: Synthetic coding sequence
atgcccctggccttctgcggcagcgagaaccacagcgccgcctacagagtggaccagggcgtgctgaacaacggctgcttcgtggacgccctgaacgtggtgccccacgtgttcctgctgttcatcaccttccccatcctgttcatcggctggggcagccagagcagcaaggtgcacatccaccacagcacctggctgcacttccccggccacaacctgagatggatcctgaccttcatgctgctgttcgtgctggtgtgcgagatcgccgagggcatcctgagcgacggcgtgaccgagagccaccacctgcacctgtacatgcccgccggcatggccttcatggccgccgtgaccagcgtggtgtactaccacaacatcgagaccagcaacttccccaagctgctgatcgccctgctggtgtactggaccctggccttcatcaccaagaccatcaagttcgtgaagttcctggaccacgccatcggcttcagccagctgagattctgcctgaccggcctgctggtgatcctgtacggcatgctgctgctggtggaggtgaacgtgatcagagtgagaagatacatcttcttcaagacccccagagaggtgaagccccccgaggacctgcaggacctgggcgtgagattcctgcagcccttcgtgaacctgctgagcaagggcacctactggtggatgaacgccttcatcaagaccgcccacaagaagcccatcgacctgagagccatcggcaagctgcccatcgccatgagagccctgaccaactaccagagactgtgcgaggccttcgacgcccaggtgagaaaggacatccagggcacccagggcgccagagccatctggcaggccctgagccacgccttcggcagaagactggtgctgagcagcaccttcagaatcctggccgacctgctgggcttcgccggccccctgtgcatcttcggcatcgtggaccacctgggcaaggagaacgacgtgttccagcccaagacccagttcctgggcgtgtacttcgtgagcagccaggagttcctggccaacgcctacgtgctggccgtgctgctgttcctggccctgctgctgcagagaaccttcctgcaggccagctactacgtggccatcgagaccggcatcaacctgagaggcgccatccagaccaagatctacaacaagatcatgcacctgagcaccagcaacctgagcatgggcgagatgaccgccggccagatctgcaacctggtggccatcgacaccaaccagctgatgtggttcttcttcctgtgccccaacctgtgggccatgcccgtgcagatcatcgtgggcgtgatcctgctgtactacatcctgggcgtgagcgccctgatcggcgccgccgtgatcatcctgctggcccccgtgcagtacttcgtggccaccaagctgagccaggcccagagaagcaccctggagtacagcaacgagagactgaagcagaccaacgagatgctgagaggcatcaagctgctgaagctgtacgcctgggagaacatcttcagaaccagagtggagaccaccagaagaaaggagatgaccagcctgagagccttcgccatctacaccagcatcagcatcttcatgaacaccgccatccccatcgccgccgtgctgatcaccttcgtgggccacgtgagcttcttcaaggaggccgacttcagccccagcgtggccttcgccagcctgagcctgttccacatcctggtgacccccctgttcctgctgagcagcgtggtgagaagcaccgtgaaggccctggtgagcgccgagatcagagaggagcagtgcgccccccacgagcccaccccccagggccccgccagcaagtaccaggccgtgcccctgagagtggtgaacagaaagagacccgccagagaggactgcagaggcctgaccggccccctgcagagcctggtgcccagcgccgacggcgacgccgacaactgctgcgtgcagatcatgggcggctacttcacctggacccccgacggcatccccaccctgagcaacatcaccatcagaatccccagaggccagctgaccatgatcgtgggccaggtgggctgcggcaagagcagcctgctgctggccgccctgggcgagatgcagaaggtgagcggcgccgtgttctggagcagcctgcccgacagcgagatcggcgaggaccccagccccgagagagagaccgccaccgacctggacatcagaaagagaggccccgtggcctacgccagccagaagccctggctgctgaacgccaccgtggaggagaacatcatcttcgagagccccttcaacaagcagagatacaagatggtgatcgaggcctgcagcctgcagcccgacatcgacatcctgccccacggcgaccagacccagatcggcgagagaggcatcaacctgagcggcggccagagacagagaatcagcgtggccagagccctgtaccagcacgccaacgtggtgttcctggacgaccccttcagcgccctggacatccacctgagcgaccacctgatgcaggccggcatcctggagctgctgagagacgacaagagaaccgtggtgctggtgacccacaagctgcagtacctgccccacgccgactggatcatcgccatgaaggacggcaccatccagagagagggcaccctgaaggacttccagagaagcgagtgccagctgttcgagcactggaagaccctgatgaacagacaggaccaggagctggagaagagaagacagctgagagccagaagaatgaccacctgcagaccctgctgcaccagcgtgctgagaagccacggcgagcccgcccccagcacctgccccccccccgccagctgcagctgcagatgctggagcagccacagctgcagcagcacctggagctggtggcccagcaccaccggctggcccagcggccccaccgccccctag

SEQ ID NO: 16577 - DNA, 792 bp, Artificial Sequence
  Description of Artificial Sequence: Synthetic coding sequence
atgagcttcgccgtgttcctgatccacaccaagagaaagaagggcgtgcagagcagcggcgtgctgttcggctactggctgctgtgcttcgtgctgcccgccaccaacgccgcccagcaggccagcggcgccggcttccagagcgaccccgtgagacacctgagcacctacctgtgcctgagcctggtggtggcccagttcgtgctgagctgcctggccgaccagccccccttcttccccgaggacccccagcagagcaacccctgccccgagaccggcgccgccttccccagcaaggccaccttctggtgggtgagcggcctggtgtggagaggctacagaagacccctgagacccaaggacctgtggagcctgggcagagagaacagcagcgaggagctggtgagcagactggagaaggagtggatgagaaacagaagcgccgccagaggccacaacaaggccatcgccttcaagagaaagggcggcagcggcatggaggcccccgagaccgagcccttcctgagacaggagggcagccagtggagacccctgctgaaggccatctggcaggtgttccacagcaccttcctgctgggcaccctgagcctggtgatcagcgacgtgttcagattcaccgtgcccaagctgctgagcctgttcctggagttcatcggcgaccccaagccccccgcctggaagggctacctgctggccgtgctgatgttcctgagcgcctgcctgcagaccctgttcgagcagcagaacatgtacagactgaaggtgctgtag

SEQ ID NO: 16578 - DNA, 600 bp, Artificial Sequence
  Description of Artificial Sequence: Synthetic coding sequence
atgctgctgggcagactgaccagccagctgctgagagccgtgccctgggccggcggcagacccccctggcccgtgagcggcgtgctgggcagcagagtgtgcggccccctgtacagcaccagccccgccggccccggcagagccgccagcctgcccagaaagggcgcccagctggagctggaggagatgctggtgcccagaaagatgagcgtgagccccctggagagctggctgaccgccagatgcttcctgcccagactggacaccggcaccgccggcaccgtggcccccccccagagctaccagtgcccccccagccagatcggcgagggcgccgagcagggcgacgagggcgtggccgacgccccccagatccagtgcaagaacgtgctgaagatcagaagaagaaagatgaaccaccacaagtacagaaagctggtgaagaagaccagattcctgagaagaaaggtgcaggagggcagactgagaagaaagcagatcaagttcgagaaggacctgagaagaatctggctgaaggccggcctgaaggaggcccccgagggctggcagacccccaagatctacctgagaggcaagtag

SEQ ID NO: 16579 - DNA, 600 bp, Artificial Sequence; identical to SEQ ID NO: 16578
  Description of Artificial Sequence: Synthetic coding sequence

SEQ ID NO: 16580 - DNA, 600 bp, Artificial Sequence; identical to SEQ ID NO: 16578
  Description of Artificial Sequence: Synthetic coding sequence

SEQ ID NO: 16581 - DNA, 600 bp, Artificial Sequence; identical to SEQ ID NO: 16578
  Description of Artificial Sequence: Synthetic coding sequence

SEQ ID NO: 16582 - DNA, 870 bp, Artificial Sequence
  Description of Artificial Sequence: Synthetic coding sequence
atgaagaccctgcccgccatgctgggcaccggcaagctgttctgggtgttcttcctgatcccctacctggacatctggaacatccacggcaaggagagctgcgacgtgcagctgtacatcaagagacagagcgagcacagcatcctggccggcgaccccttcgagctggagtgccccgtgaagtactgcgccaacagaccccacgtgacctggtgcaagctgaacggcaccacctgcgtgaagctggaggacagacagaccagctggaaggaggagaagaacatcagcttcttcatcctgcacttcgagcccgtgctgcccaacgacaacggcagctacagatgcagcgccaacttccagagcaacctgatcgagagccacagcaccaccctgtacgtgaccgacgtgaagagcgccagcgagagacccagcaaggacgagatggccagcagaccctggctgctgtacagactgctgcccctgggcggcctgcccctgctgatcaccacctgcttctgcctgttctgctgcctgagaagacaccagggcaagcagaacgagctgagcgacaccgccggcagagagatcaacctggtggacgcccacctgaagagcgagcagaccgaggccagcaccagacagaacagccaggtgctgctgagcgagaccggcatctacgacaacgaccccgacctgtgcttcagaatgcaggagggcagcgaggtgtacagcaacccctgcctggaggagaacaagcccggcatcgtgtacgccagcctgaaccacagcgtgatcggccccaacagcagactggccagaaacgtgaaggaggcccccaccgagtacgccagcatctgcgtgagaagctag

SEQ ID NO: 16583 - DNA, 726 bp, Artificial Sequence
  Description of Artificial Sequence: Synthetic coding sequence
atgaagaccctgcccgccatgctgggcaccggcaagctgttctgggtgttcttcctgatcccctacctggacatctggaacatccacggcaaggagagctgcgacgtgcagctgtacatcaagagacagagcgagcacagcatcctggccggcgaccccttcgagctggagtgccccgtgaagtactgcgccaacagaccccacgtgacctggtgcaagctgaacggcaccacctgcgtgaagctggaggacagacagaccagctggaaggaggagaagaacatcagcttcttcatcctgcacttcgagcccgtgctgcccaacgacaacggcagctacagatgcagcgccaacttccagagcaacctgatcgagagccacagcaccaccctgtacgtgaccggcaagcagaacgagctgagcgacaccgccggcagagagatcaacctggtggacgcccacctgaagagcgagcagaccgaggccagcaccagacagaacagccaggtgctgctgagcgagaccggcatctacgacaacgaccccgacctgtgcttcagaatgcaggagggcagcgaggtgtacagcaacccctgcctggaggagaacaagcccggcatcgtgtacgccagcctgaaccacagcgtgatcggccccaacagcagactggccagaaacgtgaaggaggcccccaccgagtacgccagcatctgcgtgagaagctag

SEQ ID NO: 16584 - DNA, 1365 bp, Artificial Sequence
  Description of Artificial Sequence: Synthetic coding sequence
atgacctggagagccgccgccagcacctgcgccgccctgctgatcctgctgtgggccctgaccaccgagggcgacctgaaggtggagatgatggccggcggcacccagatcacccccctgaacgacaacgtgaccatcttctgcaacatcttctacagccagcccctgaacatcaccagcatgggcatcacctggttctggaagagcctgaccttcgacaaggaggtgaaggtgttcgagttcttcggcgaccaccaggaggccttcagacccggcgccatcgtgagcccctggagactgaagagcggcgacgccagcctgagactgcccggcatccagctggaggaggccggcgagtacagatgcgaggtggtggtgacccccctgaaggcccagggcaccgtgcagctggaggtggtggccagccccgccagcagactgctgctggaccaggtgggcatgaaggagaacgaggacaagtacatgtgcgagagcagcggcttctaccccgaggccatcaacatcacctgggagaagcagacccagaagttcccccaccccatcgagatcagcgaggacgtgatcaccggccccaccatcaagaacatggacggcaccttcaacgtgaccagctgcctgaagctgaacagcagccaggaggaccccggcaccgtgtaccagtgcgtggtgagacacgccagcctgcacacccccctgagaagcaacttcaccctgaccgccgccagacacagcctgagcgagaccgagaagaccgacaacttcagcatccactggtggcccatcagcttcatcggcgtgggcctggtgctgctgatcgtgctgatcccctggaagaagatctgcaacaagagcagcagcgcctacacccccctgaagtgcatcctgaagcactggaacagcttcgacacccagaccctgaagaaggagcacctgatcttcttctgcaccagagcctggcccagctaccagctgcaggacggcgaggcctggccccccgagggcagcgtgaacatcaacaccatccagcagctggacgtgttctgcagacaggagggcaagtggagcgaggtgccctacgtgcaggccttcttcgccctgagagacaaccccgacctgtgccagtgctgcagaatcgaccccgccctgctgaccgtgaccagcggcaagagcatcgacgacaacagcaccaagagcgagaagcagacccccagagagcacagcgacgccgtgcccgacgcccccatcctgcccgtgagccccatctgggagcccccccccgccaccaccagcaccacccccgtgctgagcagccagccccccaccctgctgctgcccctgcagtag

SEQ ID NO: 16585 - DNA, 1365 bp, Artificial Sequence; identical to SEQ ID NO: 16584
  Description of Artificial Sequence: Synthetic coding sequence

SEQ ID NO: 16586 - DNA, 660 bp, Artificial Sequence
  Description of Artificial Sequence: Synthetic coding sequence
atggcccccgagatggaccagttctacagaagcaccatggccatctacaagagcatcatggagcagttcaaccccgccctggagaacctggtgtacctgggcaacaactacctgagagccttccacgccctgagcgaggccgccgaggtgtacttcagcgccatccagaagatcggcgagagagccctgcagagccccaccagccagatcctgggcgagatcctggtgcagatgagcgacacccagagacacctgaacagcgacctggaggtggtggtgcagaccttccacggcggcctgctgcagcacatggagaagaacaccaagctggacatgcagttcatcaaggacagcagacagcactacgagctggagtacagacacagagccgccaacctggagaagtgcatgagcgagctgtggagaatggagagaaagagagacaagaacgtgagagagatgaaggagagcgtgaacagactgcacgcccagatgcaggccttcgtgagcgagagccagagagccgccgagctggaggagaagagaagatacagattcctggccgagaagcacctgctgctgagcaacaccttcctgcagttcttcggcagaatgctggccgacggcagactggtggtgagcaccctgtggctgagctag

SEQ ID NO: 16587 - DNA, 1590 bp, Artificial Sequence
  Description of Artificial Sequence: Synthetic coding sequence
atggcccccgagatggaccagttctacagaagcaccatggccatctacaagagcatcatggagcagttcaaccccgccctggagaacctggtgtacctgggcaacaactacctgagagccttccacgccctgagcgaggccgccgaggtgtacttcagcgccatccagaagatcggcgagagagccctgcagagccccaccagccagatcctgggcgagatcctggtgcagatgagcgacacccagagacacctgaacagcgacctggaggtggtggtgcagaccttccacggcggcctgctgcagcacatggagaagaacaccaagctggacatgcagttcatcaaggacagcagacagcactacgagctggagtacagacacagagccgccaacctggagaagtgcatgagcgagctgtggagaatggagagaaagagagacaagaacgtgagagagatgaaggagagcgtgaacagactgcacgcccagatgcaggccttcgtgagcgagagccagagagccgccgagctggaggagaagagaagatacagattcctggccgagaagcacctgctgctgagcaacaccttcctgcagttcttcggcagagccagaggcatgctgcagaacagagtgctgctgtggaaggagcagagcgaggccagcagaagccccagcagagcccacagccccggcctgctgggccccgccctgggccccccctaccccagcggcagactgacccccacctgcctggacatgccccccagacccctgggcgagttcagcagccccagaagcagacacggcagcggcagctacggcaccgagcccgacgccagacccgccagccagctggagcccgacagaagaagcctgcccagaacccccagcgccagcagcctgtacagcggcagcgcccagagcagcagaagcaacagcttcggcgagagacccggcggcggcggcggcgccagaagagtgagagccctggtgagccacagcgagggcgccaaccacaccctgctgagattcagcgccggcgacgtggtggaggtgctggtgcccgaggcccagaacggctggctgtacggcaagctggagggcagcagcgccagcggctggttccccgaggcctacgtgaaggccctggaggagggccccgtgaaccccatgacccccgtgacccccatgaccagcatgaccagcatgagccccatgacccccatgaaccccggcaacgagctgcccagcagaagctaccccctgagaggcagccacagcctggacgacctgctggacagacccggcaacagcatcgcccccagcgagtactgggacggccagagcagaagcagaacccccagcagagtgcccagcagagcccccagccccgcccccccccccctgcccagcagcagaagaagcagcatgggcagcaccgccgtggccaccgacgtgaagaagctgatgagcagcgagcagtaccccccccaggagctgttccccagaggcaccaaccccttcgccaccgtgaagctgagacccaccatcaccaacgacagaagcgcccccctgatcagatag

SEQ ID NO: 16588 - DNA, 1548 bp, Artificial Sequence
  Description of Artificial Sequence: Synthetic coding sequence
atggcccccgagatggaccagttctacagaagcaccatggccatctacaagagcatcatggagcagttcaaccccgccctggagaacctggtgtacctgggcaacaactacctgagagccttccacgccctgagcgaggccgccgaggtgtacttcagcgccatccagaagatcggcgagagagccctgcagagccccaccagccagatcctgggcgagatcctggtgcagatgagcgacacccagagacacctgaacagcgacctggaggtggtggtgcagaccttccacggcggcctgctgcagcacatggagaagaacaccaagctggacatgcagttcatcaaggacagcagacagcactacgagctggagtacagacacagagccgccaacctggagaagtgcatgagcgagctgtggagaatggagagaaagagagacaagaacgtgagagagatgaaggagagcgtgaacagactgcacgcccagatgcaggccttcgtgagcgagagccagagagccgccgagctggaggagaagagaagatacagattcctggccgagaagcacctgctgctgagcaacaccttcctgcagttcttcggcagagccagaggcatgctgcagaacagagtgctgctgtggaaggagcagagcgaggccagcagaagccccagcagagcccacagccccggcctgctgggccccgccctgggccccccctaccccagcggcagactgacccccacctgcctggacatgccccccagacccctgggcgagttcagcagccccagaagcagacacggcagcggcagctacggcaccgagcccgacgccagacccgccagccagctggagcccgacagaagaagcctgcccagaacccccagcgccagcagcctgtacagcggcagcgcccagagcagcagaagcaacagcttcggcgagagacccggcggcggcggcggcgccagaagagtgagagccctggtgagccacagcgagggcgccaaccacaccctgctgagattcagcgccggcgacgtggtggaggtgctggtgcccgaggcccagaacggctggctgtacggcaagctggagggcagcagcgccagcggctggttccccgaggcctacgtgaaggccctggaggagggccccgtgaaccccatgacccccgtgacccccatgaccagcatgaccagcatgagccccatgacccccatgaaccccggcaacgagctgcccagcagaagctaccccctgagaggcagccacagcctggacgacctgctggacagacccggcaacagcacccccagcagagtgcccagcagagcccccagccccgcccccccccccctgcccagcagcagaagaagcagcatgggcagcaccgccgtggccaccgacgtgaagaagctgatgagcagcgagcagtaccccccccaggagctgttccccagaggcaccaaccccttcgccaccgtgaagctgagacccaccatcaccaacgacagaagcgcccccctgatcagatag

SEQ ID NO: 16589 - DNA, 726 bp, Artificial Sequence
  Description of Artificial Sequence: Synthetic coding sequence
atgaccctgcagtgggccgccgtggccaccttcctgtacgccgagatcggcctgatcctgatcttctgcctgcccttcatccccccccagagatggcagaagatcttcagcttcaacgtgtggggcaagatcgccaccttctggaacaaggccttcctgaccatcatcatcctgctgatcgtgctgttcctggacgccgtgagagaggtgagaaagtacagcagcgtgcacaccatcgagaagagcagcaccagcagacccgacgcctacgagcacacccagatgaagctgttcagaagccagagaaacctgtacatcagcggcttcagcctgttcttctggctggtgctgagaagactggtgaccctgatcacccagctggccaaggagctgagcaacaagggcgtgctgaagacccaggccgagaacaccaacaaggccgccaagaagttcatggaggagaacgagaagctgaagagaatcctgaagagccacggcaaggacgaggagtgcgtgctggaggccgagaacaagaagctggtggaggaccaggagaagctgaagaccgagctgagaaagaccagcgacgccctgagcaaggcccagaacgacgtgatggagatgaagatgcagagcgagagactgagcaaggagtacgaccagctgctgaaggagcacagcgagctgcaggacagactggagagaggcaacaagaagagactgtag

SEQ ID NO: 16590 - DNA, 726 bp, Artificial Sequence; identical to SEQ ID NO: 16589
  Description of Artificial Sequence: Synthetic coding sequence

SEQ ID NO: 16591 - DNA, 1047 bp, Artificial Sequence
  Description of Artificial Sequence: Synthetic coding sequence
atgaccctgcagtgggccgccgtggccaccttcctgtacgccgagatcggcctgatcctgatcttctgcctgcccttcatccccccccagagatggcagaagatcttcagcttcaacgtgtggggcaagatcgccaccttctggaacaaggccttcctgaccatcatcatcctgctgatcgtgctgttcctggacgccgtgagagaggtgagaaagtacagcagcgtgcacaccatcgagaagagcagcaccagcagacccgacgcctacgagcacacccagatgaagctgttcagaagccagagaaacctgtacatcagcggcttcagcctgttcttctggctggtgctgagaagactggtgaccctgatcacccagctggccaaggagctgagcaacaagggcgtgctgaagacccaggccgagaacaccaacaaggccgccaagaagttcatggaggagaacgagaagctgaagagaatcctgaagagccacggcaaggacgaggagtgcgtgctggaggccgagaacaagaagctggtggaggaccaggagaagctgaagaccgagctgagaaagaccagcgacgccctgagcaaggcccagaacgacgtgatggagatgaagatgcagagcgagagactgagcaaggagtacgaccagctgctgaaggagcacagcgagctgcagcacagcagcttcggcgagttcctgagcaagagaagccacaagaacggcagcatcggcaagcagaccggcagcagaaagggcagcttcagaaagagacagcaggagaagaccgtgaacttcatcaaggacacctgcaacatcctgtgccagaacgacaacttcgtgatgctggccagcagaaagttcaagttcagaaagatgcactacgacagattcgtgatcttcctgatgccccacatcggctgcatcgtgatggccctgagcaagtacctgatgatgttccagatctactgcaaggtgtgcatccccgccctgaagaagaacatcagcatgctgaacaccatcttcacctactag

SEQ ID NO: 16592 - DNA, 468 bp, Artificial Sequence
  Description of Artificial Sequence: Synthetic coding sequence
atgaagctgttcagaagccagagaaacctgtacatcagcggcttcagcctgttcttctggctggtgctgagaagactggtgaccctgatcacccagctggccaaggagctgagcaacaagggcgtgctgaagacccaggccgagaacaccaacaaggccgccaagaagttcatggaggagaacgagaagctgaagagaatcctgaagagccacggcaaggacgaggagtgcgtgctggaggccgagaacaagaagctggtggaggaccaggagaagctgaagaccgagctgagaaagaccagcgacgccctgagcaaggcccagaacgacgtgatggagatgaagatgcagagcgagagactgagcaaggagtacgaccagctgctgaaggagcacagcgagctgcagaagagccacagccagcccggcgccgccgccttcctggtgaaggaggtggagagcttctag

SEQ ID NO: 16593 - DNA, 402 bp, Artificial Sequence
  Description of Artificial Sequence: Synthetic coding sequence
atgaccctgcagtgggccgccgtggccaccttcctgtacgccgagatcggcctgatcctgatcttctgcctgcccttcatccccccccagagatggcagaagatcttcagcttcaacgtgtggggcaagatcgccaccttctggaacaaggccttcctgaccatcatcatcctgctgatcgtgctgttcctggacgccgtgagagaggtgagaaagtacagcagcgtgcacaccatcgagaagagcagcaccagcagacccgacgcctacgagcacacccagatgaagctgttcagaagccagagaaacctgtacatcagcggcttcagcctgttcttctggctggtgctgagaagactggtgaccctgatcacccagctggccaaggagctgagcaactag

SEQ ID NO: 16594 - DNA, 492 bp, Artificial Sequence
  Description of Artificial Sequence: Synthetic coding sequence
tgagacgcctacgagcacacccagatgaagctgttcagaagccagagaaacctgtacatcagcggcttcagcctgttcttctggctggtgctgagaagactggtgaccctgatcacccagctggccaaggagctgagcaacaagggcgtgctgaagacccaggccgagaacaccaacaaggccgccaagaagttcatggaggagaacgagaagctgaagagaatcctgaagagccacggcaaggacgaggagtgcgtgctggaggccgagaacaagaagctggtggaggaccaggagaagctgaagaccgagctgagaaagaccagcgacgccctgagcaaggcccagaacgacgtgatggagatgaagatgcagagcgagagactgagcaaggagtacgaccagctgctgaaggagcacagcgagctgcagaagagccacagccagcccggcgccgccgccttcctggtgaaggaggtggagagcttctag

SEQ ID NO: 16595 - DNA, 1047 bp, Artificial Sequence; identical to SEQ ID NO: 16591
  Description of Artificial Sequence: Synthetic coding sequence

SEQ ID NO: 16596 - DNA, 693 bp, Artificial Sequence
  Description of Artificial Sequence: Synthetic coding sequence
atgaccctgcagtgggccgccgtggccaccttcctgtacgccgagatcggcctgatcctgatcttctgcctgcccttcatccccccccagagatggcagaagatcttcagcttcaacgtgtggggcaagatcgccaccttctggaacaaggccttcctgaccatcatcatcctgctgatcgtgctgttcctggacgccgtgagagaggtgagaaagtacagcagcgtgcacaccatcgagaagagcagcaccagcagacccgacgcctacgagcacacccagatgaagctgttcagaagccagagaaacctgtacatcagcggcttcagcctgttcttctggctggtgctgagaagactggtgaccctgatcacccagctggccaaggagctgagcaacaagggcgtgctgaagacccaggccgagaacaccaacaaggccgccaagaagttcatggaggagaacgagaagctgaagagaatcctgaagagccacggcaaggacgaggagtgcgtgctggaggccgagaacaagaagctggtggaggaccaggagaagctgaagaccgagctgagaaagaccagcgacgccctgagcaaggcccagaacgacgtgatggagatgaagatgcagagcgagagactgagcaaggagtacgaccagctgctgaaggagcacagcgagctgcagtag

SEQ ID NO: 16597 - DNA, 444 bp, Artificial Sequence
  Description of Artificial Sequence: Synthetic coding sequence
atgaagctgttcagaagccagagaaacctgtacatcagcggcttcagcctgttcttctggctggtgctgagaagactggtgaccctgatcacccagctggccaaggagctgagcaacaagggcgtgctgaagacccaggccgagaacaccaacaaggccgccaagaagttcatggaggagaacgagaagctgaagagaatcctgaagagccacggcaaggacgaggagtgcgtgctggaggccgagaacaagaagctggtggaggaccaggagaagctgaagaccgagctgagaaagaccagcgacgccctgagcaaggcccagaacgacgtgatggagatgaagatgcagagcgagagactgagcaaggagtacgaccagctgctgaaggagcacagcgagctgcaggacagactggagagaggcaacaagaagagactgtag

SEQ ID NO: 16598 - DNA, 195 bp, Artificial Sequence
  Description of Artificial Sequence: Synthetic coding sequence
atgaccctgcagtgggccgccgtggccaccttcctgtacgccgagatcggcctgatcctgatcttctgcctgcccttcatccccccccagagatggcagaagatcttcagcttcaacgtgtggggcaagatcgccaccttctggaacaaggccttcctgaccatcatcatcctgctgatcgtgctgttcctgtag

SEQ ID NO: 16599 - DNA, 591 bp, Artificial Sequence
  Description of Artificial Sequence: Synthetic coding sequence
atgaccctgcagtgggccgccgtggccaccttcctgtacgccgagatcggcctgatcctgatcttctgcctgcccttcatccccccccagagatggcagaagatcttcagcttcaacgtgtggggcaagatcgccaccttctggaacaaggccttcctgaccatcatcatcctgctgatcgtgctgttcctggacgccgtgagagaggtgagaaagtacagcagcgtgcacaccatcgagaagagcagcaccagcagacccgacgcctacgagcacacccagatgaagctgttcagaagccagagaaacctgtacatcagcggcttcagcctgttcttctggctggtgctgagaagactggtgaccctgatcacccagctggccaaggagctgagcaacaagggcgtgctgaagacccaggccgagaacaccaacaaggccgccaagaagttcatggaggagaacgagaagctgaagagaatcctgaagagccacggcaaggacgaggagtgcgtgctggaggccgagaacaagaagctggtggaggaccaggagaagctgaagaccgagctgagaaagaccagcgactag

SEQ ID NO: 16600 - DNA, 741 bp, Artificial Sequence
  Description of Artificial Sequence: Synthetic coding sequence
atgagcctgcagtggaccgccgtggccaccttcctgtacgccgaggtgttcgtggtgctgctgctgtgcatccccttcatcagccccaagagatggcagaagatcttcaagagcagactggtggagctgctggtgagctacggcaacaccttcttcgtggtgctgatcgtgatcctggtgctgctggtgatcgacgccgtgagagagatcagaaagtacgacgacgtgaccgagaaggtgaacctgcagaacaaccccggcgccatggagcacttccacatgaagctgttcagagcccagagaaacctgtacatcgccggcttcagcctgctgctgagcttcctgctgagaagactggtgaccctgatcagccagcaggccaccctgctggccagcaacgaggccttcaagaagcaggccgagagcgccagcgaggccgccaagaagtacatggaggagaacgaccagctgaagaagggcgccgccgtggacggcggcaagctggacgtgggcaacgccgaggtgaagctggaggaggagaacagaagcctgaaggccgacctgcagaagctgaaggacgagctggccagcaccaagcagaagctggagaaggccgagaaccaggtgctggccatgagaaagcagagcgagggcctgaccaaggagtacgacagactgctggaggagcacgccaagctgcaggccgccgtggacggccccatggacaagaaggaggagtag

SEQ ID NO: 16601 - DNA, 549 bp, Artificial Sequence
  Description of Artificial Sequence: Synthetic coding sequence
atgagcctgcagtggaccgccgtggccaccttcctgtacgccgaggtgttcgtggtgctgctgctgtgcatccccttcatcagccccaagagatggcagaagatcttcaagagcagactggtggagctgctggtgagctacggcaacaccttcttcgtggtgctgatcgtgatcctggtgctgctggtgatcgacgccgtgagagagatcagaaagtacgacgacgtgaccgagaaggtgaacctgcagaacaaccccggcgccatggagcacttccacatgaagctgttcagagcccagagaaacctgtacatcgccggcttcagcctgctgctgagcttcctgctgagaagactggtgaccctgatcagccagcaggccaccctgctggccagcaacgaggccttcaagaagcaggccgagagcgccagcgaggccgccaagaagtacatggaggagaacgaccagctgaagaagggcgccgccgtggacggcggcaagctggacgtgggcaacgccgaggtgaagctggaggaggagaacagatag

SEQ ID NO: 16602 - DNA, 537 bp, Artificial Sequence
  Description of Artificial Sequence: Synthetic coding sequence
atgagcctgcagtggaccgccgtggccaccttcctgtacgccgaggtgttcgtggtgctgctgctgtgcatccccttcatcagccccaagagatggcagaagatcttcaagagcagactggtggagctgctggtgagctacggcaacaccttcttcgtggtgctgatcgtgatcctggtgctgctggtgatcgacgccgtgagagagatcagaaagtacgacgacgtgaccgagaaggtgaacctgcagaacaaccccggcgccatggagcacttccacatgaagctgttcagagcccagagaaacctgtacatcgccggcttcagcctgctgctgagcttcctgctgagaagactggtgaccctgatcagccagcaggccaccctgctggccagcaacgaggccttcaagaagcaggccgagagcgccagcgaggccgccaagaagtacatggaggagaacgaccagctgaagaagggcgccgccgtggacggcggcaagctggacgtgggcaacgccgaggtgaagctggagtag

SEQ ID NO: 16603 - DNA, 942 bp, Artificial Sequence
  Description of Artificial Sequence: Synthetic coding sequence
atgggcgccgaggccagcagcagctggtgccccggcaccgccctgcccgaggagagactgagcgtgaagagagccagcgagatcagcggcttcctgggccagggcagcagcggcgaggccgccctggacgtgctgacccacgtgctggagggcgccggcaacaagctgaccagcagctgcggcaagcccagcagcaacagaatgagcctgcagtggaccgccgtggccaccttcctgtacgccgaggtgttcgtggtgctgctgctgtgcatccccttcatcagccccaagagatggcagaagatcttcaagagcagactggtggagctgctggtgagctacggcaacaccttcttcgtggtgctgatcgtgatcctggtgctgctggtgatcgacgccgtgagagagatcagaaagtacgacgacgtgaccgagaaggtgaacctgcagaacaaccccggcgccatggagcacttccacatgaagctgttcagagcccagagaaacctgtacatcgccggcttcagcctgctgctgagcttcctgctgagaagactggtgaccctgatcagccagcaggccaccctgctggccagcaacgaggccttcaagaagcaggccgagagcgccagcgaggccgccaagaagtacatggaggagaacgaccagctgaagaagggcgccgccgtggacggcggcaagctggacgtgggcaacgccgaggtgaagctggaggaggagaacagaagcctgaaggccgacctgcagaagctgaaggacgagctggccagcaccaagcagaagctggagaaggccgagaaccaggtgctggccatgagaaagcagagcgagggcctgaccaaggagtacgacagactgctggaggagcacgccaagctgcaggccgccgtggacggccccatggacaagaaggaggagtag

SEQ ID NO: 16604 - DNA, 564 bp, Artificial Sequence
  Description of Artificial Sequence: Synthetic coding sequence
atgagcctgcagtggaccgccgtggccaccttcctgtacgccgaggtgttcgtggtgctgctgctgtgcatccccttcatcagccccaagagatggcagaagatcttcaagagcagactggtggagctgctggtgagctacggcaacaccttcttcgtggtgctgatcgtgatcctggtgctgctggtgatcgacgccgtgagagagatcagaaagtacgacgacgtgaccgagaaggtgaacctgcagaacaaccccggcgccatggagcacttccacatgaagctgttcagagcccagagaaacctgtacatcgccggcttcagcctgctgctgagcttcctgctgagaagactggtgaccctgatcagccagcaggccaccctgctggccagcaacgaggccttcaagaagcaggccgagagcgccagcgaggccgccaagaagtacatggaggagaacgaccagctgaagaagggcgccgccgtggacggcggcaagctggacgtgggcaacgccgaggtgaagctggaggaggagaacagaagcctgaaggccgactag

SEQ ID NO: 16605 - DNA, 417 bp, Artificial Sequence
  Description of Artificial Sequence: Synthetic coding sequence
atgagcctgcagtggaccgccgtggccaccttcctgtacgccgaggtgttcgtggtgctgctgctgtgcatccccttcatcagccccaagagatggcagaagatcttcaagagcagactggtggagctgctggtgagctacggcaacaccttcttcgtggtgctgatcgtgatcctggtgctgctggtgatcgacgccgtgagagagatcagaaagtacgacgacgtgaccgagaaggtgaacctgcagaacaaccccggcgccatggagcacttccacatgaagctgttcagagcccagagaaacctgtacatcgccggcttcagcctgctgctgagcttcctgctgagaagactggtgaccctgatcagccagcaggccaccctgctggccagcaacgaggccttcaagaagtag

SEQ ID NO: 16606 - DNA, 741 bp, Artificial Sequence; identical to SEQ ID NO: 16600
  Description of Artificial Sequence: Synthetic coding sequence

SEQ ID NO: 16607 - DNA, 567 bp, Artificial Sequence
  Description of Artificial Sequence: Synthetic coding sequence
atgagcctgcagtggaccgccgtggccaccttcctgtacgccgaggtgttcgtggtgctgctgctgtgcatccccttcatcagccccaagagatggcagaagatcttcaagagcagactggtggagctgctggtgagctacggcaacaccttcttcgtggtgctgatcgtgatcctggtgctgctggtgatcgacgccgtgagagagatcagaaagtacgacgacgtgaccgagaaggtgaacctgcagaacaaccccggcgccatggagcacttccacatgaagctgttcagagcccagagaaacctgtacatcgccggcttcagcctgctgctgagcttcctgctgagaagactggtgaccctgatcagccagcaggccaccctgctggccagcaacgaggccttcaagaagcaggccgagagcgccagcgaggccgccaagaagtacatggaggagaacgaccagctgaagaagggcgccgccgtggacggcggcaagctggacgtgggcaacgccgaggtgaagctggaggaggagaacagaagcctgaaggccgacctgtag

SEQ ID NO: 16608 - DNA, 942 bp, Artificial Sequence; identical to SEQ ID NO: 16603
  Description of Artificial Sequence: Synthetic coding sequence

SEQ ID NO: 16609 - DNA, 798 bp, Artificial Sequence
  Description of Artificial Sequence: Synthetic coding sequence
atgtacgtgggctacgtgctggacaaggacagccccgtgtaccccggccccgccagacccgccagcctgggcctgggcccccaggcctacggcccccccgcccccccccccgcccccccccagtaccccgacttcagcagctacagccacgtggagcccgcccccgccccccccaccgcctggggcgcccccttccccgcccccaaggacgactgggccgccgcctacggccccggccccgccgcccccgccgccagccccgccagcctggccttcggccccccccccgacttcagccccgtgcccgccccccccggccccggccccggcctgctggcccagcccctgggcggccccggcacccccagcagccccggcgcccagagacccaccccctacgagtggatgagaagaagcgtggccgccggcggcggcggcggcagcggcaagaccagaaccaaggacaagtacagagtggtgtacaccgaccaccagagactggagctggagaaggagttccactacagcagatacatcaccatcagaagaaagagcgagctggccgccaacctgggcctgaccgagagacaggtgaagatctggttccagaacagaagagccaaggagagaaaggtgaacaagaagaagcagcagcagcagcagcccccccagccccccatggcccacgacatcaccgccacccccgccggccccagcctgggcggcctgtgccccagcaacaccagcctgctggccaccagcagccccatgcccgtgaaggaggagttcctgccctag

SEQ ID NO: 16610 - DNA, 687 bp, Artificial Sequence
  Description of Artificial Sequence: Synthetic coding sequence
atggccgccccccaggacgtgcacgtgagaatctgcaaccaggagatcgtgaagttcgacctggaggtgaaggccctgatccaggacatcagagactgcagcggccccctgagcgccctgaccgagctgaacaccaaggtgaaggagaagttccagcagctgagacacagaatccaggacctggagcagctggccaaggagcaggacaaggagagcgagaagcagctgctgctgcaggaggtggagaaccacaagaagcagatgctgagcaaccaggccagctggagaaaggccaacctgacctgcaagatcgccatcgacaacctggagaaggccgagctgctgcagggcggcgacctgctgagacagagaaagaccaccaaggagagcctggcccagaccagcagcaccatcaccgagagcctgatgggcatcagcagaatgatggcccagcaggtgcagcagagcgaggaggccatgcagagcctggtgaccagcagcagaaccatcctggacgccaacgaggagttcaagagcatgagcggcaccatccagctgggcagaaagctgatcaccaagtacaacagaagagagctgaccgacaagctgctgatcttcctggccctggccctgttcctggccaccgtgctgtacatcgtgaagaagagactgttccccttcctgtag

SEQ ID NO: 16611 - DNA, 714 bp, Artificial Sequence
  Description of Artificial Sequence: Synthetic coding sequence
atggccgccccccaggacgtgcacgtgagaatctgcaaccaggagatcgtgaagttcgacctggaggtgaaggccctgatccaggacatcagagactgcagcggccccctgagcgccctgaccgagctgaacaccaaggtgaaggagaagttccagcagctgagacacagaatccagcccgtgctgtaccagagagccttcatctggaccgccagcaccttcttcttcaagctgacctacagcctgaccgacttcagcagcacccagcacgacttcaacagccccaccacccccgtgaccttcagcgacctggagcagctggccaaggagcaggacaaggagagcgagaagcagctgctgctgcaggaggtggagaaccacaagaagcagatgctgagaaagaccaccaaggagagcctggcccagaccagcagcaccatcaccgagagcctgatgggcatcagcagaatgatggcccagcaggtgcagcagagcgaggaggccatgcagagcctggtgaccagcagcagaaccatcctggacgccaacgaggagttcaagagcatgagcggcaccatccagctgggcagaaagctgatcaccaagtacaacagaagagagctgaccgacaagctgctgatcttcctggccctggccctgttcctggccaccgtgctgtacatcgtgaagaagagactgttccccttcctgtag

SEQ ID NO: 16612 - DNA, 585 bp, Artificial Sequence
  Description of Artificial Sequence: Synthetic coding sequence
atggccgccccccaggacgtgcacgtgagaatctgcaaccaggagatcgtgaagttcgacctggaggtgaaggccctgatccaggacatcagagactgcagcggccccctgagcgccctgaccgagctgaacaccaaggtgaaggagaagttccagcagctgagacacagaatccaggacctggagcagctggccaaggagcaggacaaggagagcgagaagcagctgctgctgcaggaggtggagaaccacaagaagcagatgctgagaaagaccaccaaggagagcctggcccagaccagcagcaccatcaccgagagcctgatgggcatcagcagaatgatggcccagcaggtgcagcagagcgaggaggccatgcagagcctggtgaccagcagcagaaccatcctggacgccaacgaggagttcaagagcatgagcggcaccatccagctgggcagaaagctgatcaccaagtacaacagaagagagctgaccgacaagctgctgatcttcctggccctggccctgttcctggccaccgtgctgtacatcgtgaagaagagactgttccccttcctgtag

SEQ ID NO: 16613 - DNA, 1458 bp, Artificial Sequence
  Description of Artificial Sequence: Synthetic coding sequence
atggccagcagcagcaccgtgcccctgggcttccactacgagaccaagtacgtggtgctgagctacctgggcctgctgagccaggagaagctgcaggagcagcacctgagcagcccccagggcgtgcagctggacatcgccagccagagcctggaccaggagatcctgctgaaggtgaagaccgagatcgaggaggagctgaagagcctggacaaggagatcagcgaggccttcaccagcaccggcttcgacagacacaccagccccgtgttcagccccgccaaccccgagagcagcatggaggactgcctggcccacctgggcgagaaggtgagccaggagctgaaggagcccctgcacaaggccctgcagatgctgctgagccagcccgtgacctaccaggccttcagagagtgcaccctggagaccaccgtgcacgccagcggctggaacaagatcctggtgcccctggtgctgctgagacagatgctgctggagctgaccagaagaggccaggagcccctgagcgccctgctgcagttcggcgtgacctacctggaggactacagcgccgagtacatcatccagcagggcggctggggcaccgtgttcagcctggagagcgaggaggaggagtaccccggcatcaccgccgaggacagcaacgacatctacatcctgcccagcgacaacagcggccaggtgagcccccccgagagccccaccgtgaccaccagctggcagagcgagagcctgcccgtgagcctgagcgccagccagagctggcacaccgagagcctgcccgtgagcctgggccccgagagctggcagcagatcgccatggaccccgaggaggtgaagagcctggacagcaacggcgccggcgagaagagcgagaacaacagcagcaacagcgacatcgtgcacgtggagaaggaggaggtgcccgagggcatggaggaggccgccgtggccagcgtggtgctgcccgccagagagctgcaggaggccctgcccgaggcccccgcccccctgctgccccacatcaccgccaccagcctgctgggcaccagagagcccgacaccgaggtgatcaccgtggagaagagcagccccgccaccagcctgttcgtggagctggacgaggaggaggtgaaggccgccaccaccgagcccaccgaggtggaggaggtggtgcccgccctggagcccaccgagaccctgctgagcgagaaggagatcaacgccagagaggagagcctggtggaggagctgagccccgccagcgagaagaagcccgtgccccccagcgagggcaagagcagactgagccccgccggcgagatgaagcccatgcccctgagcgagggcaagagcatcctgctgttcggcggcgccgccgccgtggccatcctggccgtggccatcggcgtggccctggccctgagaaagaagtag

SEQ ID NO: 16614 - DNA, 972 bp, Artificial Sequence
  Description of Artificial Sequence: Synthetic coding sequence
atgctgctggagctgaccagaagaggccaggagcccctgagcgccctgctgcagttcggcgtgacctacctggaggactacagcgccgagtacatcatccagcagggcggctggggcaccgtgttcagcctggagagcgaggaggaggagtaccccggcatcaccgccgaggacagcaacgacatctacatcctgcccagcgacaacagcggccaggtgagcccccccgagagccccaccgtgaccaccagctggcagagcgagagcctgcccgtgagcctgagcgccagccagagctggcacaccgagagcctgcccgtgagcctgggccccgagagctggcagcagatcgccatggaccccgaggaggtgaagagcctggacagcaacggcgccggcgagaagagcgagaacaacagcagcaacagcgacatcgtgcacgtggagaaggaggaggtgcccgagggcatggaggaggccgccgtggccagcgtggtgctgcccgccagagagctgcaggaggccctgcccgaggcccccgcccccctgctgccccacatcaccgccaccagcctgctgggcaccagagagcccgacaccgaggtgatcaccgtggagaagagcagccccgccaccagcctgttcgtggagctggacgaggaggaggtgaaggccgccaccaccgagcccaccgaggtggaggaggtggtgcccgccctggagcccaccgagaccctgctgagcgagaaggagatcaacgccagagaggagagcctggtggaggagctgagccccgccagcgagaagaagcccgtgccccccagcgagggcaagagcagactgagccccgccggcgagatgaagcccatgcccctgagcgagggcaagagcatcctgctgttcggcggcgccgccgccgtggccatcctggccgtggccatcggcgtggccctggccctgagaaagaagtag

SEQ ID NO: 16615 - DNA, 606 bp, Artificial Sequence
  Description of Artificial Sequence: Synthetic coding sequence
atggccagcagcagcaccgtgcccctgggcttccactacgagaccaagtacgtggtgctgagctacctgggcctgctgagccaggagaagctgcaggagcagcacctgagcagcccccagggcgtgcagctggacatcgccagccagagcctggaccaggagatcctgctgaaggtgaagaccgagatcgaggaggagctgaagagcctggacaaggagatcagcgaggccttcaccagcaccggcttcgacagacacaccagccccgtgttcagccccgccaaccccgagagcagcatggaggactgcctggcccacctgggcgagaaggtgagccaggagctgaaggagcccctgcacaaggccctgcagatgctgctgagccagcccgtgacctaccaggccttcagagagtgcaccctggagaccaccgtgcacgccagcggctggaacaagatcctggtgcccctggtgctgctgagacagatgctgctggagctgaccagaagaggccaggagcccctgagcgccctgctgcagttcggcgtgacctacctggaggactacagcgccgagtacatcatccagcagggcggctgggtgtag

SEQ ID NO: 16616 - DNA, 315 bp, Artificial Sequence
  Description of Artificial Sequence: Synthetic coding sequence
atggccagcagcagcaccgtgcccctgggcttccactacgagaccaagtacgtggtgctgagctacctgggcctgctgagccaggagaagctgcaggagcagcacctgagcagcccccagggcgtgcagctggacatcgccagccagagcctggaccaggagatcctgctgaaggtgaagaccgagatcgaggaggagctgaagagcctggacaaggagatcagcgagggctggagcgccgtggcccccagcagacccaccaccaccagcatcagccaggtgcagatgatcctgctgagccagccccccgagtag

SEQ ID NO: 16617 - DNA, 606 bp, Artificial Sequence; identical to SEQ ID NO: 16615
  Description of Artificial Sequence: Synthetic coding sequence

SEQ ID NO: 16618 - DNA, 1086 bp, Artificial Sequence
  Description of Artificial Sequence: Synthetic coding sequence
atgaagcagagcatgctgttcagcgccacctgggacagcagcctgaagagaagctgcaagagcaacatcttcccccaccccaagatcctggtgcccctggtgctgctgagacagatgctgctggagctgaccagaagaggccaggagcccctgagcgccctgctgcagttcggcgtgacctacctggaggactacagcgccgagtacatcatccagcagggcggctggggcaccgtgttcagcctggagagcgaggaggaggagtaccccggcatcaccgccgaggacagcaacgacatctacatcctgcccagcgacaacagcggccaggtgagcccccccgagagccccaccgtgaccaccagctggcagagcgagagcctgcccgtgagcctgagcgccagccagagctggcacaccgagagcctgcccgtgagcctgggccccgagagctggcagcagatcgccatggaccccgaggaggtgaagagcctggacagcaacggcgccggcgagaagagcgagaacaacagcagcaacagcgacatcgtgcacgtggagaaggaggaggtgcccgagggcatggaggaggccgccgtggccagcgtggtgctgcccgccagagagctgcaggaggccctgcccgaggcccccgcccccctgctgccccacatcaccgccaccagcctgctgggcaccagagagcccgacaccgaggtgatcaccgtggagaagagcagccccgccaccagcctgttcgtggagctggacgaggaggaggtgaaggccgccaccaccgagcccaccgaggtggaggaggtggtgcccgccctggagcccaccgagaccctgctgagcgagaaggagatcaacgccagagaggagagcctggtggaggagctgagccccgccagcgagaagaagcccgtgccccccagcgagggcaagagcagactgagccccgccggcgagatgaagcccatgcccctgagcgagggcaagagcatcctgctgttcggcggcgccgccgccgtggccatcctggccgtggccatcggcgtggccctggccctgagaaagaagtag

SEQ ID NO: 16619 - DNA, 972 bp, Artificial Sequence; identical to SEQ ID NO: 16614
  Description of Artificial Sequence: Synthetic coding sequence

SEQ ID NO: 16620 - DNA, 516 bp, Artificial Sequence
  Description of Artificial Sequence: Synthetic coding sequence
atggccagcagcagcaccgtgcccctgggcttccactacgagaccaagtacgtggtgctgagctacctgggcctgctgagccaggagaagctgcaggagcagcacctgagcagcccccagggcgtgcagctggacatcgccagccagagcctggaccaggagatcctgctgaaggtgaagaccgagatcgaggaggagctgaagagcctggacaaggagatcagcgaggccttcaccagcaccggcttcgacagacacaccagccccgtgttcagccccgccaaccccgagagcagcatggaggactgcctggcccacctgggcgagaaggtgagccaggagctgaaggagcccctgcacaaggccctgcagatgctgctgagccaggccctgtgcctggtgctgagccagagaagaagaaacaccctggagagcctgcagaagatcgccatgaccttcaccagctgccccgccaccaccctggacaagagcgtgccccagagcctgcagctgtag

SEQ ID NO: 16621 - DNA, 402 bp, Artificial Sequence
  Description of Artificial Sequence: Synthetic coding sequence
atggacaagtacatcctggacaacggcaaggtgcacctgggcagcggcatctgggtggacgaggagaagtggcaccagctgcaggtgacccagggcgacagcaagtacaccaagaacctggccgtgatgatctggggcaccgacgtgctgaagaacagaagcgtgaccggcgtggccaccaagaagaagaaggacgccgtgcccaagccccccctgagcccccacaagctgagcatcgtgagagagtgcctgtacgacagaatcgcccaggagaccgtggacgagaccgagatcgcccagagactgagcaaggtgaacaagtacatctgcgagaagatcatggacatcaacaagagctgcaagaacgaggagagaagagaggccaagtacaacctgcagtag

SEQ ID NO: 16622 - DNA, 1266 bp, Artificial Sequence
  Description of Artificial Sequence: Synthetic coding sequence
atgtacgccttcgtgagattcctggaggacaacgtgtgctacgccctgcccgtgagctgcgtgagagacttcagccccagaagcagactggacttcgacaaccagaaggtgtacgccgtgtacagaggccccgaggagctgggcgccggccccgagagcccccccagagcccccagagactggggcgccctgctgctgcacaaggcccagatcctggccctggccgaggacaagagcgacctggagaacagcgtgatgcagaagaagatcaagatccccaagctgagcctgaaccacgtggaggaggacggcgaggtgaaggactacggcgaggaggacctgcagctgagacacatcaagagacccgagggcagaaagcccagcgaggtggcccacaagagcatcgaggccgtggtggccagactggagaagcagaacggcctgagcctgggccacagcacctgccccgaggaggtgttcgtggaggccagccccggcaccgaggacatggacagcctggaggacgccgtggtgcccagagccctgtacgaggagctgctgagaaactaccagcagcagcaggaggagatgagacacctgcagcaggagctggagagaaccagaagacagctggtgcagcaggccaagaagctgaaggagtacggcgccctggtgagcgagatgaaggagctgagagacctgaacagaagactgcaggacgtgctgctgctgagactgggcagcggccccgccatcgacctggagaaggtgaagagcgagtgcctggagcccgagcccgagctgagaagcaccttcagcgaggaggccaacaccagcagctactaccccgcccccgcccccgtgatggacaagtacatcctggacaacggcaaggtgcacctgggcagcggcatctgggtggacgaggagaagtggcaccagctgcaggtgacccagggcgacagcaagtacaccaagaacctggccgtgatgatctggggcaccgacgtgctgaagaacagaagcgtgaccggcgtggccaccaagaagaagaaggacgccgtgcccaagccccccctgagcccccacaagctgagcatcgtgagagagtgcctgtacgacagaatcgcccaggagaccgtggacgagaccgagatcgcccagagactgagcaaggtgaacaagtacatctgcgagaagatcatggacatcaacaagagctgcaagaacgaggagagaagagaggccaagtacaacctgcagtag

SEQ ID NO: 16623 - DNA, 399 bp, Artificial Sequence
  Description of Artificial Sequence: Synthetic coding sequence
atggccgaggagggcatcgccgccggcggcgtgatggacgtgaacaccgccctgcaggaggtgctgaagaccgccctgatccacgacggcctggccagaggcatcagagaggccgccaaggccctggacaagagacaggcccacctgtgcgtgctggccagcaactgcgacgagcccatgtacgtgaagctggtggaggccctgtgcgccgagcaccagatcaacctgatcaaggtggacgacaacaagaagctgggcgagtgggtgggcctgtgcaagatcgacagagagggcaagcccagaaaggtggtgggctgcagctgcgtggtggtgaaggactacggcaaggagagccaggccaaggacgtgatcgaggagtacttcaagtgcaagaagtag

SEQ ID NO: 16624 - DNA, 996 bp, Artificial Sequence
  Description of Artificial Sequence: Synthetic coding sequence
atggccagcgccctgtggaccgtgctgcccagcagaatgagcctgagaagcctgaagtggagcctgctgctgctgagcctgctgagcttcttcgtgatgtggtacctgagcctgccccactacaacgtgatcgagagagtgaactggatgtacttctacgagtacgagcccatctacagacaggacttccacttcaccctgagagagcacagcaactgcagccaccagaaccccttcctggtgatcctggtgaccagccaccccagcgacgtgaaggccagacaggccatcagagtgacctggggcgagaagaagagctggtggggctacgaggtgctgaccttcttcctgctgggccaggaggccgagaaggaggacaagatgctggccctgagcctggaggacgagcacctgctgtacggcgacatcatcagacaggacttcctggacacctacaacaacctgaccctgaagaccatcatggccttcagatgggtgaccgagttctgccccaacgccaagtacgtgatgaagaccgacaccgacgtgttcatcaacaccggcaacctggtgaagtacctgctgaacctgaaccacagcgagaagttcttcaccggctaccccctgatcgacaactacagctacagaggcttctaccagaagacccacatcagctaccaggagtaccccttcaaggtgttccccccctactgcagcggcctgggctacatcatgagcagagacctggtgcccagaatctacgagatgatgggccacgtgaagcccatcaagttcgaggacgtgtacgtgggcatctgcctgaacctgctgaaggtgaacatccacatccccgaggacaccaacctgttcttcctgtacagaatccacctggacgtgtgccagctgagaagagtgatcgccgcccacggcttcagcagcaaggagatcatcaccttctggcaggtgatgctgagaaacaccacctgccactactag

SEQ ID NO: 16625 - DNA, 996 bp, Artificial Sequence; identical to SEQ ID NO: 16624
  Description of Artificial Sequence: Synthetic coding sequence

SEQ ID NO: 16626 - DNA, 996 bp, Artificial Sequence; identical to SEQ ID NO: 16624
  Description of Artificial Sequence: Synthetic coding sequence

SEQ ID NO: 16627 - DNA, 996 bp, Artificial Sequence; identical to SEQ ID NO: 16624
  Description of Artificial Sequence: Synthetic coding sequence

SEQ ID NO: 16628 - DNA, 276 bp, Artificial Sequence
  Description of Artificial Sequence: Synthetic coding sequence
atggccagcgccctgtggaccgtgctgcccagcagaatgagcctgagaagcctgaagtggagcctgctgctgctgagcctgctgagcttcttcgtgatgtggtacctgagcctgccccactacaacgtgatcgagagagtgaactggatgtacttctacgagatccacctggacgtgtgccagctgagaagagtgatcgccgcccacggcttcagcagcaaggagatcatcaccttctggcaggtgatgctgagaaacaccacctgccactactag

SEQ ID NO: 16629 - DNA, 336 bp, Artificial Sequence
  Description of Artificial Sequence: Synthetic coding sequence
atggccagcgccctgtggaccgtgctgcccagcagaatgagcctgagaagcctgaagtggagcctgctgctgctgagcctgctgagcttcttcgtgatgtggtacctgagcctgccccactacaacgtgatcgagagagtgaactggatgtacttctacgagtacgagcccatctacagacaggacttccacttcaccctgagagagcacagcaactgcagccaccagaaccccttcctggtgatcctggtgaccagccaccccagcgacgtgaaggccagacaggccatcagagtgacctggggcgagaagaagagctggtggggctacgagtag

SEQ ID NO: 16630 - DNA, 177 bp, Artificial Sequence
  Description of Artificial Sequence: Synthetic coding sequence
atggccagcgccctgtggaccgtgctgcccagcagaatgagcctgagaagcctgaagtggagcctgctgctgctgagcctgctgagcttcttcgtgatgtggtacctgagcctgccccactacaacgtgatcgagagagtgaactggatgtacttctacgagtacgagcccatctag

SEQ ID NO: 16631 - DNA, 996 bp, Artificial Sequence; identical to SEQ ID NO: 16624
  Description of Artificial Sequence: Synthetic coding sequence

SEQ ID NO: 16632 - DNA, 126 bp, Artificial Sequence
  Description of Artificial Sequence: Synthetic coding sequence
atggccagcgccctgtggaccgtgctgcccagcagaatgagcctgagaagcctgaagtggagcctgctgctgctgagcctgctgagcttcttcgtgatgtggtacctgagcctgccccactactag

SEQ ID NO: 16633 - DNA, 996 bp, Artificial Sequence; identical to SEQ ID NO: 16624
  Description of Artificial Sequence: Synthetic coding sequence

SEQ ID NO: 16634 - DNA, 198 bp, Artificial Sequence
  Description of Artificial Sequence: Synthetic coding sequence
atggccagcgccctgtggaccgtgctgcccagcagaatgagcctgagaagcctgaagtggagcctgctgctgctgagcctgctgagcttcttcgtgatgtggtacctgagcctgccccactacaacgtgatcgagagagtgaactggatgtacttctacgagtacgagcccatctacagacaggacttccacttctag

SEQ ID NO: 16635 - DNA, 90 bp, Artificial Sequence
  Description of Artificial Sequence: Synthetic coding sequence
atggccagcgccctgtggaccgtgctgcccagcagaatgagcctgagaagcctgaagtggagcctgctgctgctgagcctgctgagctag

SEQ ID NO: 16636 - DNA, 165 bp, Artificial Sequence
  Description of Artificial Sequence: Synthetic coding sequence
atggccagcgccctgtggaccgtgctgcccagcagaatgagcctgagaagcctgaagtggagcctgctgctgctgagcctgctgagcttcttcgtgatgtggtacctgagcctgccccactacaacgtgatcgagagagtgaactggatgtacttctacgagtag

SEQ ID NO: 16637 - DNA, 981 bp, Artificial Sequence
  Description of Artificial Sequence: Synthetic coding sequence
atgagaaactggctggtgctgctgtgcccctgcgtgctgggcgccgccctgcacctgtggctgagactgagaagccccccccccgcctgcgccagcggcgccggccccgccggcggcgtgagcctgctgctgcccagactggagtgcaacggcgccgtgagcgcccaccccaacctgcacctgcccggcagcagagacagccccgccagcgccagccaggtggccggcatcaccgaccagctggccctgttcccccagtggaagagcacccactacgacgtggtggtgggcgtgctgagcgccagaaacaaccacgagctgagaaacgtgatcagaagcacctggatgagacacctgctgcagcaccccaccctgagccagagagtgctggtgaagttcatcatcggcgcccacggctgcgaggtgcccgtggaggacagagaggacccctacagctgcaagctgctgaacatcaccaaccccgtgctgaaccaggagatcgaggccttcagcctgagcgaggacaccagcagcggcctgcccgaggacagagtggtgagcgtgagcttcagagtgctgtaccccatcgtgatcaccagcctgggcgtgttctacgacgccaacgacgtgggcttccagagaaacatcaccgtgaagctgtaccaggccgagcaggaggaggccctgttcatcgccagattcagcccccccagctgcggcgtgcaggtgaacaagctgtggtacaagcccgtggagcagttcatcctgcccgagagcttcgagggcaccatcgtgtgggagagccaggacctgcacggcctggtgagcagaaacctgcacaaggtgaccgtgaacgacggcggcggcgtgctgagagtgatcaccgccggcgagggcgccctgccccacgagttcctggagggcgtggagggcgtggccggcggcttcatctacaccatccagggcaagttcgccagctag

SEQ ID NO: 16638 - DNA, 966 bp, Artificial Sequence
  Description of Artificial Sequence: Synthetic coding sequence
atgagaaactggctggtgctgctgtgcccctgcgtgctgggcgccgccctgcacctgtggctgagactgagaagccccccccccgcctgcgccagcggcgccggccccgccggcggcgtgagcctgctgctgcccagactggagtgcaacggcgccgtgagcgcccaccccaacctgcacctgcccggcagcagagacagccccgccagcgccagccaggtggccggcatcaccgaccagctggccctgttcccccagtggaagagcacccactacgacgtggtggtgggcgtgctgagcgccagaaacaaccacgagctgagaaacgtgatcagaagcacctggatgagacacctgctgcagcaccccaccctgagccagagagtgctggtgaagttcatcatcggcgcccacggctgcgaggtgcccgtggaggacagagaggacccctacagctgcaagctgctgaacatcaccaaccccgtgctgaaccaggagatcgaggccttcagcctgagcgaggacaccagcagcggcctgcccgaggacagagtggtgagcgtgagcttcagagtgctgtaccccatcgtgatcaccagcctgggcgtgttctacgacgccaacgacgtgggcttccagagaaacatcaccgtgaagctgtaccaggccgagcaggaggaggccctgttcatcgccagattcagcccccccagctgcggcgtgcaggtgaacaagctgtggtacaagcccgtggagcagttcatcctgcccgagagcttcgagggcaccatcgtgtgggagagccaggacctgcacggcctggtgagcagaaacctgcacaaggtgaccgtgaacgacggcggcggcgtgctgagagtgatcaccgccggcgagggcgccctgccccacgagttcctggagggcgtggagggcgtggccggcggcttcatctacaccatccagtag

SEQ ID NO: 16639 - DNA, 1503 bp, Artificial Sequence
  Description of Artificial Sequence: Synthetic coding sequence
atgagaaactggctggtgctgctgtgcccctgcgtgctgggcgccgccctgcacctgtggctgagactgagaagccccccccccgcctgcgccagcggcgccggccccgccgaccagctggccctgttcccccagtggaagagcacccactacgacgtggtggtgggcgtgctgagcgccagaaacaaccacgagctgagaaacgtgatcagaagcacctggatgagacacctgctgcagcaccccaccctgagccagagagtgctggtgaagttcatcatcggcgcccacggctgcgaggtgcccgtggaggacagagaggacccctacagctgcaagctgctgaacatcaccaaccccgtgctgaaccaggagatcgaggccttcagcctgagcgaggacaccagcagcggcctgcccgaggacagagtggtgagcgtgagcttcagagtgctgtaccccatcgtgatcaccagcctgggcgtgttctacgacgccaacgacgtgggcttccagagaaacatcaccgtgaagctgtaccaggccgagcaggaggaggccctgttcatcgccagattcagcccccccagctgcggcgtgcaggtgaacaagctgtggtacaagcccgtggagcagttcatcctgcccgagagcttcgagggcaccatcgtgtgggagagccaggacctgcacggcctggtgagcagaaacctgcacaaggtgaccgtgaacgacggcggcggcgtgctgagagtgatcaccgccggcgagggcgccctgccccacgagttcctggagggcgtggagggcgtggccggcggcttcatctacaccatccaggagggcgacgccctgctgcacaacctgcacagcagaccccagagactgatcgaccacatcagaaacctgcacgaggaggacgccctgctgaaggaggagagcagcatctacgacgacatcgtgttcgtggacgtggtggacacctacagaaacgtgcccgccaagctgctgaacttctacagatggaccgtggagaccaccagcttcaacctgctgctgaagaccgacgacgactgctacatcgacctggaggccgtgttcaacagaatcgtgcagaagaacctggacggccccaacttctggtggggcaacttcagactgaactgggccgtggacagaaccggcaagtggcaggagctggagtaccccagccccgcctaccccgccttcgcctgcggcagcggctacgtgatcagcaaggacatcgtgaagtggctggccagcaacagcggcagactgaagacctaccagggcgaggacgtgagcatgggcatctggatggccgccatcggccccaagagataccaggacagcctgtggctgtgcgagaagacctgcgagaccggcatgctgagcagcccccagtacagcccctgggagctgaccgagctgtggaagctgaaggagagatgcggcgacccctgcagatgccaggccagatag

SEQ ID NO: 16640 - DNA, 1602 bp, Artificial Sequence
  Description of Artificial Sequence: Synthetic coding sequence
atgtggctgggcagaagagccctgtgcgccctggtgctgctgctggcctgcgccagcctgggcctgctgtacgccagcaccagagacgcccccggcctgagactgcccctggccccctgggcccccccccagagccccagaagacccgagctgcccgacctggcccccgagcccagatacgcccacatccccgtgagaatcaaggagcaggtggtgggcctgctggcctggaacaactgcagctgcgagagcagcggcggcggcctgcccctgcccttccagaagcaggtgagagccatcgacctgaccaaggccttcgaccccgccgagctgagagccgccagcgccaccagagagcaggagttccaggccttcctgagcagaagccagagccccgccgaccagctgctgatcgcccccgccaacagccccctgcagtaccccctgcagggcgtggaggtgcagcccctgagaagcatcctggtgcccggcctgagcctgcaggccgccagcggccaggaggtgtaccaggtgaacctgaccgccagcctgggcacctgggacgtggccggcgaggtgaccggcgtgaccctgaccggcgagggccaggccgacctgaccctggtgagccccggcctggaccagctgaacagacagctgcagctggtgacctacagcagcagaagctaccagaccaacaccgccgacaccgtgagattcagcaccgagggccacgaggccgccttcaccatcagaatcagacacccccccaaccccagactgtacccccccggcagcctgccccagggcgcccagtacaacatcagcgccctggtgaccatcgccaccaagaccttcctgagatacgacagactgagagccctgatcaccagcatcagaagattctaccccaccgtgaccgtggtgatcgccgacgacagcgacaagcccgagagagtgagcggcccctacgtggagcactacctgatgcccttcggcaagggctggttcgccggcagaaacctggccgtgagccaggtgaccaccaagtacgtgctgtgggtggacgacgacttcgtgttcaccgccagaaccagactggagagactggtggacgtgctggagagaacccccctggacctggtgggcggcgccgtgagagagatcagcggcttcgccaccacctacagacagctgctgagcgtggagcccggcgcccccggcctgggcaactgcctgagacagagaagaggcttccaccacgagctggtgggcttccccggctgcgtggtgaccgacggcgtggtgaacttcttcctggccagaaccgacaaggtgagagaggtgggcttcgaccccagactgagcagagtggcccacctggagttcttcctggacggcctgggcagcctgagagtgggcagctgcagcgacgtggtggtggaccacgccagcaagctgaagctgccctggaccagcagagacgccggcgccgagacctacgccagatacagataccccggcagcctggacgagagccagatggccaagcacagactgctgttcttcaagcacagactgcagtgcatgaccagccagtag

SEQ ID NO: 16641 - DNA, 714 bp, Artificial Sequence
  Description of Artificial Sequence: Synthetic coding sequence
atgtggctgggcagaagagccctgtgcgccctggtgctgctgctggcctgcgccagcctgggcctgctgtacgccagcaccagagacgcccccggcctgagactgcccctggccccctgggcccccccccagagccccagaagacccgagctgcccgacctggcccccgagcccagatacgcccacatccccgtgagaatcaaggagcaggtggtgggcctgctggcctggaacaactgcagctgcgagagcagcggcggcggcctgcccctgcccttccagaagcaggtgagagccatcgacctgaccaaggccttcgaccccgccgagctgagagccgccagcgccaccagagagcaggagttccaggccttcctgagcagaagccagagccccgccgaccagctgctgatcgcccccgccaacagccccctgcagtaccccctgcagggcgtggaggtgcagcccctgagaagcatcctggtgcccggcctgagcctgcaggccgccagcggccaggaggtgtaccaggtgaacctgaccgccagcctgggcacctgggacgtggccggcgaggtgaccggcgtgaccctgaccggcgagggccaggccgacctgaccctggtgagccccggcctggaccagctgaacagacagctgcagctggtgacctacagcagcagaagctaccagaccaacaccgccgacacctag

SEQ ID NO: 16642 - DNA, 363 bp, Artificial Sequence
  Description of Artificial Sequence: Synthetic coding sequence
atgtggctgggcagaagagccctgtgcgccctggtgctgctgctggcctgcgccagcctgggcctgctgtacgccagcaccagagacgcccccggcctgagactgcccctggccccctgggcccccccccagagccccagaagacccgagctgcccgacctggcccccgagcccagatacgcccacatccccgtgagaatcaaggagcaggtggtgggcctgctggcctggaacaactgcagctgcgagagcagcggcggcggcctgcccctgcccttccagaagcaggtgagagccatcgacctgaccaaggccttcgaccccgccgagctgagagccgccagcgccaccagagagcagtag

SEQ ID NO: 16643 - DNA, 1701 bp, Artificial Sequence
  Description of Artificial Sequence: Synthetic coding sequence
atgggcagcgccggcttcagcgtgggcaagttccacgtggaggtggccagcagaggcagagagtgcgtgagcggcacccccgagtgcggcaacagactgggcagcgccggcttcggcgccctgtgcctggagctgagaggcgccgaccccgcctggggccccttcgccgcccacggcagaagcagaagacagggcagcagattcctgtggctgctgaagatcctggtgatcatcctggtgctgggcatcgtgggcttcatgttcggcagcatgttcctgcaggccgtgttcagcagccccaagcccgagctgcccagccccgcccccggcgtgcagaagctgaagctgctgcccgaggagagactgagaaacctgttcagctacgacggcatctggctgttccccaagaaccagtgcaagtgcgaggccaacaaggagcagggcggctacaacttccaggacgcctacggccagagcgacctgcccgccgtgaaggccagaagacaggccgagttcgagcacttccagagaagagagggcctgcccagacccctgcccctgctggtgcagcccaacctgcccttcggctaccccgtgcacggcgtggaggtgatgcccctgcacaccgtgcccatccccggcctgcagttcgagggccccgacgcccccgtgtacgaggtgaccctgaccgccagcctgggcaccctgaacaccctggccgacgtgcccgacagcgtggtgcagggcagaggccagaagcagctgatcatcagcaccagcgacagaaagctgctgaagttcatcctgcagcacgtgacctacaccagcaccggctaccagcaccagaaggtggacatcgtgagcctggagagcagaagcagcgtggccaagttccccgtgaccatcagacaccccgtgatccccaagctgtacgaccccggccccgagagaaagctgagaaacctggtgaccatcgccaccaagaccttcctgagaccccacaagctgatgatcatgctgagaagcatcagagagtactaccccgacctgaccgtgatcgtggccgacgacagccagaagcccctggagatcaaggacaaccacgtggagtactacaccatgcccttcggcaagggctggttcgccggcagaaacctggccatcagccaggtgaccaccaagtacgtgctgtgggtggacgacgacttcctgttcaacgaggagaccaagatcgaggtgctggtggacgtgctggagaagaccgagctggacgtggtgggcggcagcgtgctgggcaacgtgttccagttcaagctgctgctggagcagagcgagaacggcgcctgcctgcacaagagaatgggcttcttccagcccctggacggcttccccagctgcgtggtgaccagcggcgtggtgaacttcttcctggcccacaccgagagactgcagagagtgggcttcgaccccagactgcagagagtggcccacagcgagttcttcatcgacggcctgggcaccctgctggtgggcagctgccccgaggtgatcatcggccaccagagcagaagccccgtggtggacagcgagctggccgccctggagaagacctacaacacctacagaagcaacaccctgaccagagtgcagttcaagctggccctgcactacttcaagaaccacctgcagtgcgccgcctag

SEQ ID NO: 16644 - DNA, 1521 bp, Artificial Sequence
  Description of Artificial Sequence: Synthetic coding sequence
atgaccagcggcggcagcagattcctgtggctgctgaagatcctggtgatcatcctggtgctgggcatcgtgggcttcatgttcggcagcatgttcctgcaggccgtgttcagcagccccaagcccgagctgcccagccccgcccccggcgtgcagaagctgaagctgctgcccgaggagagactgagaaacctgttcagctacgacggcatctggctgttccccaagaaccagtgcaagtgcgaggccaacaaggagcagggcggctacaacttccaggacgcctacggccagagcgacctgcccgccgtgaaggccagaagacaggccgagttcgagcacttccagagaagagagggcctgcccagacccctgcccctgctggtgcagcccaacctgcccttcggctaccccgtgcacggcgtggaggtgatgcccctgcacaccgtgcccatccccggcctgcagttcgagggccccgacgcccccgtgtacgaggtgaccctgaccgccagcctgggcaccctgaacaccctggccgacgtgcccgacagcgtggtgcagggcagaggccagaagcagctgatcatcagcaccagcgacagaaagctgctgaagttcatcctgcagcacgtgacctacaccagcaccggctaccagcaccagaaggtggacatcgtgagcctggagagcagaagcagcgtggccaagttccccgtgaccatcagacaccccgtgatccccaagctgtacgaccccggccccgagagaaagctgagaaacctggtgaccatcgccaccaagaccttcctgagaccccacaagctgatgatcatgctgagaagcatcagagagtactaccccgacctgaccgtgatcgtggccgacgacagccagaagcccctggagatcaaggacaaccacgtggagtactacaccatgcccttcggcaagggctggttcgccggcagaaacctggccatcagccaggtgaccaccaagtacgtgctgtgggtggacgacgacttcctgttcaacgaggagaccaagatcgaggtgctggtggacgtgctggagaagaccgagctggacgtggtgggcggcagcgtgctgggcaacgtgttccagttcaagctgctgctggagcagagcgagaacggcgcctgcctgcacaagagaatgggcttcttccagcccctggacggcttccccagctgcgtggtgaccagcggcgtggtgaacttcttcctggcccacaccgagagactgcagagagtgggcttcgaccccagactgcagagagtggcccacagcgagttcttcatcgacggcctgggcaccctgctggtgggcagctgccccgaggtgatcatcggccaccagagcagaagccccgtggtggacagcgagctggccgccctggagaagacctacaacacctacagaagcaacaccctgaccagagtgcagttcaagctggccctgcactacttcaagaaccacctgcagtgcgccgcctag

SEQ ID NO: 16645 - DNA, 1443 bp, Artificial Sequence
  Description of Artificial Sequence: Synthetic coding sequence
atgttcggcagcatgttcctgcaggccgtgttcagcagccccaagcccgagctgcccagccccgcccccggcgtgcagaagctgaagctgctgcccgaggagagactgagaaacctgttcagctacgacggcatctggctgttccccaagaaccagtgcaagtgcgaggccaacaaggagcagggcggctacaacttccaggacgcctacggccagagcgacctgcccgccgtgaaggccagaagacaggccgagttcgagcacttccagagaagagagggcctgcccagacccctgcccctgctggtgcagcccaacctgcccttcggctaccccgtgcacggcgtggaggtgatgcccctgcacaccgtgcccatccccggcctgcagttcgagggccccgacgcccccgtgtacgaggtgaccctgaccgccagcctgggcaccctgaacaccctggccgacgtgcccgacagcgtggtgcagggcagaggccagaagcagctgatcatcagcaccagcgacagaaagctgctgaagttcatcctgcagcacgtgacctacaccagcaccggctaccagcaccagaaggtggacatcgtgagcctggagagcagaagcagcgtggccaagttccccgtgaccatcagacaccccgtgatccccaagctgtacgaccccggccccgagagaaagctgagaaacctggtgaccatcgccaccaagaccttcctgagaccccacaagctgatgatcatgctgagaagcatcagagagtactaccccgacctgaccgtgatcgtggccgacgacagccagaagcccctggagatcaaggacaaccacgtggagtactacaccatgcccttcggcaagggctggttcgccggcagaaacctggccatcagccaggtgaccaccaagtacgtgctgtgggtggacgacgacttcctgttcaacgaggagaccaagatcgaggtgctggtggacgtgctggagaagaccgagctggacgtggtgggcggcagcgtgctgggcaacgtgttccagttcaagctgctgctggagcagagcgagaacggcgcctgcctgcacaagagaatgggcttcttccagcccctggacggcttccccagctgcgtggtgaccagcggcgtggtgaacttcttcctggcccacaccgagagactgcagagagtgggcttcgaccccagactgcagagagtggcccacagcgagttcttcatcgacggcctgggcaccctgctggtgggcagctgccccgaggtgatcatcggccaccagagcagaagccccgtggtggacagcgagctggccgccctggagaagacctacaacacctacagaagcaacaccctgaccagagtgcagttcaagctggccctgcactacttcaagaaccacctgcagtgcgccgcctag

SEQ ID NO: 16646 - DNA, 3120 bp, Artificial Sequence
  Description of Artificial Sequence: Synthetic coding sequence
atgcccagactgcccgtgaagaagatcagaaagcagatgaagctgctgctgctgctgctgctgctgagctgcgccgcctggctgacctacgtgcacctgggcctggtgagacagggcagagccctgagacagagactgggctacggcagagacggcgagaagctgaccagcgagaccgacggcagaggcgtgcacgccgcccccagcacccagagagccgaggacagcagcgagagcagagaggaggagcaggcccccgagggcagagacctggacatgctgttccccggcggcgccggcagactgcccctgaacttcacccaccagacccccccctggagagaggagtacaagggccaggtgaacctgcacgtgttcgaggactggtgcggcggcgccgtgggccacctgagaagaaacctgcacttccccctgttcccccacaccagaaccaccgtgaagaagctggccgtgagccccaagtggaagaactacggcctgagaatcttcggcttcatccaccccgccagagacggcgacgtgcagttcagcgtggccagcgacgacaacagcgagttctggctgagcctggacgagagccccgccgccgcccagctggtggccttcgtgggcaagaccggcagcgagtggaccgcccccggcgagttcaccaagttcagcagccaggtgagcaagcccagaagactgatggccagcagaagatactacttcgagctgctgcacaagcaggacgacagaggcagcgaccacgtggaggtgggctggagagccttcctgcccggcctgaagttcgaggtgatcagcagcgcccacatcagcctgtacaccgacgagagcgccctgaagatggaccacgtggcccacgtgccccagagccccgccagccacgtgggcggcagacccccccaggaggagaccagcgccgacatgctgagacccgaccccagagacaccttcttcctgacccccagaatggagagcagcagcctggagaacgtgctggagccctgcgcctacgcccccacctacgtggtgaaggacttccccatcgccagataccagggcctgcagttcgtgtacctgagcttcgtgtaccccaacgactacaccagactgacccacatggagaccgacaacaagtgcttctacagagagagccccctgtacctggagagattcggcttctacaagtacatgaagatggacaaggaggagggcgacgaggacgaggaggacgaggtgcagagaagagccttcctgttcctgaaccccgacgacttcctggacgacgaggacgagggcgagctgctggacagcctggagcccaccgaggccgccccccccagaagcggcccccagagccccgcccccgccgcccccgcccagcccggcgccaccctggccccccccaccccccccagacccagagacggcggcacccccagacacagcagagccctgagctgggccgccagagccgccagacccctgcccctgttcctgggcagagcccccccccccagacccgccgtggagcagcccccccccaaggtgtacgtgaccagagtgagacccggccagagagccagccccagagcccccgcccccagagccccctggccccccttccccggcgtgttcctgcaccccagacccctgcccagagtgcagctgagagccccccccagaccccccagaccccacggcagaagaaccggcggcccccaggccacccagcccagaccccccgccagagcccaggccacccagggcggcagagagggccaggccagaaccctgggccccgccgcccccaccgtggacagcaacctgagcagcgaggccagacccgtgaccagcttcctgagcctgagccaggtgagcggcccccagctgcccggcgagggcgaggaggaggaggagggcgaggacgacggcgcccccggcgacgaggccgccagcgaggacagcgaggaggccgccggccccgccctgggcagatggagagaggacgccatcgactggcagagaaccttcagcgtgggcgccgtggacttcgagctgctgagaagcgactggaacgacctgagatgcaacgtgagcggcaacctgcagctgcccgaggccgaggccgtggacgtgaccgcccagtacatggagagactgaacgccagacacggcggcagattcgccctgctgagaatcgtgaacgtggagaagagaagagacagcgccagaggcagcagattcctgctggagctggagctgcaggagagaggcggcggcagactgagactgagcgagtacgtgttcctgagactgcccggcgccagagtgggcgacgccgacggcgagagccccgagcccgcccccgccgccagcgtgagacccgacggcagacccgagctgtgcagacccctgagactggcctggagacaggacgtgatggtgcacttcatcgtgcccgtgaagaaccaggccagatgggtggcccagttcctggccgacatggccgccctgcacgccagaaccggcgacagcagattcagcgtggtgctggtggacttcgagagcgaggacatggacgtggagagagccctgagagccgccagactgcccagataccagtacctgagaagaaccggcaacttcgagagaagcgccggcctgcaggccggcgtggacgccgtggaggacgccagcagcatcgtgttcctgtgcgacctgcacatccacttcccccccaacatcctggacggcatcagaaagcactgcgtggagggcagactggccttcgcccccgtggtgatgagactgagctgcggcagcagccccagagacccccacggctactgggaggtgaacggcttcggcctgttcggcatctacaagagcgacttcgacagagtgggcggcatgaacaccgaggagttcagagaccagtggggcggcgaggactgggagctgctggacagagtgctgcaggccggcctggaggtggagagactgagactgagaaacttctaccaccactaccacagcaagagaggcatgtggagcgtgagaagcagaaagggcagcagaaccggcgccagctag

SEQ ID NO: 16647 - DNA, 708 bp, Artificial Sequence
  Description of Artificial Sequence: Synthetic coding sequence
atggaccccgccagacccctgggcctgagcatcctgctgctgttcctgaccgaggccgccctgggcgacgccgcccaggagcccaccggcaacaacgccgagatctgcctgctgcccctggactacggcccctgcagagccctgctgctgagatactactacgacagatacacccagagctgcagacagttcctgtacggcggctgcgagggcaacgccaacaacttctacacctgggaggcctgcgacgacgcctgctggagaatcgagaaggtgcccaaggtgtgcagactgcaggtgagcgtggacgaccagtgcgagggcagcaccgagaagtacttcttcaacctgagcagcatgacctgcgagaagttcttcagcggcggctgccacagaaacagaatcgagaacagattccccgacgaggccacctgcatgggcttctgcgcccccaagaagatccccagcttctgctacagccccaaggacgagggcctgtgcagcgccaacgtgaccagatactacttcaaccccagatacagaacctgcgacgccttcacctacaccggctgcggcggcaacgacaacaacttcgtgagcagagaggactgcaagagagcctgcgccaaggccctgaagaagaagaagaagatgcccaagctgagattcgccagcagaatcagaaagatcagaaagaagcagttctag

SEQ ID NO: 16648 - DNA, 309 bp, Artificial Sequence
  Description of Artificial Sequence: Synthetic coding sequence
atggccgactgggccagagcccagagccccggcgccgtggaggagatcctggacagagagaacaagagaatggccgacagcctggccagcaaggtgaccagactgaagagcctggccctggacatcgacagagacgccgaggaccagaacagatacctggacggcatggtgagagcccacggcgtgagagtgagcgtgccctgccccagcaccacctgctgcagagcctgcagcgtgagcttcagcaccggcgccggcggctggagcaaccaccacttctgcgtgatcctgctgggcttcctgccctag

SEQ ID NO: 16649 - DNA, 336 bp, Artificial Sequence
  Description of Artificial Sequence: Synthetic coding sequence
atggccgactgggccagagcccagagccccggcgccgtggaggagatcctggacagagagaacaagagaatggccgacagcctggccagcaaggtgaccagactgaagagcctggccctggacatcgacagagacgccgaggaccagaacagatacctggacggcatggacagcgacttcaccagcatgaccagcctgctgaccggcagcgtgaagagattcagcaccatggccagaagcggccaggacaacagaaagctgctgtgcggcatggccgtgggcctgatcgtggccttcttcatcctgagctacttcctgagcagagccagaacctag

SEQ ID NO: 16650 - DNA, 3348 bp, Artificial Sequence
  Description of Artificial Sequence: Synthetic coding sequence
atgctgagaggcaccatgaccgcctggagaggcatgagacccgaggtgaccctggcctgcctgctgctggccaccgccggctgcttcgccgacctgaacgaggtgccccaggtgaccgtgcagcccgccagcaccgtgcagaagcccggcggcaccgtgatcctgggctgcgtggtggagccccccagaatgaacgtgacctggagactgaacggcaaggagctgaacggcagcgacgacgccctgggcgtgctgatcacccacggcaccctggtgatcaccgccctgaacaaccacaccgtgggcagataccagtgcgtggccagaatgcccgccggcgccgtggccagcgtgcccgccaccgtgaccctggccaacctgcaggacttcaagctggacgtgcagcacgtgatcgaggtggacgagggcaacaccgccgtgatcgcctgccacctgcccgagagccaccccaaggcccaggtgagatacagcgtgaagcaggagtggctggaggccagcagaggcaactacctgatcatgcccagcggcaacctgcagatcgtgaacgccagccaggaggacgagggcatgtacaagtgcgccgcctacaaccccgtgacccaggaggtgaagaccagcggcagcagcgacagactgagagtgagaagaagcaccgccgaggccgccagaatcatctacccccccgaggcccagaccatcatcgtgaccaagggccagagcctgatcctggagtgcgtggccagcggcatccccccccccagagtgacctgggccaaggacggcagcagcgtgaccggctacaacaagaccagattcctgctgagcaacctgctgatcgacaccaccagcgaggaggacagcggcacctacagatgcatggccgacaacggcgtgggccagcccggcgccgccgtgatcctgtacaacgtgcaggtgttcgagccccccgaggtgaccatggagctgagccagctggtgatcccctggggccagagcgccaagctgacctgcgaggtgagaggcaaccccccccccagcgtgctgtggctgagaaacgccgtgcccctgatcagcagccagagactgagactgagcagaagagccctgagagtgctgagcatgggccccgaggacgagggcgtgtaccagtgcatggccgagaacgaggtgggcagcgcccacgccgtggtgcagctgagaaccagcagacccagcatcacccccagactgtggcaggacgccgagctggccaccggcaccccccccgtgagccccagcaagctgggcaaccccgagcagatgctgagaggccagcccgccctgcccagaccccccaccagcgtgggccccgccagcccccagtgccccggcgagaagggccagggcgcccccgccgaggcccccatcatcctgagcagccccagaaccagcaagaccgacagctacgagctggtgtggagacccagacacgagggcagcggcagagcccccatcctgtactacgtggtgaagcacagaaagcaggtgaccaacagcagcgacgactggaccatcagcggcatccccgccaaccagcacagactgaccctgaccagactggaccccggcagcctgtacgaggtggagatggccgcctacaactgcgccggcgagggccagaccgccatggtgaccttcagaaccggcagaagacccaagcccgagatcatggccagcaaggagcagcagatccagagagacgaccccggcgccagcccccagagcagcagccagcccgaccacggcagactgagcccccccgaggcccccgacagacccaccatcagcaccgccagcgagaccagcgtgtacgtgacctggatccccagaggcaacggcggcttccccatccagagcttcagagtggagtacaagaagctgaagaaggtgggcgactggatcctggccaccagcgccatcccccccagcagactgagcgtggagatcaccggcctggagaagggcaccagctacaagttcagagtgagagccctgaacatgctgggcgagagcgagcccagcgcccccagcagaccctacgtggtgagcggctacagcggcagagtgtacgagagacccgtggccggcccctacatcaccttcaccgacgccgtgaacgagaccaccatcatgctgaagtggatgtacatccccgccagcaacaacaacacccccatccacggcttctacatctactacagacccaccgacagcgacaacgacagcgactacaagaaggacatggtggagggcgacaagtactggcacagcatcagccacctgcagcccgagaccagctacgacatcaagatgcagtgcttcaacgagggcggcgagagcgagttcagcaacgtgatgatctgcgagaccaaggccagaaagagcagcggccagcccggcagactgcccccccccaccctggcccccccccagccccccctgcccgagaccatcgagagacccgtgggcaccggcgccatggtggccagaagcagcgacctgccctacctgatcgtgggcgtggtgctgggcagcatcgtgctgatcatcgtgaccttcatccccttctgcctgtggagagcctggagcaagcagaagcacaccaccgacctgggcttccccagaagcgccctgccccccagctgcccctacaccatggtgcccctgggcggcctgcccggccaccaggccagcggccagccctacctgagcggcatcagcggcagagcctgcgccaacggcatccacatgaacagaggctgccccagcgccgccgtgggctaccccggcatgaagccccagcagcactgccccggcgagctgcagcagcagagcgacaccagcagcctgctgagacagacccacctgggcaacggctacgacccccagagccaccagatcaccagaggccccaagagcagccccgacgagggcagcttcctgtacaccctgcccgacgacagcacccaccagctgctgcagccccaccacgactgctgccagagacaggagcagcccgccgccgtgggccagagcggcgtgagaagagcccccgacagccccgtgctggaggccgtgtgggacccccccttccacagcggccccccctgctgcctgggcctggtgcccgtggaggaggtggacagccccgacagctgccaggtgagcggcggcgactggtgcccccagcaccccgtgggcgcctacgtgggccaggagcccggcatgcagctgagccccggccccctggtgagagtgagcttcgagaccccccccctgaccatctag

SEQ ID NO: 16651 - DNA, 3345 bp, Artificial Sequence
  Description of Artificial Sequence: Synthetic coding sequence
atgctgagaggcaccatgaccgcctggagaggcatgagacccgaggtgaccctggcctgcctgctgctggccaccgccggctgcttcgccgacctgaacgaggtgccccaggtgaccgtgcagcccgccagcaccgtgcagaagcccggcggcaccgtgatcctgggctgcgtggtggagccccccagaatgaacgtgacctggagactgaacggcaaggagctgaacggcagcgacgacgccctgggcgtgctgatcacccacggcaccctggtgatcaccgccctgaacaaccacaccgtgggcagataccagtgcgtggccagaatgcccgccggcgccgtggccagcgtgcccgccaccgtgaccctggccaacctgcaggacttcaagctggacgtgcagcacgtgatcgaggtggacgagggcaacaccgccgtgatcgcctgccacctgcccgagagccaccccaaggcccaggtgagatacagcgtgaagcaggagtggctggaggccagcagaggcaactacctgatcatgcccagcggcaacctgcagatcgtgaacgccagccaggaggacgagggcatgtacaagtgcgccgcctacaaccccgtgacccaggaggtgaagaccagcggcagcagcgacagactgagagtgagaagaagcaccgccgaggccgccagaatcatctacccccccgaggcccagaccatcatcgtgaccaagggccagagcctgatcctggagtgcgtggccagcggcatccccccccccagagtgacctgggccaaggacggcagcagcgtgaccggctacaacaagaccagattcctgctgagcaacctgctgatcgacaccaccagcgaggaggacagcggcacctacagatgcatggccgacaacggcgtgggccagcccggcgccgccgtgatcctgtacaacgtgcaggtgttcgagccccccgaggtgaccatggagctgagccagctggtgatcccctggggccagagcgccaagctgacctgcgaggtgagaggcaaccccccccccagcgtgctgtggctgagaaacgccgtgcccctgatcagcagccagagactgagactgagcagaagagccctgagagtgctgagcatgggccccgaggacgagggcgtgtaccagtgcatggccgagaacgaggtgggcagcgcccacgccgtggtgcagctgagaaccagcagacccagcatcacccccagactgtggcaggacgccgagctggccaccggcaccccccccgtgagccccagcaagctgggcaaccccgagcagatgctgagaggccagcccgccctgcccagaccccccaccagcgtgggccccgccagcccccagtgccccggcgagaagggccagggcgcccccgccgaggcccccatcatcctgagcagccccagaaccagcaagaccgacagctacgagctggtgtggagacccagacacgagggcagcggcagagcccccatcctgtactacgtggtgaagcacagaaaggtgaccaacagcagcgacgactggaccatcagcggcatccccgccaaccagcacagactgaccctgaccagactggaccccggcagcctgtacgaggtggagatggccgcctacaactgcgccggcgagggccagaccgccatggtgaccttcagaaccggcagaagacccaagcccgagatcatggccagcaaggagcagcagatccagagagacgaccccggcgccagcccccagagcagcagccagcccgaccacggcagactgagcccccccgaggcccccgacagacccaccatcagcaccgccagcgagaccagcgtgtacgtgacctggatccccagaggcaacggcggcttccccatccagagcttcagagtggagtacaagaagctgaagaaggtgggcgactggatcctggccaccagcgccatcccccccagcagactgagcgtggagatcaccggcctggagaagggcaccagctacaagttcagagtgagagccctgaacatgctgggcgagagcgagcccagcgcccccagcagaccctacgtggtgagcggctacagcggcagagtgtacgagagacccgtggccggcccctacatcaccttcaccgacgccgtgaacgagaccaccatcatgctgaagtggatgtacatccccgccagcaacaacaacacccccatccacggcttctacatctactacagacccaccgacagcgacaacgacagcgactacaagaaggacatggtggagggcgacaagtactggcacagcatcagccacctgcagcccgagaccagctacgacatcaagatgcagtgcttcaacgagggcggcgagagcgagttcagcaacgtgatgatctgcgagaccaaggccagaaagagcagcggccagcccggcagactgcccccccccaccctggcccccccccagccccccctgcccgagaccatcgagagacccgtgggcaccggcgccatggtggccagaagcagcgacctgccctacctgatcgtgggcgtggtgctgggcagcatcgtgctgatcatcgtgaccttcatccccttctgcctgtggagagcctggagcaagcagaagcacaccaccgacctgggcttccccagaagcgccctgccccccagctgcccctacaccatggtgcccctgggcggcctgcccggccaccaggccagcggccagccctacctgagcggcatcagcggcagagcctgcgccaacggcatccacatgaacagaggctgccccagcgccgccgtgggctaccccggcatgaagccccagcagcactgccccggcgagctgcagcagcagagcgacaccagcagcctgctgagacagacccacctgggcaacggctacgacccccagagccaccagatcaccagaggccccaagagcagccccgacgagggcagcttcctgtacaccctgcccgacgacagcacccaccagctgctgcagccccaccacgactgctgccagagacaggagcagcccgccgccgtgggccagagcggcgtgagaagagcccccgacagccccgtgctggaggccgtgtgggacccccccttccacagcggccccccctgctgcctgggcctggtgcccgtggaggaggtggacagccccgacagctgccaggtgagcggcggcgactggtgcccccagcaccccgtgggcgcctacgtgggccaggagcccggcatgcagctgagccccggccccctggtgagagtgagcttcgagaccccccccctgaccatctag

SEQ ID NO: 16652 - DNA, 69 bp, Artificial Sequence
  Description of Artificial Sequence: Synthetic coding sequence
atgctgagaggcaccatgaccgcctggagaggcatgagacccgaggtgaccctggcctgcctgctgtag

SEQ ID NO: 16653 - DNA, 258 bp, Artificial Sequence
  Description of Artificial Sequence: Synthetic coding sequence
atgctgagaggcaccatgaccgcctggagaggcatgagacccgaggtgaccctggcctgcctgctgctggccaccgccggctgcttcgccgacctgaacgaggtgccccaggtgaccgtgcagcccgccagcaccgtgcagaagcccggcggcaccgtgatcctgggctgcgtggtggagccccccagaatgaacgtgacctggagactgaacggcaaggagctgaacggcagcgacgacgccctgggcgtgctgtag

SEQ ID NO: 16654 - DNA, 474 bp, Artificial Sequence
  Description of Artificial Sequence: Synthetic coding sequence
atgctgagaggcaccatgaccgcctggagaggcatgagacccgaggtgaccctggcctgcctgctgctggccaccgccggctgcttcgccgacctgaacgaggtgccccaggtgaccgtgcagcccgccagcaccgtgcagaagcccggcggcaccgtgatcctgggctgcgtggtggagccccccagaatgaacgtgacctggagactgaacggcaaggagctgaacggcagcgacgacgccctgggcgtgctgatcacccacggcaccctggtgatcaccgccctgaacaaccacaccgtgggcagataccagtgcgtggccagaatgcccgccggcgccgtggccagcgtgcccgccaccgtgaccctggccagcgagagcgcccccctgcccccctgccacggcgccgtgcccccccacctgagccaccccgaggcccccaccatccacgccgccagctgctacagctag

SEQ ID NO: 16655 - DNA, 474 bp, Artificial Sequence; identical to SEQ ID NO: 16654
  Description of Artificial Sequence: Synthetic coding sequence

SEQ ID NO: 16656 - DNA, 99 bp, Artificial Sequence
  Description of Artificial Sequence: Synthetic coding sequence
atgctgagaggcaccatgaccgcctggagaggcatgagacccgaggtgaccctggcctgcctgctgctggccaccgccggctgcttcgccgacctgtag

SEQ ID NO: 16657 - DNA, 3345 bp, Artificial Sequence; identical to SEQ ID NO: 16651
  Description of Artificial Sequence: Synthetic coding sequence

SEQ ID NO: 16658 - DNA, 627 bp, Artificial Sequence
  Description of Artificial Sequence: Synthetic coding sequence
atgagatacgcctgcagcagcagcgaggactggcccccccccctggacatcagcagcgacggcgacgtggacgccaccgtgctgagagagctgtaccccgacagcccccccggcgtgagcctgagcagactgagatggagcgccatgatgtacaccggcagcttcacctactgggtgagaagcatgctgagcagacacaagctggacgccatcctgggcagactgggctacaccgccaccctggagagcgagttcagcctggtgcaggccatcagcaaggagaacgtgaagcagatggtgttcaagatcttcctggtgagagtgagctgcgaggccgtgctgagaaccgccggcaccagaatgctggagcccggcaccgagaagctggccagaacccacagcagacacagcagcgagaagagactggtgaagccctgcagctgcctggagggcgtgcagcccggccccggcagcggcggcccccagcagggccccagcgagggcgtgggcagcgagaccgccctggccgagggcaccgccggccagagaagcctgcccatggccctgagccccagcgaggtgagcaccgcccccaacagcctgcccagcggcagccccgtgctgtag

SEQ ID NO: 16659 - DNA, 753 bp, Artificial Sequence
  Description of Artificial Sequence: Synthetic coding sequence
gccagatacaacagaaccagctacttctaccccaccttcagcgagagcagcgagcacagccacctgctggtgagccccgtgctggtggccagcgccgtgatcggcgtggtgatcatcctgagctgcatcaccatcatcgtgggcagcatcagaagagacagacaggccagactgcagagacacagacacagacaccacagacaccaccaccaccaccaccaccacagaagaagaagacacagagagtacgagcacggctacgtgagcgacgagcacacctacagcagaagcagcagaagaatgagatacgcctgcagcagcagcgaggactggcccccccccctggacatcagcagcgacggcgacgtggacgccaccgtgctgagagagctgtaccccgacagcccccccggctacgaggagtgcgtgggccccggcgccacccagctgtacgtgcccaccgacgccccccccccctacagcctgaccgacagctgccccaccctggacggcaccagcgacagcggcagcggccacagccccggcagacaccagcaggagcagagaacccccgcccagggcggcctgcacaccgtgagcatggacaccctgcccccctacgaggccgtgtgcggcgccggcccccccagcggcctgctgcccctgcccggccccgaccccggccccagaggcagccagggcagccccacccccaccagagcccccgccagcggccccgagagaatcgtgtag

SEQ ID NO: 16660 - DNA, 780 bp, Artificial Sequence
  Description of Artificial Sequence: Synthetic coding sequence
atgagcttcaagagaccctgccccctggccagatacaacagaaccagctacttctaccccaccttcagcgagagcagcgagcacagccacctgctggtgagccccgtgctggtggccagcgccgtgatcggcgtggtgatcatcctgagctgcatcaccatcatcgtgggcagcatcagaagagacagacaggccagactgcagagacacagacacagacaccacagacaccaccaccaccaccaccaccacagaagaagaagacacagagagtacgagcacggctacgtgagcgacgagcacacctacagcagaagcagcagaagaatgagatacgcctgcagcagcagcgaggactggcccccccccctggacatcagcagcgacggcgacgtggacgccaccgtgctgagagagctgtaccccgacagcccccccggctacgaggagtgcgtgggccccggcgccacccagctgtacgtgcccaccgacgccccccccccctacagcctgaccgacagctgccccaccctggacggcaccagcgacagcggcagcggccacagccccggcagacaccagcaggagcagagaacccccgcccagggcggcctgcacaccgtgagcatggacaccctgcccccctacgaggccgtgtgcggcgccggcccccccagcggcctgctgcccctgcccggccccgaccccggccccagaggcagccagggcagccccacccccaccagagcccccgccagcggccccgagagaatcgtgtag

SEQ ID NO: 16661 - DNA, 384 bp, Artificial Sequence
  Description of Artificial Sequence: Synthetic coding sequence
atgagcgccgccggcgccagaggcctgagagccacctaccacagactgctggacaaggtggagctgatgctgcccgagaagctgagacccctgtacaaccaccccgccggccccagaaccgtgttcttctgggcccccatcatgaagtggggcctggtgtgcgccggcctggccgacatggccagacccgccgagaagctgagcaccgcccagagcgccgtgctgatggccaccggcttcatctggagcagatacagcctggtgatcatccccaagaactggagcctgttcgccgtgaacttcttcgtgggcgccgccggcgccagccagctgttcagaatctggagatacaaccaggagctgaaggccaaggcccacaagtag

SEQ ID NO: 16662 - DNA, 384 bp, Artificial Sequence; identical to SEQ ID NO: 16661
  Description of Artificial Sequence: Synthetic coding sequence

SEQ ID NO: 16663 - DNA, 318 bp, Artificial Sequence
  Description of Artificial Sequence: Synthetic coding sequence
atgagcgccgccggcgccagaggcctgagagccacctaccacagactgctggacaaggtggagctgatgctgcccgagaagctgagacccctgtacaaccaccccgccggccccagaaccgtgttcttctgggcccccatcatgaagtggggcctggtgtgcgccggcctggccgacatggccagacccgccgagaagctgagcaccgcccagagcgccgtgctgatggccaccggcttcatctggagcagatacagcctggtgatcatccccaagaactggagcctgttcgccgtgaacttcttcgtgggcgcctag

SEQ ID NO: 16664 - DNA, 330 bp, Artificial Sequence
  Description of Artificial Sequence: Synthetic coding sequence
atggccggcgccctggtgagaaaggccgccgactacgtgagaagcaaggacttcagagactacctgatgagcaagcacttctggggccccgtggccaactggggcctgcccatcgccgccatcaacgacatgaagaagagccccgagatcatcagcggcagaatgaccttcgccctgtgctgctacagcctgaccttcatgagattcgcctacaaggtgcagcccagaaactggctgctgttcgcctgccacgccaccaacgaggtggcccagctgatccagggcggcagactgatcaagcacgagatgaccaagaccgccagcgcctag

SEQ ID NO: 16665 - DNA, 330 bp, Artificial Sequence
  Description of Artificial Sequence: Synthetic coding sequence
atggccggcgccctggtgagaaaggccgccgactacgtgagaagcaaggacttcagagactacctgatgagcacccacttctggggccccgtggccaactggggcctgcccatcgccgccatcaacgacatgaagaagagccccgagatcatcagcggcagaatgaccttcgccctgtgctgctacagcctgaccttcatgagattcgcctacaaggtgcagcccagaaactggctgctgttcgcctgccacgccaccaacgaggtggcccagctgatccagggcggcagactgatcaagcacgagatgaccaagaccgccagcgcctag

SEQ ID NO: 16666 - DNA, 201 bp, Artificial Sequence
  Description of Artificial Sequence: Synthetic coding sequence
atgaagaagagccccgagatcatcagcggcagaatgaccttcgccctgtgctgctacagcctgaccttcatgagattcgcctacaaggtgcagcccagaaactggctgctgttcgcctgccacgccaccaacgaggtggcccagctgatccagggcggcagactgatcaagcacgagatgaccaagaccgccagcgcctag

SEQ ID NO: 16667 - DNA, 642 bp, Artificial Sequence
  Description of Artificial Sequence: Synthetic coding sequence
atgcccgacgagaacatcttcctgttcgtgcccaacctgatcggctacgccagaatcgtgttcgccatcatcagcttctacttcatgccctgctgccccctgaccgccagcagcttctacctgctgagcggcctgctggacgccttcgacggccacgccgccagagccctgaaccagggcaccagattcggcgccatgctggacatgctgaccgacagatgcagcaccatgtgcctgctggtgaacctggccctgctgtaccccggcgccaccctgttcttccagatcagcatgagcctggacgtggccagccactggctgcacctgcacagcagcgtggtgagaggcagcgagagccacaagatgatcgacctgagcggcaaccccgtgctgagaatctactacaccagcagacccgccctgttcaccctgtgcgccggcaacgagctgttctactgcctgctgtacctgttccacttcagcgagggccccctggtgggcagcgtgggcctgttcagaatgggcctgtgggtgaccgcccccatcgccctgctgaagagcctgatcagcgtgatccacctgatcaccgccgccagaaacatggccgccctggacgccgccgacagagccaagaagaagtag

SEQ ID NO: 16668 - DNA, 1008 bp, Artificial Sequence
  Description of Artificial Sequence: Synthetic coding sequence
atgatcctggccagcgtgctgagaagcggccccggcggcggcctgcccctgagacccctgctgggccccgccctggccctgagagccagaagcaccagcgccaccgacacccaccacgtggagatggccagagagagaagcaagaccgtgaccagcttctacaaccagagcgccatcgacgccgccgccgagaagcccagcgtgagactgacccccaccatgatgctgtacgccggcagaagccaggacggcagccacctgctgaagagcgccagatacctgcagcaggagctgcccgtgagaatcgcccacagaatcaagggcttcagatgcctgcccttcatcatcggctgcaaccccaccatcctgcacgtgcacgagctgtacatcagagccttccagaagctgaccgacttcccccccatcaaggaccaggccgacgaggcccagtactgccagctggtgagacagctgctggacgaccacaaggacgtggtgaccctgctggccgagggcctgagagagagcagaaagcacatcgaggacgagaagctggtgagatacttcctggacaagaccctgaccagcagactgggcatcagaatgctggccacccaccacctggccctgcacgaggacaagcccgacttcgtgggcatcatctgcaccagactgagccccaagaagatcatcgagaagtgggtggacttcgccagaagactgtgcgagcacaagtacggcaacgcccccagagtgagaatcaacggccacgtggccgccagattccccttcatccccatgcccctggactacatcctgcccgagctgctgaagaacgccatgagaatcagcgacagaggcggcggcatcgcccacaaggacctggacagagtgatggactaccacttcaccaccgccgaggccagcacccaggaccccagaatcagccccctgttcggccacctggacatgcacagcggcgcccagagcggccccatgcacggctag

SEQ ID NO: 16669 - DNA, 1098 bp, Artificial Sequence
  Description of Artificial Sequence: Synthetic coding sequence
atgatcctggccagcgtgctgagaagcggccccggcggcggcctgcccctgagacccctgctgggccccgccctggccctgagagccagaagcaccagcgccaccgacacccaccacgtggagatggccagagagagaagcaagaccgtgaccagcttctacaaccagagcgccatcgacgccgccgccgagaagcccagcgtgagactgacccccaccatgatgctgtacgccggcagaagccaggacggcagccacctgctgaagagcgccagatacctgcagcaggagctgcccgtgagaatcgcccacagaatcaagggcttcagatgcctgcccttcatcatcggctgcaaccccaccatcctgcacgtgcacgagctgtacatcagagccttccagaagctgaccgacttcccccccatcaaggaccaggccgacgaggcccagtactgccagctggtgagacagctgctggacgaccacaaggacgtggtgaccctgctggccgagggcctgagagagagcagaaagcacatcgaggacgagaagctggtgagatacttcctggacaagaccctgaccagcagactgggcatcagaatgctggccacccaccacctggccctgcacgaggacaagcccgacttcgtgggcatcatctgcaccagactgagccccaagaagatcatcgagaagtgggtggacttcgccagaagactgtgcgagcacaagtacggcaacgcccccagagtgagaatcaacggccacgtggccgccagattccccttcatccccatgcccctggactacatcctgcccgagctgctgaagaacgccatgagagccaccatggagagccacctggacaccccctacaacgtgcccgacgtggtgatcaccatcgccaacaacgacgtggacctgatcatcagaatcagcgacagaggcggcggcatcgcccacaaggacctggacagagtgatggactaccacttcaccaccgccgaggccagcacccaggaccccagaatcagccccctgttcggccacctggacatgcacagcggcgcccagagcggccccatgcacggctag

SEQ ID NO: 16670 - DNA, 1239 bp, Artificial Sequence
  Description of Artificial Sequence: Synthetic coding sequence
atgatcctggccagcgtgctgagaagcggccccggcggcggcctgcccctgagacccctgctgggccccgccctggccctgagagccagaagcaccagcgccaccgacacccaccacgtggagatggccagagagagaagcaagaccgtgaccagcttctacaaccagagcgccatcgacgccgccgccgagaagcccagcgtgagactgacccccaccatgatgctgtacgccggcagaagccaggacggcagccacctgctgaagagcgccagatacctgcagcaggagctgcccgtgagaatcgcccacagaatcaagggcttcagatgcctgcccttcatcatcggctgcaaccccaccatcctgcacgtgcacgagctgtacatcagagccttccagaagctgaccgacttcccccccatcaaggaccaggccgacgaggcccagtactgccagctggtgagacagctgctggacgaccacaaggacgtggtgaccctgctggccgagggcctgagagagagcagaaagcacatcgaggacgagaagctggtgagatacttcctggacaagaccctgaccagcagactgggcatcagaatgctggccacccaccacctggccctgcacgaggacaagcccgacttcgtgggcatcatctgcaccagactgagccccaagaagatcatcgagaagtgggtggacttcgccagaagactgtgcgagcacaagtacggcaacgcccccagagtgagaatcaacggccacgtggccgccagattccccttcatccccatgcccctggactacatcctgcccgagctgctgaagaacgccatgagagccaccatggagagccacctggacaccccctacaacgtgcccgacgtggtgatcaccatcgccaacaacgacgtggacctgatcatcagaatcagcgacagaggcggcggcatcgcccacaaggacctggacagagtgatggactaccacttcaccaccgccgaggccagcacccaggaccccagaatcagccccctgttcggccacctggacatgcacagcggcgcccagagcggccccatgcacggcttcggcttcggcctgcccaccagcagagcctacgccgagtacctgggcggcagcctgcagctgcagagcctgcagggcatcggcaccgacgtgtacctgagactgagacacatcgacggcagagaggagagcttcagaatctag

SEQ ID NO: 16671 - DNA, 756 bp, Artificial Sequence
  Description of Artificial Sequence: Synthetic coding sequence
atgggcgccagagccagcggcggccccctggccagagccggcctgctgctgctgctgctgctgctgctgctgctgggcctgctggcccccggcgcccagggcgccagaggcagaggcggcgccgagaagaacagctacagaagaaccgtgaacaccttcagccagagcgtgagcagcctgttcggcgaggacaacgtgagagccgcccagaagttcctggccagactgaccgagagattcgtgctgggcgtggacatgttcgtggagaccctgtggaaggtgtggaccgagctgctggacgtgctgggcctggacgtgagcaacctgagccagtacttcagccccgccagcgtgagcagcagccccgccagagccctgctgctggtgggcgtggtgctgctggcctactggttcctgagcctgaccctgggcttcaccttcagcgtgctgcacgtggtgttcggcagattcttctggatcgtgagagtggtgctgttcagcatgagctgcgtgtacatcctgcacaagtacgagggcgagcccgagaacgccgtgctgcccctgtgcttcgtggtggccgtgtacttcatgaccggccccatgggcttctactggagaagcagccccagcggccccagcaaccccagcaaccccagcgtggaggagaagctggagcacctggagaagcaggtgagactgctgaacatcagactgaacagagtgctggagagcctggacagaagcaaggacaagtag

SEQ ID NO: 16672 - DNA, 1236 bp, Artificial Sequence
  Description of Artificial Sequence: Synthetic coding sequence
atgacccactggttccacagaaaccccctgaaggccaccgcccccgtgagcttcaactactacggcgtggtgaccggccccagcgccagcaagatctgcaacgacctgagaagcagcagagccagactgctggagctgttcaccgacctgagctgcaaccccgagatgatgaagaacgccgccgacagctacttcagcctgctgcagggcttcatcaacagcctggacgagagcacccaggagagcaagctgagatacatccagaacttcaagtggaccgacaccctgcagggccaggtgcccagcgcccagcaggacgccgtgttcgagctgatcagcatgggcttcaacgtggccctgtggtacaccaagtacgccagcagactggccggcaaggagaacatcaccgaggacgaggccaaggaggtgcacagaagcctgaagatcgccgccggcatcttcaagcacctgaaggagagccacctgcccaagctgatcacccccgccgagaagggcagagacctggagagcagactgatcgaggcctacgtgatccagtgccaggccgaggcccaggaggtgaccatcgccagagccatcgagctgaagcacgcccccggcctgatcgccgccctggcctacgagaccgccaacttctaccagaaggccgaccacaccctgagcagcctggagcccgcctacagcgccaagtggagaaagtacctgcacctgaagatgtgcttctacaccgcctacgcctactgctaccacggcgagaccctgctggccagcgacaagtgcggcgaggccatcagaagcctgcaggaggccgagaagctgtacgccaaggccgaggccctgtgcaaggagtacggcgagaccaagggccccggccccaccgtgaagcccagcggccacctgttcttcagaaagctgggcaacctggtgaagaacaccctggagaagtgccagagagagaacggcttcatctacttccagaagatccccaccgaggccccccagctggagctgaaggccaactacggcctggtggagcccatccccttcgagttcccccccaccagcgtgcagtggacccccgagaccctggccgccttcgacctgaccaagagacccaaggacgacagcaccaagcccaagcccgaggaggaggtgaagcccgtgaaggagcccgacatcaagccccagaaggacaccggctgctacatcagctag

SEQ ID NO: 16673 - DNA, 648 bp, Artificial Sequence
  Description of Artificial Sequence: Synthetic coding sequence
atgacccactggttccacagaaaccccctgaaggccaccgcccccgtgagcttcaactactacggcgtggtgaccggccccagcgccagcaagatctgcaacgacctgagaagcagcagagccagactgctggagctgttcaccgacctgagctgcaaccccgagatgatgaagaacgccgccgacagctacttcagcctgctgcagggcttcatcaacagcctggacgagagcacccaggagagcaagctgagatacatccagaacttcaagtggaccgacaccctgcagggccaggtgcccagcgcccagcaggacgccgtgttcgagctgatcagcatgggcttcaacgtggccctgtggtacaccaagtacgccagcagactggccggcaaggagaacatcaccgaggacgaggccaaggaggtgcacagaagcctgaagatcgccgccggcatcttcaagcacctgaaggagagccacctgcccaagctgatcacccccgccgagaagggcagagacctggagagcagactgatcgaggcctacgtgatccagtgccaggccgaggcccaggaggtgaccatcgccagagccatcgagctgaagcacgcccccggcctgatcgccgccctggcctacgagtag

SEQ ID NO: 16674 - DNA, 1017 bp, Artificial Sequence
  Description of Artificial Sequence: Synthetic coding sequence
atgacccactggttccacagaaaccccctgaaggccaccgcccccgtgagcttcaactactacggcgtggtgaccggccccagcgccagcaagatctgcaacgacctgagaagcagcagagccagactgctggagctgttcaccgacctgagctgcaaccccgagatgatgaagaacgccgccgacagctacttcagcctgctgcagggcttcatcaacagcctggacgagagcacccaggagagcaagctgagatacatccagaacttcaagtggaccgacaccctgcagggccaggtgcccagcgcccagcaggacgccgtgttcgagctgatcagcatgggcttcaacgtggccctgtggtacaccaagtacgccagcagactggccggcaaggagaacatcaccgaggacgaggccaaggaggtgcacagaagcctgaagatcgccgccggcatcttcaagcacctgaaggagagccacctgcccaagctgatcacccccgccgagaagggcagagacctggagagcagactgatcgaggcctacgtgatccagtgccaggccgaggcccaggaggtgaccatcgccagagccatcgagctgaagcacgcccccggcctgatcgccgccctggcctacgagaccgccaacttctaccagaaggccgaccacaccctgagcagcctggagcccgcctacagcgccaagtggagaaagtacctgcacctgaagatgtgcttctacaccgcctacgcctactgctaccacggcgagaccctgctggccagcgacaagtgcggcgaggccatcagaagcctgcaggaggccgagaagctgtacgccaaggccgaggccctgtgcaaggagtacggcgagaccaagggccccggccccaccgtgaagcccagcggccacctgttcttcagaaagctgggcaacctggtgaagaacaccctggagaagtgccagagagagaacggcttcatcctgaaccccaaccagaagaagaagtag

SEQ ID NO: 16675 - DNA, 1140 bp, Artificial Sequence
  Description of Artificial Sequence: Synthetic coding sequence
atgacccactggttccacagaaaccccctgaaggccaccgcccccgtgagcttcaactactacggcgtggtgaccggccccagcgccagcaagatctgcaacgacctgagaagcagcagagccagactgctggagctgttcaccgacctgagctgcaaccccgagatgatgaagaacgccgccgacagctacttcagcctgctgcagggcttcatcaacagcctggacgagagcacccaggagagcaagctgagatacatccagaacttcaagtggaccgacaccctgcagggccaggtgcccagcatcaccgaggacgaggccaaggaggtgcacagaagcctgaagatcgccgccggcatcttcaagcacctgaaggagagccacctgcccaagctgatcacccccgccgagaagggcagagacctggagagcagactgatcgaggcctacgtgatccagtgccaggccgaggcccaggaggtgaccatcgccagagccatcgagctgaagcacgcccccggcctgatcgccgccctggcctacgagaccgccaacttctaccagaaggccgaccacaccctgagcagcctggagcccgcctacagcgccaagtggagaaagtacctgcacctgaagatgtgcttctacaccgcctacgcctactgctaccacggcgagaccctgctggccagcgacaagtgcggcgaggccatcagaagcctgcaggaggccgagaagctgtacgccaaggccgaggccctgtgcaaggagtacggcgagaccaagggccccggccccaccgtgaagcccagcggccacctgttcttcagaaagctgggcaacctggtgaagaacaccctggagaagtgccagagagagaacggcttcatctacttccagaagatccccaccgaggccccccagctggagctgaaggccaactacggcctggtggagcccatccccttcgagttcccccccaccagcgtgcagtggacccccgagaccctggccgccttcgacctgaccaagagacccaaggacgacagcaccaagcccaagcccgaggaggaggtgaagcccgtgaaggagcccgacatcaagccccagaaggacaccggctgctacatcagctag

SEQ ID NO: 16676 - DNA, 309 bp, Artificial Sequence
  Description of Artificial Sequence: Synthetic coding sequence
atgagcagcccccccgagggcaagctggagaccaaggccggccacccccccgccgtgaaggccggcggcatgagaatcgtgcagaagcacccccacaccggcgacaccaaggaggagaaggacaaggacgaccaggagtgggagagccccagcccccccaagcccaccgtgttcatcagcggcgtgatcgccagaggcgacaaggacttcccccccgccgccgcccaggtggcccaccagaagccccacgccagcatggacaagcaccccagccccagaacccagcacatccagcagcccagaaagtag

SEQ ID NO: 16677 - DNA, 2274 bp, Artificial Sequence
  Description of Artificial Sequence: Synthetic coding sequence
ctggccaagaagatcaccctgaagaagaagctggaggaggaggaggccgaggtgaagagaaaggccaccgacgccgcctaccaggccagacaggccgtgaagaccccccccagaagactgcccaccgtgatggtgagaagccccatcgacagcgccagccccggcggcgactaccccctgggcgacctgacccccaccaccatggaggaggccaccagcggcgtgacccccggcaccctgcccagcacccccgtgaccagcttccccggcatccccgacaccctgccccccggcagcgcccccctggaggcccccatgacccccgtgaccgacgacagcccccagaagaagatgctgggccagaaggccacccccccccccagccccctgctgagcgagctgctgaagaagggcagcctgctgcccaccagccccagactggtgaacgagagcgagatggccgtggccagcggccacctgaacagcaccggcgtgctgctggaggtgggcggcgtgctgcccatgatccacggcggcgagatccagcagacccccaacaccgtggccgccagccccgccgccagcgagagcgtgagccaggccaccatcgtgatgatgcccgccctgcccgcccccagcagcgcccccgccgtgagcaccaccgagagcgtggcccccgtgagccagcccgacaactgcgtgcccatggaggccgtgggcgacccccacaccgtgaccgtgagcatggacagcagcgagatcagcatgatcatcaacagcatcaaggaggagtgcttcagaagcggcgtggccgaggcccccgtgggcagcaaggcccccagcatcgacggcaaggaggagctggacctggccgagaagatggacatcgccgtgagctacaccggcgaggagctggacttcgagaccgtgggcgacatcatcgccatcatcgaggacaaggtggacgaccaccccgaggtgctggacgtggccgccgtggaggccgccctgagcttctgcgaggagaacgacgacccccagagcctgcccggcccctgggagcaccccatccagcaggagagagacaagcccgtgcccctgcccgcccccgagatgaccgtgaagcaggagagactggacttcgaggagaccgagaacaagggcatccacgagctggtggacatcagagagcccagcgccgagatcaaggtggagcccgccgagcccgagcccgtgatcagcggcgccgagatcgtggccggcgtggtgcccgccaccagcatggagccccccgagctgagaagccaggacctggacgaggagctgggcagcaccgccgccggcgagatcgtggaggccgacgtggccatcggcaagggcgacgagacccccctgaccaacgtgaagaccgaggccagccccgagagcatgctgagccccagccacggcagcaaccccatcgaggaccccctggaggccgagacccagcacaagttcgagatgagcgacagcctgaaggaggagagcggcaccatcttcggcagccagatcaaggacgcccccggcgaggacgaggaggaggacggcgtgagcgaggccgccagcctggaggagcccaaggaggaggaccagggcgagggctacctgagcgagatggacaacgagccccccgtgagcgagagcgacgacggcttcagcatccacaacgccaccctgcagagccacaccctggccgacagcatccccagcagccccgccagcagccagttcagcgtgtgcagcgaggaccaggaggccatccaggcccagaagatctggaagaaggccatcatgctggtgtggagagccgccgccaaccacagatacgccaacgtgttcctgcagcccgtgaccgacgacatcgcccccggctaccacagcatcgtgcagagacccatggacctgagcaccatcaagaagaacatcgagaacggcctgatcagaagcaccgccgagttccagagagacatcatgctgatgttccagaacgccgtgatgtacaacagcagcgaccacgacgtgtaccacatggccgtggagatgcagagagacgtgctggagcagatccagcagttcctggccacccagctgatcatgcagaccagcgagagcggcatcagcgccaagagcctgagaggcagagacagcaccagaaagcaggacgccagcgagaaggacggcggcaccagaggcagaagatgcgccatcgaggccgacatgaagatgaagaagtag

SEQ ID NO: 16678 - DNA, 3708 bp, Artificial Sequence
  Description of Artificial Sequence: Synthetic coding sequence
atggccaccggcaccggcaagcacaagctgctgagcaccggccccaccgagccctggagcatcagagagaagctgtgcctggccagcagcgtgatgagaagcggcgaccagaactgggtgagcgtgagcagagccatcaagcccttcgccgagcccggcagaccccccgactggttcagccagaagcactgcgccagccagtacagcgagctgctggagaccaccgagacccccaagagaaagagaggcgagaagggcgaggtggtggagaccgtggaggacgtgatcgtgagaaagctgaccgccgagagagtggaggagctgaagaaggtgatcaaggagacccaggagagatacagaagactgaagagagacgccgagctgatccaggccggccacatggacagcagactggacgagctgtgcaacgacatcgccaccaagaagaagctggaggaggaggaggccgaggtgaagagaaaggccaccgacgccgcctaccaggccagacaggccgtgaagaccccccccagaagactgcccaccgtgatggtgagaagccccatcgacagcgccagccccggcggcgactaccccctgggcgacctgacccccaccaccatggaggaggccaccagcggcgtgaacgagagcgagatggccgtggccagcggccacctgaacagcaccggcgtgctgctggaggtgggcggcgtgctgcccatgatccacggcggcgagatccagcagacccccaacaccgtggccgccagccccgccgccagcggcgcccccaccctgagcagactgctggaggccggccccacccagttcaccacccccctggccagcttcaccaccgtggccagcgagccccccgtgaagctggtgcccccccccgtggagagcgtgagccaggccaccatcgtgatgatgcccgccctgcccgcccccagcagcgcccccgccgtgagcaccaccgagagcgtggcccccgtgagccagcccgacaactgcgtgcccatggaggccgtgggcgacccccacaccgtgaccgtgagcatggacagcagcgagatcagcatgatcatcaacagcatcaaggaggagtgcttcagaagcggcgtggccgaggcccccgtgggcagcaaggcccccagcatcgacggcaaggaggagctggacctggccgagaagatggacatcgccgtgagctacaccggcgaggagctggacttcgagaccgtgggcgacatcatcgccatcatcgaggacaaggtggacgaccaccccgaggtgctggacgtggccgccgtggaggccgccctgagcttctgcgaggagaacgacgacccccagagcctgcccggcccctgggagcaccccatccagcaggagagagacaagcccgtgcccctgcccgcccccgagatgaccgtgaagcaggagagactggacttcgaggagaccgagaacaagggcatccacgagctggtggacatcagagagcccagcgccgagatcaaggtggagcccgccgagcccgagcccgtgatcagcggcgccgagatcgtggccggcgtggtgcccgccaccagcatggagccccccgagctgagaagccaggacctggacgaggagctgggcagcaccgccgccggcgagatcgtggaggccgacgtggccatcggcaagggcgacgagacccccctgaccaacgtgaagaccgaggccagccccgagagcatgctgagccccagccacggcagcaaccccatcgaggaccccctggaggccgagacccagcacaagttcgagatgagcgacagcctgaaggaggagagcggcaccatcttcggcagccagatcaaggacgcccccggcgaggacgaggaggaggacggcgtgagcgaggccgccagcctggaggagcccaaggaggaggaccagggcgagggctacctgagcgagatggacaacgagccccccgtgagcgagagcgacgacggcttcagcatccacaacgccaccctgcagagccacaccctggccgacagcatccccagcagccccgccagcagccagttcagcgtgtgcagcgaggaccaggaggccatccaggcccagaagatctggaagaaggccatcatgctggtgtggagagccgccgccaaccacagatacgccaacgtgttcctgcagcccgtgaccgacgacatcgcccccggctaccacagcatcgtgcagagacccatggacctgagcaccatcaagaagaacatcgagaacggcctgatcagaagcaccgccgagttccagagagacatcatgctgatgttccagaacgccgtgatgtacaacagcagcgaccacgacgtgtaccacatggccgtggagatgcagagagacgtgctggagcagatccagcagttcctggccacccagctgatcatgcagaccagcgagagcggcatcagcgccaagagcctgagaggcagagacagcaccagaaagcaggacgccagcgagaaggacagcgtgcccatgggcagccccgccttcctgctgagcctgttcatgggccacgagtgggtgtggctggacagcgagcaggaccaccccaacgacagcgagctgagcaacgactgcagaagcctgttcagcagctgggacagcagcctggacctggacgtgggcaactggagagagaccgaggaccccgaggccgaggagctggaggagagcagccccgagagagagcccagcgagctgctggtgggcgacggcggcagcgaggagagccaggaggccgccagaaaggccagccaccagaacctgctgcacttcctgagcgaggtggcctacctgatggagcccctgtgcatcagcagcaacgagagcagcgagggctgctgcccccccagcggcaccagacaggagggcagagagatcaaggccagcgagggcgagagagagctgtgcagagagaccgaggagctgagcgccaagggcgaccccctggtggccgagaagcccctgggcgagaacggcaagcccgaggtggccagcgcccccagcgtgatctgcaccgtgcagggcctgctgaccgagagcgaggagggcgaggcccagcaggagagcaagggcgaggaccagggcgaggtgtacgtgagcgagatggaggaccagccccccagcggcgagtgcgacgacgccttcaacatcaaggagacccccctggtggacaccctgttcagccacgccaccagcagcaagctgaccgacctgagccaggacgaccccgtgcaggaccacctgctgttcaagaagaccctgctgcccgtgtggaagatgatcgccagccacagattcagcagccccttcctgaagcccgtgagcgagagacaggcccccggctacaaggacgtggtgaagagacccatggacctgaccagcctgaagagaaacctgagcaagggcagaatcagaaccatggcccagttcctgagagacctgatgctgatgttccagaacgccgtgatgtacaacgacagcgaccaccacgtgtaccacatggccgtggagatgagacaggaggtgctggagcagatccaggtgctgaacatctggctggacaagagaaagggcagcagcagcctggagggcgagcccgccaaccccgtggacgacggcaagcccgtgttctag

SEQ ID NO: 16679 - DNA, 2601 bp, Artificial Sequence
  Description of Artificial Sequence: Synthetic coding sequence
atggccaccggcaccggcaagcacaagctgctgagcaccggccccaccgagccctggagcatcagagagaagctgtgcctggccagcagcgtgatgagaagcggcgaccagaactgggtgagcgtgagcagagccatcaagcccttcgccgagcccggcagaccccccgactggttcagccagaagcactgcgccagccagtacagcgagctgctggagaccaccgagacccccaagagaaagagaggcgagaagggcgaggtggtggagaccgtggaggacgtgatcgtgagaaagctgaccgccgagagagtggaggagctgaagaaggtgatcaaggagacccaggagagatacagaagactgaagagagacgccgagctgatccaggccggccacatggacagcagactggacgagctgtgcaacgacatcgccaccaagaagaagctggaggaggaggaggccgaggtgaagagaaaggccaccgacgccgcctaccaggccagacaggccgtgaagaccccccccagaagactgcccaccgtgatggtgagaagccccatcgacagcgccagccccggcggcgactaccccctgggcgacctgacccccaccaccatggaggaggccaccagcggcgtgacccccggcaccctgcccagcacccccgtgaccagcttccccggcatccccgacaccctgccccccggcagcgcccccctggaggcccccatgacccccgtgaccgacgacagcccccagaagaagatgctgggccagaaggccacccccccccccagccccctgctgagcgagctgctgaagaagggcagcctgctgcccaccagccccagactggtgaacgagagcgagatggccgtggccagcggccacctgaacagcaccggcgtgctgctggaggtgggcggcgtgctgcccatgatccacggcggcgagatccagcagacccccaacaccgtggccgccagccccgccgccagcgtgagccagcccgacaactgcgtgcccatggaggccgtgggcgacccccacaccgtgaccgtgagcatggacagcagcgagatcagcatgatcatcaacagcatcaaggaggagtgcttcagaagcggcgtggccgaggcccccgtgggcagcaaggcccccagcatcgacggcaaggaggagctggacctggccgagaagatggacatcgccgtgagctacaccggcgaggagctggacttcgagaccgtgggcgacatcatcgccatcatcgaggacaaggtggacgaccaccccgaggtgctggacgtggccgccgtggaggccgccctgagcttctgcgaggagaacgacgacccccagagcctgcccggcccctgggagcaccccatccagcaggagagagacaagcccgtgcccctgcccgcccccgagatgaccgtgaagcaggagagactggacttcgaggagaccgagaacaagggcatccacgagctggtggacatcagagagcccagcgccgagatcaaggtggagcccgccgagcccgagcccgtgatcagcggcgccgagatcgtggccggcgtggtgcccgccaccagcatggagccccccgagctgagaagccaggacctggacgaggagctgggcagcaccgccgccggcgagatcgtggaggccgacgtggccatcggcaagggcgacgagacccccctgaccaacgtgaagaccgaggccagccccgagagcatgctgagccccagccacggcagcaaccccatcgaggaccccctggaggccgagacccagcacaagttcgagatgagcgacagcctgaaggaggagagcggcaccatcttcggcagccagatcaaggacgcccccggcgaggacgaggaggaggacggcgtgagcgaggccgccagcctggaggagcccaaggaggaggaccagggcgagggctacctgagcgagatggacaacgagccccccgtgagcgagagcgacgacggcttcagcatccacaacgccaccctgcagagccacaccctggccgacagcatccccagcagccccgccagcagccagttcagcgtgtgcagcgaggaccaggaggccatccaggcccagaagatctggaagaaggccatcatgctggtgtggagagccgccgccaaccacagatacgccaacgtgttcctgcagcccgtgaccgacgacatcgcccccggctaccacagcatcgtgcagagacccatggacctgagcaccatcaagaagaacatcgagaacggcctgatcagaagcaccgccgagttccagagagacatcatgctgatgttccagaacgccgtgatgtacaacagcagcgaccacgacgtgtaccacatggccgtggagatgcagagagacgtgctggagcagatccagcagttcctggccacccagctgatcatgcagaccagcgagagcggcatcagcgccaagagcctgagaggcagagacagcaccagaaagcaggacgccagcgagaaggacggcggcaccagaggcagaagatgcgccatcgaggccgacatgaagatgaagaagtag

SEQ ID NO: 16680 - DNA, 2586 bp, Artificial Sequence
  Description of Artificial Sequence: Synthetic coding sequence
ggcaagcacaagctgctgagcaccggccccaccgagccctggagcatcagagagaagctgtgcctggccagcagcgtgatgagaagcggcgaccagaactgggtgagcgtgagcagagccatcaagcccttcgccgagcccggcagaccccccgactggttcagccagaagcactgcgccagccagtacagcgagctgctggagaccaccgagacccccaagagaaagagaggcgagaagggcgaggtggtggagaccgtggaggacgtgatcgtgagaaagctgaccgccgagagagtggaggagctgaagaaggtgatcaaggagacccaggagagatacagaagactgaagagagacgccgagctgatccaggccggccacatggacagcagactggacgagctgtgcaacgacatcgccaccaagaagaagctggaggaggaggaggccgaggtgaagagaaaggccaccgacgccgcctaccaggccagacaggccgtgaagaccccccccagaagactgcccaccgtgatggtgagaagccccatcgacagcgccagccccggcggcgactaccccctgggcgacctgacccccaccaccatggaggaggccaccagcggcgtgacccccggcaccctgcccagcacccccgtgaccagcttccccggcatccccgacaccctgccccccggcagcgcccccctggaggcccccatgacccccgtgaccgacgacagcccccagaagaagatgctgggccagaaggccacccccccccccagccccctgctgagcgagctgctgaagaagggcagcctgctgcccaccagccccagactggtgaacgagagcgagatggccgtggccagcggccacctgaacagcaccggcgtgctgctggaggtgggcggcgtgctgcccatgatccacggcggcgagatccagcagacccccaacaccgtggccgccagccccgccgccagcgtgagccagcccgacaactgcgtgcccatggaggccgtgggcgacccccacaccgtgaccgtgagcatggacagcagcgagatcagcatgatcatcaacagcatcaaggaggagtgcttcagaagcggcgtggccgaggcccccgtgggcagcaaggcccccagcatcgacggcaaggaggagctggacctggccgagaagatggacatcgccgtgagctacaccggcgaggagctggacttcgagaccgtgggcgacatcatcgccatcatcgaggacaaggtggacgaccaccccgaggtgctggacgtggccgccgtggaggccgccctgagcttctgcgaggagaacgacgacccccagagcctgcccggcccctgggagcaccccatccagcaggagagagacaagcccgtgcccctgcccgcccccgagatgaccgtgaagcaggagagactggacttcgaggagaccgagaacaagggcatccacgagctggtggacatcagagagcccagcgccgagatcaaggtggagcccgccgagcccgagcccgtgatcagcggcgccgagatcgtggccggcgtggtgcccgccaccagcatggagccccccgagctgagaagccaggacctggacgaggagctgggcagcaccgccgccggcgagatcgtggaggccgacgtggccatcggcaagggcgacgagacccccctgaccaacgtgaagaccgaggccagccccgagagcatgctgagccccagccacggcagcaaccccatcgaggaccccctggaggccgagacccagcacaagttcgagatgagcgacagcctgaaggaggagagcggcaccatcttcggcagccagatcaaggacgcccccggcgaggacgaggaggaggacggcgtgagcgaggccgccagcctggaggagcccaaggaggaggaccagggcgagggctacctgagcgagatggacaacgagccccccgtgagcgagagcgacgacggcttcagcatccacaacgccaccctgcagagccacaccctggccgacagcatccccagcagccccgccagcagccagttcagcgtgtgcagcgaggaccaggaggccatccaggcccagaagatctggaagaaggccatcatgctggtgtggagagccgccgccaaccacagatacgccaacgtgttcctgcagcccgtgaccgacgacatcgcccccggctaccacagcatcgtgcagagacccatggacctgagcaccatcaagaagaacatcgagaacggcctgatcagaagcaccgccgagttccagagagacatcatgctgatgttccagaacgccgtgatgtacaacagcagcgaccacgacgtgtaccacatggccgtggagatgcagagagacgtgctggagcagatccagcagttcctggccacccagctgatcatgcagaccagcgagagcggcatcagcgccaagagcctgagaggcagagacagcaccagaaagcaggacgccagcgagaaggacggcggcaccagaggcagaagatgcgccatcgaggccgacatgaagatgaagaagtag

SEQ ID NO: 16681 - DNA, 2679 bp, Artificial Sequence
  Description of Artificial Sequence: Synthetic coding sequence
ggcaagcacaagctgctgagcaccggccccaccgagccctggagcatcagagagaagctgtgcctggccagcagcgtgatgagaagcggcgaccagaactgggtgagcgtgagcagagccatcaagcccttcgccgagcccggcagaccccccgactggttcagccagaagcactgcgccagccagtacagcgagctgctggagaccaccgagacccccaagagaaagagaggcgagaagggcgaggtggtggagaccgtggaggacgtgatcgtgagaaagctgaccgccgagagagtggaggagctgaagaaggtgatcaaggagacccaggagagatacagaagactgaagagagacgccgagctgatccaggccggccacatggacagcagactggacgagctgtgcaacgacatcgccaccaagaagaagctggaggaggaggaggccgaggtgaagagaaaggccaccgacgccgcctaccaggccagacaggccgtgaagaccccccccagaagactgcccaccgtgatggtgagaagccccatcgacagcgccagccccggcggcgactaccccctgggcgacctgacccccaccaccatggaggaggccaccagcggcgtgacccccggcaccctgcccagcacccccgtgaccagcttccccggcatccccgacaccctgccccccggcagcgcccccctggaggcccccatgacccccgtgaccgacgacagcccccagaagaagatgctgggccagaaggccacccccccccccagccccctgctgagcgagctgctgaagaagggcagcctgctgcccaccagccccagactggtgaacgagagcgagatggccgtggccagcggccacctgaacagcaccggcgtgctgctggaggtgggcggcgtgctgcccatgatccacggcggcgagatccagcagacccccaacaccgtggccgccagccccgccgccagcgagagcgtgagccaggccaccatcgtgatgatgcccgccctgcccgcccccagcagcgcccccgccgtgagcaccaccgagagcgtggcccccgtgagccagcccgacaactgcgtgcccatggaggccgtgggcgacccccacaccgtgaccgtgagcatggacagcagcgagatcagcatgatcatcaacagcatcaaggaggagtgcttcagaagcggcgtggccgaggcccccgtgggcagcaaggcccccagcatcgacggcaaggaggagctggacctggccgagaagatggacatcgccgtgagctacaccggcgaggagctggacttcgagaccgtgggcgacatcatcgccatcatcgaggacaaggtggacgaccaccccgaggtgctggacgtggccgccgtggaggccgccctgagcttctgcgaggagaacgacgacccccagagcctgcccggcccctgggagcaccccatccagcaggagagagacaagcccgtgcccctgcccgcccccgagatgaccgtgaagcaggagagactggacttcgaggagaccgagaacaagggcatccacgagctggtggacatcagagagcccagcgccgagatcaaggtggagcccgccgagcccgagcccgtgatcagcggcgccgagatcgtggccggcgtggtgcccgccaccagcatggagccccccgagctgagaagccaggacctggacgaggagctgggcagcaccgccgccggcgagatcgtggaggccgacgtggccatcggcaagggcgacgagacccccctgaccaacgtgaagaccgaggccagccccgagagcatgctgagccccagccacggcagcaaccccatcgaggaccccctggaggccgagacccagcacaagttcgagatgagcgacagcctgaaggaggagagcggcaccatcttcggcagccagatcaaggacgcccccggcgaggacgaggaggaggacggcgtgagcgaggccgccagcctggaggagcccaaggaggaggaccagggcgagggctacctgagcgagatggacaacgagccccccgtgagcgagagcgacgacggcttcagcatccacaacgccaccctgcagagccacaccctggccgacagcatccccagcagccccgccagcagccagttcagcgtgtgcagcgaggaccaggaggccatccaggcccagaagatctggaagaaggccatcatgctggtgtggagagccgccgccaaccacagatacgccaacgtgttcctgcagcccgtgaccgacgacatcgcccccggctaccacagcatcgtgcagagacccatggacctgagcaccatcaagaagaacatcgagaacggcctgatcagaagcaccgccgagttccagagagacatcatgctgatgttccagaacgccgtgatgtacaacagcagcgaccacgacgtgtaccacatggccgtggagatgcagagagacgtgctggagcagatccagcagttcctggccacccagctgatcatgcagaccagcgagagcggcatcagcgccaagagcctgagaggcagagacagcaccagaaagcaggacgccagcgagaaggacggcggcaccagaggcagaagatgcgccatcgaggccgacatgaagatgaagaagtag

SEQ ID NO: 16682 - DNA, 2514 bp, Artificial Sequence
  Description of Artificial Sequence: Synthetic coding sequence
atggtgcaccccagagaggccatgttcagcatcttctgccacgagaagtggagaagcaagctgcactgcgccagccagtacagcgagctgctggagaccaccgagacccccaagagaaagagaggcgagaagggcgaggtggtggagaccgtggaggacgtgatcgtgagaaagctgaccgccgagagagtggaggagctgaagaaggtgatcaaggagacccaggagagatacagaagactgaagagagacgccgagctgatccaggccggccacatggacagcagactggacgagctgtgcaacgacatcgccaccaagaagaagctggaggaggaggaggccgaggtgaagagaaaggccaccgacgccgcctaccaggccagacaggccgtgaagaccccccccagaagactgcccaccgtgatggtgagaagccccatcgacagcgccagccccggcggcgactaccccctgggcgacctgacccccaccaccatggaggaggccaccagcggcgtgaacgagagcgagatggccgtggccagcggccacctgaacagcaccggcgtgctgctggaggtgggcggcgtgctgcccatgatccacggcggcgagatccagcagacccccaacaccgtggccgccagccccgccgccagcggcgcccccaccctgagcagactgctggaggccggccccacccagttcaccacccccctggccagcttcaccaccgtggccagcgagccccccgtgaagctggtgcccccccccgtggagagcgtgagccaggccaccatcgtgatgatgcccgccctgcccgcccccagcagcgcccccgccgtgagcaccaccgagagcgtggcccccgtgagccagcccgacaactgcgtgcccatggaggccgtgggcgacccccacaccgtgaccgtgagcatggacagcagcgagatcagcatgatcatcaacagcatcaaggaggagtgcttcagaagcggcgtggccgaggcccccgtgggcagcaaggcccccagcatcgacggcaaggaggagctggacctggccgagaagatggacatcgccgtgagctacaccggcgaggagctggacttcgagaccgtgggcgacatcatcgccatcatcgaggacaaggtggacgaccaccccgaggtgctggacgtggccgccgtggaggccgccctgagcttctgcgaggagaacgacgacccccagagcctgcccggcccctgggagcaccccatccagcaggagagagacaagcccgtgcccctgcccgcccccgagatgaccgtgaagcaggagagactggacttcgaggagaccgagaacaagggcatccacgagctggtggacatcagagagcccagcgccgagatcaaggtggagcccgccgagcccgagcccgtgatcagcggcgccgagatcgtggccggcgtggtgcccgccaccagcatggagccccccgagctgagaagccaggacctggacgaggagctgggcagcaccgccgccggcgagatcgtggaggccgacgtggccatcggcaagggcgacgagacccccctgaccaacgtgaagaccgaggccagccccgagagcatgctgagccccagccacggcagcaaccccatcgaggaccccctggaggccgagacccagcacaagttcgagatgagcgacagcctgaaggaggagagcggcaccatcttcggcagccagatcaaggacgcccccggcgaggacgaggaggaggacggcgtgagcgaggccgccagcctggaggagcccaaggaggaggaccagggcgagggctacctgagcgagatggacaacgagccccccgtgagcgagagcgacgacggcttcagcatccacaacgccaccctgcagagccacaccctggccgacagcatccccagcagccccgccagcagccagttcagcgtgtgcagcgaggaccaggaggccatccaggcccagaagatctggaagaaggccatcatgctggtgtggagagccgccgccaaccacagatacgccaacgtgttcctgcagcccgtgaccgacgacatcgcccccggctaccacagcatcgtgcagagacccatggacctgagcaccatcaagaagaacatcgagaacggcctgatcagaagcaccgccgagttccagagagacatcatgctgatgttccagaacgccgtgatgtacaacagcagcgaccacgacgtgtaccacatggccgtggagatgcagagagacgtgctggagcagatccagcagttcctggccacccagctgatcatgcagaccagcgagagcggcatcagcgccaagagcctgagaggcagagacagcaccagaaagcaggacgccagcgagaaggacagcgtgcccatgggcagccccgccttcctgctgagcctgttcgacggcggcaccagaggcagaagatgcgccatcgaggccgacatgaagatgaagaagtag

SEQ ID NO: 16683 - DNA, 3315 bp, Artificial Sequence
  Description of Artificial Sequence: Synthetic coding sequence
atggccagaagaggcaagaagcccgtggtgagaaccctggaggacctgaccctggacagcggctacggcggcgccgccgacagcgtgagaagcagcaacctgagcctgtgctgcagcgacagccaccccgccagcccctacggcggcagctgctggccccccctggccgacagcatgcacagcagacacaacagcttcgacaccgtgaacaccgccctggtggaggacagcgagggcctggactgcgccggccagcactgcagcagactgctgcccgacctggacgaggtgccctggaccctgcaggagctggaggccctgctgctgagaagcagagaccccagagccggccccgccgtgcccggcggcctgcccaaggacgccctggccaagctgagcaccctggtgagcagagccctggtgagaatcgccaaggaggcccagagactgagcctgagattcgccaagtgcaccaagtacgagatccagagcgccatggagatcgtgctgagctggggcctggccgcccactgcaccgccgccgccctggccgccctgagcctgtacaacatgagcagcgccggcggcgacagactgggcagaggcaagagcgccagatgcggcctgaccttcagcgtgggcagagtgtacagatggatggtggacagcagagtggccctgagaatccacgagcacgccgccatctacctgaccgcctgcatggagagcctgttcagagacatctacagcagagtggtggccagcggcgtgcccagaagctgcagcggccccggcagcggcagcggcagcggccccggccccagcagcggccccggcgccgcccccgccgccgacaaggagagagaggcccccggcggcggcgccgccagcggcggcgcctgcagcgccgccagcagcgccagcggcggcagcagctgctgcgccccccccgccgccgccgccgccgccgtgccccccgccgccgccgccaaccaccaccaccaccaccaccacgccctgcacgaggcccccaagttcaccgtggagaccctggagcacaccgtgaacaacgacagcgagatctggggcctgctgcagccctaccagcacctgatctgcggcaagaacgccagcggcgtgctgtgcctgcccgacagcctgaacctgcacagagacccccagagaagcaacaagcccggcgagctgcccatgttcagccagagcgagctgagaaccatcgagcagagcctgctggccaccagagtgggcagcatcgccgagctgagcgacctggtgagcagagccatgcaccacctgcagcccctgaacgccaagcaccacggcaacggcacccccctgcaccacaagcagggcgccctgtactgggagcccgaggccctgtacaccctgtgctacttcatgcactgcccccagatggagtgggagaaccccaacgtggagcccagcaaggtgaacctgcaggtggagagacccttcctggtgctgccccccctgatggagtggatcagagtggccgtggcccacgccggccacagaagaagcttcagcatggacagcgacgacgtgagacaggccgccagactgctgctgcccggcgtggactgcgagcccagacagctgagagccgacgactgcttctgcgccagcagaaagctggacgccgtggccatcgaggccaagttcaagcaggacctgggcttcagaatgctgaactgcggcagaaccgacctggtgaagcaggccgtgagcctgctgggccccgacggcatcaacaccatgagcgagcagggcatgacccccctgatgtacgcctgcgtgagaggcgacgaggccatggtgcagatgctgctggacgccggcgccgacctgaacgtggaggtggtgagcaccccccacaagtaccccagcgtgcaccccgagaccagacactggaccgccctgaccttcgccgtgctgcacggccacatccccgtggtgcagctgctgctggacgccggcgccaaggtggagggcagcgtggagcacggcgaggagaactacagcgagacccccctgcagctggccgccgccgtgggcaacttcgagctggtgagcctgctgctggagagaggcgccgaccccctgatcggcaccatgtacagaaacggcatcagcaccaccccccagggcgacatgaacagcttcagccaggccgccgcccacggccacagaaacgtgttcagaaagctgctggcccagcccgagaaggagaagagcgacatcctgagcctggaggagatcctggccgagggcaccgacctggccgagaccgcccccccccccctgtgcgccagcagaaacagcaaggccaagctgagagccctgagagaggccatgtaccacagcgccgagcacggctacgtggacgtgaccatcgacatcagaagcatcggcgtgccctggaccctgcacacctggctggagagcctgagaatcgccttccagcagcacagaagacccctgatccagtgcctgctgaaggagttcaagaccatccaggaggaggagtacaccgaggagctggtgacccagggcctgcccctgatgttcgagatcctgaaggccagcaagaacgaggtgatcagccagcagctgtgcgtgatcttcacccactgctacggcccctaccccatccccaagctgaccgagatcaagagaaagcagaccagcagactggacccccacttcctgaacaacaaggagatgagcgacgtgaccttcctggtggagggcagacccttctacgcccacaaggtgctgctgttcaccgccagccccagattcaaggccctgctgagcagcaagcccaccaacgacggcacctgcatcgagatcggctacgtgaagtacagcatcttccagctggtgatgcagtacctgtactacggcggccccgagagcctgctgatcaagaacaacgagatcatggagctgctgagcgccgccaagttcttccagctggaggccctgcagagacactgcgagatcatctgcgccaagagcatcaacaccgacaactgcgtggacatctacaaccacgccaagttcctgggcgtgaccgagctgagcgcctactgcgagggctacttcctgaagaacatgatggtgctgatcgagaacgaggccttcaagcagctgctgtacgacaagaacggcgagggcaccggccaggacgtgctgcaggacctgcagagaaccctggccatcagaatccagagcatccacctgagcagcagcaagggcagcgtggtgtag

SEQ ID NO: 16684 - DNA, 1926 bp, Artificial Sequence
  Description of Artificial Sequence: Synthetic coding sequence
atgagaaagctgagacccaaggacagcagagagcccgcccccggcagccccgtgagaagcggctgcctgcagagactgagccactacagcggcatccagagacccttcctggtgctgccccccctgatggagtggatcagagtggccgtggcccacgccggccacagaagaagcttcagcatggacagcgacgacgtgagacaggccgccagactgctgctgcccggcgtggactgcgagcccagacagctgagagccgacgactgcttctgcgccagcagaaagctggacgccgtggccatcgaggccaagttcaagcaggacctgggcttcagaatgctgaactgcggcagaaccgacctggtgaagcaggccgtgagcctgctgggccccgacggcatcaacaccatgagcgagcagggcatgacccccctgatgtacgcctgcgtgagaggcgacgaggccatggtgcagatgctgctggacgccggcgccgacctgaacgtggaggtggtgagcaccccccacaagtaccccagcgtgcaccccgagaccagacactggaccgccctgaccttcgccgtgctgcacggccacatccccgtggtgcagctgctgctggacgccggcgccaaggtggagggcagcgtggagcacggcgaggagaactacagcgagacccccctgcagctggccgccgccgtgggcaacttcgagctggtgagcctgctgctggagagaggcgccgaccccctgatcggcaccatgtacagaaacggcatcagcaccaccccccagggcgacatgaacagcttcagccaggccgccgcccacggccacagaaacgtgttcagaaagctgctggcccagcccgagaaggagaagagcgacatcctgagcctggaggagatcctggccgagggcaccgacctggccgagaccgcccccccccccctgtgcgccagcagaaacagcaaggccaagctgagagccctgagagaggccatgtaccacagcgccgagcacggctacgtggacgtgaccatcgacatcagaagcatcggcgtgccctggaccctgcacacctggctggagagcctgagaatcgccttccagcagcacagaagacccctgatccagtgcctgctgaaggagttcaagaccatccaggaggaggagtacaccgaggagctggtgacccagggcctgcccctgatgttcgagatcctgaaggccagcaagaacgaggtgatcagccagcagctgtgcgtgatcttcacccactgctacggcccctaccccatccccaagctgaccgagatcaagagaaagcagaccagcagactggacccccacttcctgaacaacaaggagatgagcgacgtgaccttcctggtggagggcagacccttctacgcccacaaggtgctgctgttcaccgccagccccagattcaaggccctgctgagcagcaagcccaccaacgacggcacctgcatcgagatcggctacgtgaagtacagcatcttccagctggtgatgcagtacctgtactacggcggccccgagagcctgctgatcaagaacaacgagatcatggagctgctgagcgccgccaagttcttccagctggaggccctgcagagacactgcgagatcatctgcgccaagagcatcaacaccgacaactgcgtggacatctacaaccacgccaagttcctgggcgtgaccgagctgagcgcctactgcgagggctacttcctgaagaacatgatggtgctgatcgagaacgaggccttcaagcagctgctgtacgacaagaacggcgagggcaccggccaggacgtgctgcaggacctgcagagaaccctggccatcagaatccagagcatccacctgagcagcagcaagggcagcgtggtgtag

SEQ ID NO: 16685 - DNA, 2958 bp, Artificial Sequence
  Description of Artificial Sequence: Synthetic coding sequence
atggccagaagaggcaagaagcccgtggtgagaaccctggaggacctgaccctggacagcggctacggcggcgccgccgacagcgtgagaagcagcaacctgagcctgtgctgcagcgacagccaccccgccagcccctacggcggcagctgctggccccccctggccgacagcatgcacagcagacacaacagcttcgacaccgtgaacaccgccctggtggaggacagcgagggcctggactgcgccggccagcactgcagcagactgctgcccgacctggacgaggtgccctggaccctgcaggagctggaggccctgctgctgagaagcagagaccccagagccggccccgccgtgcccggcggcctgcccaaggacgccctggccaagctgagcaccctggtgagcagagccctggtgagaatcgccaaggaggcccagagactgagcctgagattcgccaagtgcaccaagtacgagatccagagcgccatggagatcgtgctgagctggggcctggccgcccactgcaccgccgccgccctggccgccctgagcctgtacaacatgagcagcgccggcggcgacagactgggcagaggcaagagcgccagatgcggcctgaccttcagcgtgggcagagtgtacagatggatggtggacagcagagtggccctgagaatccacgagcacgccgccatctacctgaccgcctgcatggagagcctgttcagagacatctacagcagagtggtggccagcggcgtgcccagaagctgcagcggccccggcagcggcagcggcagcggccccggccccagcagcggccccggcgccgcccccgccgccgacaaggagagagaggcccccggcggcggcgccgccagcggcggcgcctgcagcgccgccagcagcgccagcggcggcagcagctgctgcgccccccccgccgccgccgccgccgccgtgccccccgccgccgccgccaaccaccaccaccaccaccaccacgccctgcacgaggcccccaagttcaccgtggagaccctggagcacaccgtgaacaacgacagcgagatctggggcctgctgcagccctaccagcacctgatctgcggcaagaacgccagcggcgtgctgtgcctgcccgacagcctgaacctgcacagagacccccagagaagcaacaagcccggcgagctgcccatgttcagccagagcgagctgagaaccatcgagcagagcctgctggccaccagagtgggcagcatcgccgagctgagcgacctggtgagcagagccatgcaccacctgcagcccctgaacgccaagcaccacggcaacggcacccccctgcaccacaagcagggcgccctgtactgggagcccgaggccctgtacaccctgtgctacttcatgcactgcccccagatggagtgggagaaccccaacgtggagcccagcaaggtgaacctgcaggtggagagacccttcctggtgctgccccccctgatggagtggatcagagtggccgtggcccacgccggccacagaagaagcttcagcatggacagcgacgacgtgagacaggccgccagactgctgctgcccggcgtggactgcgagcccagacagctgagagccgacgactgcttctgcgccagcagaaagctggacgccgtggccatcgaggccaagttcaagcaggacctgggcttcagaatgctgaactgcggcagaaccgacctggtgaagcaggccgtgagcctgctgggccccgacggcatcaacaccatgagcgagcagggcatgacccccctgatgtacgcctgcgtgagaggcgacgaggccatggtgcagatgctgctggacgccggcgccgacctgaacgtggaggtggtgagcaccccccacaagtaccccagcgtgcaccccgagaccagacactggaccgccctgaccttcgccgtgctgcacggccacatccccgtggtgcagctgctgctggacgccggcgccaaggtggagggcagcgtggagcacggcgaggagaactacagcgagacccccctgcagctggccgccgccgtgggcgtgccctggaccctgcacacctggctggagagcctgagaatcgccttccagcagcacagaagacccctgatccagtgcctgctgaaggagttcaagaccatccaggaggaggagtacaccgaggagctggtgacccagggcctgcccctgatgttcgagatcctgaaggccagcaagaacgaggtgatcagccagcagctgtgcgtgatcttcacccactgctacggcccctaccccatccccaagctgaccgagatcaagagaaagcagaccagcagactggacccccacttcctgaacaacaaggagatgagcgacgtgaccttcctggtggagggcagacccttctacgcccacaaggtgctgctgttcaccgccagccccagattcaaggccctgctgagcagcaagcccaccaacgacggcacctgcatcgagatcggctacgtgaagtacagcatcttccagctggtgatgcagtacctgtactacggcggccccgagagcctgctgatcaagaacaacgagatcatggagctgctgagcgccgccaagttcttccagctggaggccctgcagagacactgcgagatcatctgcgccaagagcatcaacaccgacaactgcgtggacatctacaaccacgccaagttcctgggcgtgaccgagctgagcgcctactgcgagggctacttcctgaagaacatgatggtgctgatcgagaacgaggccttcaagcagctgctgtacgacaagaacggcgagggcaccggccaggacgtgctgcaggacctgcagagaaccctggccatcagaatccagagcatccacctgagcagcagcaagggcagcgtggtgtag

SEQ ID NO: 16686 - DNA, 3024 bp, Artificial Sequence
  Description of Artificial Sequence: Synthetic coding sequence
atggccagaagaggcaagaagcccgtggtgagaaccctggaggacctgaccctggacagcggctacggcggcgccgccgacagcgtgagaagcagcaacctgagcctgtgctgcagcgacagccaccccgccagcccctacggcggcagctgctggccccccctggccgacagcatgcacagcagacacaacagcttcgacaccgtgaacaccgccctggtggaggacagcgagggcctggactgcgccggccagcactgcagcagactgctgcccgacctggacgaggtgccctggaccctgcaggagctggaggccctgctgctgagaagcagagaccccagagccggccccgccgtgcccggcggcctgcccaaggacgccctggccaagctgagcaccctggtgagcagagccctggtgagaatcgccaaggaggcccagagactgagcctgagattcgccaagtgcaccaagtacgagatccagagcgccatggagatcgtgctgagctggggcctggccgcccactgcaccgccgccgccctggccgccctgagcctgtacaacatgagcagcgccggcggcgacagactgggcagaggcaagagcgccagatgcggcctgaccttcagcgtgggcagagtgtacagatggatggtggacagcagagtggccctgagaatccacgagcacgccgccatctacctgaccgcctgcatggagagcctgttcagagacatctacagcagagtggtggccagcggcgtgcccagaagctgcagcggccccggcagcggcagcggcagcggccccggccccagcagcggccccggcgccgcccccgccgccgacaaggagagagaggcccccggcggcggcgccgccagcggcggcgcctgcagcgccgccagcagcgccagcggcggcagcagctgctgcgccccccccgccgccgccgccgccgccgtgccccccgccgccgccgccaaccaccaccaccaccaccaccacgccctgcacgaggcccccaagttcaccgtggagaccctggagcacaccgtgaacaacgacagcgagatctggggcctgctgcagccctaccagcacctgatctgcggcaagaacgccagcggcgtgctgtgcctgcccgacagcctgaacctgcacagagacccccagagaagcaacaagcccggcgagctgcccatgttcagccagagcgagctgagaaccatcgagcagagcctgctggccaccagagtgggcagcatcgccgagctgagcgacctggtgagcagagccatgcaccacctgcagcccctgaacgccaagcaccacggcaacggcacccccctgcaccacaagcagggcgccctgtactgggagcccgaggccctgtacaccctgtgctacttcatgcactgcccccagatggagtgggagaaccccaacgtggagcccagcaaggtgaacctgcaggtggagagacccttcctggtgctgccccccctgatggagtggatcagagtggccgtggcccacgccggccacagaagaagcttcagcatggacagcgacgacgtgagacaggccgccagactgctgctgcccggcgtggactgcgagcccagacagctgagagccgacgactgcttctgcgccagcagaaagctggacgccgtggccatcgaggccaagttcaagcaggacctgggcttcagaatgctgaactgcggcagaaccgacctggtgaagcaggccgtgagcctgctgggccccgacggcatcaacaccatgagcgagcagggcatgacccccctgatgtacgcctgcgtgagaggcgacgaggccatggtgcagatgctgctggacgccggcgccgacctgaacgtggaggtggtgagcaccccccacaagtaccccagcgtgcaccccgagaccagacactggaccgccctgaccttcgccgtgctgcacggccacatccccgtggtgcagctgctgctggacgccggcgccaaggtggagggcagcgtggagcacggcgaggagaactacagcgagacccccctgcagctggccgccgccgtgggcaacttcgagctggtgagcctgctgctggagagaggcgccgaccccctgatcggcaccatgtacagaaacggcatcagcaccaccccccagggcgacatgaacagcttcagccaggccgccgcccacggccacagaaacgtgttcagaaagctgctggcccagcccgagaaggagaagagcgacatcctgagcctggaggagatcctggccgagggcaccgacctggccgagaccgcccccccccccctgtgcgccagcagaaacagcaaggccaagctgagagccctgagagaggccatgtaccacagcgccgagcacggctacgtggacgtgaccatcgacatcagaagcatcggcgtgccctggaccctgcacacctggctggagagcctgagaatcgccttccagcagcacagaagacccctgatccagtgcctgctgaaggagttcaagaccatccaggaggaggagtacaccgaggagctggtgacccagggcctgcccctgatgttcgagatcctgaaggccagcaagaacgaggtgatcagccagcagctgtgcgtgatcttcacccactgctacggcccctaccccatccccaagctgaccgagatcaagagaaagcagaccagcagactggacccccacttcctgaacaacaaggagatgagcgacgtgaccttcctggtggagggcagacccttctacgcccacaaggtgctgctgttcaccgccagccccagattcaaggccctgctgagcagcaagcccaccaacgacggcacctgcatcgagatcggctacgtgaagtacagcatcttccagctggtgatgcagtacctgtactacggcggccccgagagcctgctgatcaagaacaacgagatcatggaggtgagagaccccctgtggtgctggctgagctag

SEQ ID NO: 16687 - DNA, 552 bp, Artificial Sequence
  Description of Artificial Sequence: Synthetic coding sequence
atgagcgacgtgaccttcctggtggagggcagacccttctacgcccacaaggtgctgctgttcaccgccagccccagattcaaggccctgctgagcagcaagcccaccaacgacggcacctgcatcgagatcggctacgtgaagtacagcatcttccagctggtgatgcagtacctgtactacggcggccccgagagcctgctgatcaagaacaacgagatcatggagctgctgagcgccgccaagttcttccagctggaggccctgcagagacactgcgagatcatctgcgccaagagcatcaacaccgacaactgcgtggacatctacaaccacgccaagttcctgggcgtgaccgagctgagcgcctactgcgagggctacttcctgaagaacatgatggtgctgatcgagaacgaggccttcaagcagctgctgtacgacaagaacggcgagggcaccggccaggacgtgctgcaggacctgcagagaaccctggccatcagaatccagagcatccacctgagcagcagcaagggcagcgtggtgtag

SEQ ID NO: 16688 - DNA, 987 bp, Artificial Sequence
  Description of Artificial Sequence: Synthetic coding sequence
atgtgccaccagcagctggtgatcagctggttcagcctggtgttcctggccagccccctggtggccatctgggagctgaagaaggacgtgtacgtggtggagctggactggtaccccgacgcccccggcgagatggtggtgctgacctgcgacacccccgaggaggacggcatcacctggaccctggaccagagcagcgaggtgctgggcagcggcaagaccctgaccatccaggtgaaggagttcggcgacgccggccagtacacctgccacaagggcggcgaggtgctgagccacagcctgctgctgctgcacaagaaggaggacggcatctggagcaccgacatcctgaaggaccagaaggagcccaagaacaagaccttcctgagatgcgaggccaagaactacagcggcagattcacctgctggtggctgaccaccatcagcaccgacctgaccttcagcgtgaagagcagcagaggcagcagcgacccccagggcgtgacctgcggcgccgccaccctgagcgccgagagagtgagaggcgacaacaaggagtacgagtacagcgtggagtgccaggaggacagcgcctgccccgccgccgaggagagcctgcccatcgaggtgatggtggacgccgtgcacaagctgaagtacgagaactacaccagcagcttcttcatcagagacatcatcaagcccgacccccccaagaacctgcagctgaagcccctgaagaacagcagacaggtggaggtgagctgggagtaccccgacacctggagcaccccccacagctacttcagcctgaccttctgcgtgcaggtgcagggcaagagcaagagagagaagaaggacagagtgttcaccgacaagaccagcgccaccgtgatctgcagaaagaacgccagcatcagcgtgagagcccaggacagatactacagcagcagctggagcgagtgggccagcgtgccctgcagctag

SEQ ID NO: 16689 - DNA, 1503 bp, Artificial Sequence
  Description of Artificial Sequence: Synthetic coding sequence
atggccctgatgctgagcctggtgctgagcctgctgaagctgggcagcggccagtggcaggtgttcggccccgacaagcccgtgcaggccctggtgggcgaggacgccgccttcagctgcttcctgagccccaagaccaacgccgaggccatggaggtgagattcttcagaggccagttcagcagcgtggtgcacctgtacagagacggcaaggaccagcccttcatgcagatgccccagtaccagggcagaaccaagctggtgaaggacagcatcgccgagggcagaatcagcctgagactggagaacatcaccgtgctggacgccggcctgtacggctgcagaatcagcagccagagctactaccagaaggccatctgggagctgcaggtgagcgccctgggcagcgtgcccctgatcagcatcaccggctacgtggacagagacatccagctgctgtgccagagcagcggctggttccccagacccaccgccaagtggaagggcccccagggccaggacctgagcaccgacagcagaaccaacagagacatgcacggcctgttcgacgtggagatcagcctgaccgtgcaggagaacgccggcagcatcagctgcagcatgagacacgcccacctgagcagagaggtggagagcagagtgcagatcggcgacaccttcttcgagcccatcagctggcacctggccaccaaggtgctgggcatcctgtgctgcggcctgttcttcggcatcgtgggcctgaagatcttcttcagcaagttccagtggaagatccaggccgagctggactggagaagaaagcacggccaggccgagctgagagacgccagaaagcacgccgtggaggtgaccctggaccccgagaccgcccaccccaagctgtgcgtgagcgacctgaagaccgtgacccacagaaaggccccccaggaggtgccccacagcgagaagagattcaccagaaagagcgtggtggccagccagagcttccaggccggcaagcactactgggaggtggacggcggccacaacaagagatggagagtgggcgtgtgcagagacgacgtggacagaagaaaggagtacgtgaccctgagccccgaccacggctactgggtgctgagactgaacggcgagcacctgtacttcaccctgaaccccagattcatcagcgtgttccccagaaccccccccaccaagatcggcgtgttcctggactacgagtgcggcaccatcagcttcttcaacatcaacgaccagagcctgatctacaccctgacctgcagattcgagggcctgctgagaccctacatcgagtaccccagctacaacgagcagaacggcacccccatcgtgatctgccccgtgacccaggagagcgagaaggaggccagctggcagagagccagcgccatccccgagaccagcaacagcgagagcagcagccaggccaccacccccttcctgcccagaggcgagatgtag

SEQ ID NO: 16690 - DNA, 951 bp, Artificial Sequence
  Description of Artificial Sequence: Synthetic coding sequence
atgcacggcctgttcgacgtggagatcagcctgaccgtgcaggagaacgccggcagcatcagctgcagcatgagacacgcccacctgagcagagaggtggagagcagagtgcagatcggcgacaccttcttcgagcccatcagctggcacctggccaccaaggtgctgggcatcctgtgctgcggcctgttcttcggcatcgtgggcctgaagatcttcttcagcaagttccagtggaagatccaggccgagctggactggagaagaaagcacggccaggccgagctgagagacgccagaaagcacgccgtggaggtgaccctggaccccgagaccgcccaccccaagctgtgcgtgagcgacctgaagaccgtgacccacagaaaggccccccaggaggtgccccacagcgagaagagattcaccagaaagagcgtggtggccagccagagcttccaggccggcaagcactactgggaggtggacggcggccacaacaagagatggagagtgggcgtgtgcagagacgacgtggacagaagaaaggagtacgtgaccctgagccccgaccacggctactgggtgctgagactgaacggcgagcacctgtacttcaccctgaaccccagattcatcagcgtgttccccagaaccccccccaccaagatcggcgtgttcctggactacgagtgcggcaccatcagcttcttcaacatcaacgaccagagcctgatctacaccctgacctgcagattcgagggcctgctgagaccctacatcgagtaccccagctacaacgagcagaacggcacccccatcgtgatctgccccgtgacccaggagagcgagaaggaggccagctggcagagagccagcgccatccccgagaccagcaacagcgagagcagcagccaggccaccacccccttcctgcccagaggcgagatgtag

SEQ ID NO: 16691 - DNA, 1128 bp, Artificial Sequence
  Description of Artificial Sequence: Synthetic coding sequence
atgtggacctggttcgtgaagagcctgggcagcgtgcccctgatcagcatcaccggctacgtggacagagacatccagctgctgtgccagagcagcggctggttccccagacccaccgccaagtggaagggcccccagggccaggacctgagcaccgacagcagaaccaacagagacatgcacggcctgttcgacgtggagatcagcctgaccgtgcaggagaacgccggcagcatcagctgcagcatgagacacgcccacctgagcagagaggtggagagcagagtgcagatcggcgacaccttcttcgagcccatcagctggcacctggccaccaaggtgctgggcatcctgtgctgcggcctgttcttcggcatcgtgggcctgaagatcttcttcagcaagttccagtggaagatccaggccgagctggactggagaagaaagcacggccaggccgagctgagagacgccagaaagcacgccgtggaggtgaccctggaccccgagaccgcccaccccaagctgtgcgtgagcgacctgaagaccgtgacccacagaaaggccccccaggaggtgccccacagcgagaagagattcaccagaaagagcgtggtggccagccagagcttccaggccggcaagcactactgggaggtggacggcggccacaacaagagatggagagtgggcgtgtgcagagacgacgtggacagaagaaaggagtacgtgaccctgagccccgaccacggctactgggtgctgagactgaacggcgagcacctgtacttcaccctgaaccccagattcatcagcgtgttccccagaaccccccccaccaagatcggcgtgttcctggactacgagtgcggcaccatcagcttcttcaacatcaacgaccagagcctgatctacaccctgacctgcagattcgagggcctgctgagaccctacatcgagtaccccagctacaacgagcagaacggcacccccatcgtgatctgccccgtgacccaggagagcgagaaggaggccagctggcagagagccagcgccatccccgagaccagcaacagcgagagcagcagccaggccaccacccccttcctgcccagaggcgagatgtag

SEQ ID NO: 16692 - DNA, 1023 bp, Artificial Sequence
  Description of Artificial Sequence: Synthetic coding sequence
atggccctgatgctgagcctggtgctgagcctgctgaagctgggcagcggccagtggcaggtgttcggccccgacaagcccgtgcaggccctggtgggcgaggacgccgccttcagctgcttcctgagccccaagaccaacgccgaggccatggaggtgagattcttcagaggccagttcagcagcgtggtgcacctgtacagagacggcaaggaccagcccttcatgcagatgccccagtaccagggcagaaccaagctggtgaaggacagcatcgccgagggcagaatcagcctgagactggagaacatcaccgtgctggacgccggcctgtacggctgcagaatcagcagccagagctactaccagaaggccatctgggagctgcaggtgagcgccctgggcagcgtgcccctgatcagcatcaccggctacgtggacagagacatccagctgctgtgccagagcagcggctggttccccagacccaccgccaagtggaagggcccccagggccaggacctgagcaccgacagcagaaccaacagagacatgcacggcctgttcgacgtggagatcagcctgaccgtgcaggagaacgccggcagcatcagctgcagcatgagacacgcccacctgagcagagaggtggagagcagagtgcagatcggcgacaccttcttcgagcccatcagctggcacctggccaccaaggtgctgggcatcctgtgctgcggcctgttcttcggcatcgtgggcctgaagatcttcttcagcaagttccagtgcaagagagagagagaggcctgggccggcgccctgttcatggtgcccgccggcaccggcagcgagatgctgccccaccccgccgccagcctgctgctggtgctggccagcagaggccccggccccaagaagctggagaagaaggccagaaccggcagaatcgagagaagacccgagaccagaagcggcggcgacagcggcagcagagacggcagccccgaggccctgagattctag

SEQ ID NO: 16693 - DNA, 1155 bp, Artificial Sequence
  Description of Artificial Sequence: Synthetic coding sequence
atggccctgatgctgagcctggtgctgagcctgctgaagctgggcagcgccctgggcagcgtgcccctgatcagcatcaccggctacgtggacagagacatccagctgctgtgccagagcagcggctggttccccagacccaccgccaagtggaagggcccccagggccaggacctgagcaccgacagcagaaccaacagagacatgcacggcctgttcgacgtggagatcagcctgaccgtgcaggagaacgccggcagcatcagctgcagcatgagacacgcccacctgagcagagaggtggagagcagagtgcagatcggcgacaccttcttcgagcccatcagctggcacctggccaccaaggtgctgggcatcctgtgctgcggcctgttcttcggcatcgtgggcctgaagatcttcttcagcaagttccagtggaagatccaggccgagctggactggagaagaaagcacggccaggccgagctgagagacgccagaaagcacgccgtggaggtgaccctggaccccgagaccgcccaccccaagctgtgcgtgagcgacctgaagaccgtgacccacagaaaggccccccaggaggtgccccacagcgagaagagattcaccagaaagagcgtggtggccagccagagcttccaggccggcaagcactactgggaggtggacggcggccacaacaagagatggagagtgggcgtgtgcagagacgacgtggacagaagaaaggagtacgtgaccctgagccccgaccacggctactgggtgctgagactgaacggcgagcacctgtacttcaccctgaaccccagattcatcagcgtgttccccagaaccccccccaccaagatcggcgtgttcctggactacgagtgcggcaccatcagcttcttcaacatcaacgaccagagcctgatctacaccctgacctgcagattcgagggcctgctgagaccctacatcgagtaccccagctacaacgagcagaacggcacccccatcgtgatctgccccgtgacccaggagagcgagaaggaggccagctggcagagagccagcgccatccccgagaccagcaacagcgagagcagcagccaggccaccacccccttcctgcccagaggcgagatgtag

SEQ ID NO: 16694 - DNA, 1608 bp, Artificial Sequence
  Description of Artificial Sequence: Synthetic coding sequence
atggtggacctgagcgtgagccccgacagcctgaagcccgtgagcctgaccagcagcctggtgttcctgatgcacctgctgctgctgcagcccggcgagcccagcagcgaggtgaaggtgctgggccccgagtaccccatcctggccctggtgggcgaggaggtggagttcccctgccacctgtggccccagctggacgcccagcagatggagatcagatggttcagaagccagaccttcaacgtggtgcacctgtaccaggagcagcaggagctgcccggcagacagatgcccgccttcagaaacagaaccaagctggtgaaggacgacatcgcctacggcagcgtggtgctgcagctgcacagcatcatccccagcgacaagggcacctacggctgcagattccacagcgacaacttcagcggcgaggccctgtgggagctggaggtggccggcctgggcagcgacccccacctgagcctggagggcttcaaggagggcggcatccagctgagactgagaagcagcggctggtaccccaagcccaaggtgcagtggagagaccaccagggccagtgcctgccccccgagttcgaggccatcgtgtgggacgcccaggacctgttcagcctggagaccagcgtggtggtgagagccggcgccctgagcaacgtgagcgtgagcatccagaacctgctgctgagccagaagaaggagctggtggtgcagatcgccgacgtgttcgtgcccggcgccagcgcctggaagagcgccttcgtggccaccctgcccctgctgctggtgctggccgccctggccctgggcgtgctgagaaagcagagaagaagcagagagaagctgagaaagcaggccgagaagagacaggagaagctgaccgccgagctggagaagctgcagaccgagctggactggagaagagccgagggccaggccgagtggagagccgcccagaagtacgccgtggacgtgaccctggaccccgccagcgcccaccccagcctggaggtgagcgaggacggcaagagcgtgagcagcagaggcgccccccccggccccgcccccggccacccccagagattcagcgagcagacctgcgccctgagcctggagagattcagcgccggcagacactactgggaggtgcacgtgggcagaagaagcagatggttcctgggcgcctgcctggccgccgtgcccagagccggccccgccagactgagccccgccgccggctactgggtgctgggcctgtggaacggctgcgagtacttcgtgctggccccccacagagtggccctgaccctgagagtgccccccagaagactgggcgtgttcctggactacgaggccggcgagctgagcttcttcaacgtgagcgacggcagccacatcttcaccttccacgacaccttcagcggcgccctgtgcgcctacttcagacccagagcccacgacggcggcgagcaccccgaccccctgaccatctgccccctgcccgtgagaggcaccggcgtgcccgaggagaacgacagcgacacctggctgcagccctacgagcccgccgaccccgccctggactggtggtag

SEQ ID NO: 16695 - DNA, 1035 bp, Artificial Sequence
  Description of Artificial Sequence: Synthetic coding sequence
atggtggacctgagcgtgagccccgacagcctgaagcccgtgagcctgaccagcagcctggtgttcctgatgcacctgctgctgctgcagcccggcgagcccagcagcgaggtgaaggtgctgggccccgagtaccccatcctggccctggtgggcgaggaggtggagttcccctgccacctgtggccccagctggacgcccagcagatggagatcagatggttcagaagccagaccttcaacgtggtgcacctgtaccaggagcagcaggagctgcccggcagacagatgcccgccttcagaaacagaaccaagctggtgaaggacgacatcgcctacggcagcgtggtgctgcagctgcacagcatcatccccagcgacaagggcacctacggctgcagattccacagcgacaacttcagcggcgaggccctgtgggagctggaggtggccggcctgggcagcgacccccacctgagcctggagggcttcaaggagggcggcatccagctgagactgagaagcagcggctggtaccccaagcccaaggtgcagtggagagaccaccagggccagtgcctgccccccgagttcgaggccatcgtgtgggacgcccaggacctgttcagcctggagaccagcgtggtggtgagagccggcgccctgagcaacgtgagcgtgagcatccagaacctgctgctgagccagaagaaggagctggtggtgcagatcgccgacgtgttcgtgcccggcgccagcgcctggaagagcgccttcgtggccaccctgcccctgctgctggtgctggccgccctggccctgggcgtgctgagaaagcagagaagaagcagagagaagctgagaaagcaggccgagaagagacaggagaagctgaccgccgagctggagaagctgcagaccgagctggactggagaagagccgagggccaggccgagtgcttcgtgctggccagccacccccccggcgagggcatccaggccgccagcaacagcaccaccaccctgaacgcctag

SEQ ID NO: 16696 - DNA, 1611 bp, Artificial Sequence
  Description of Artificial Sequence: Synthetic coding sequence
atggtggacctgagcgtgagccccgacagcctgaagcccgtgagcctgaccagcagcctggtgttcctgatgcacctgctgctgctgcagcccggcgagcccagcagcgaggtgaaggtgctgggccccgagtaccccatcctggccctggtgggcgaggaggtggagttcccctgccacctgtggccccagctggacgcccagcagatggagatcagatggttcagaagccagaccttcaacgtggtgcacctgtaccaggagcagcaggagctgcccggcagacagatgcccgccttcagaaacagaaccaagctggtgaaggacgacatcgcctacggcagcgtggtgctgcagctgcacagcatcatccccagcgacaagggcacctacggctgcagattccacagcgacaacttcagcggcgaggccctgtgggagctggaggtggccggcctgggcagcgacccccacctgagcctggagggcttcaaggagggcggcatccagctgagactgagaagcagcggctggtaccccaagcccaaggtgcagtggagagaccaccagggccagtgcctgccccccgagttcgaggccatcgtgtgggacgcccaggacctgttcagcctggagaccagcgtggtggtgagagccggcgccctgagcaacgtgagcgtgagcatccagaacctgctgctgagccagaagaaggagctggtggtgcagatcgccgacgtgttcgtgcccggcgccagcgcctggaagagcgccttcgtggccaccctgcccctgctgctggtgctggccgccctggccctgggcgtgctgagaaagcagagaagaagcagagagaagctgagaaagcaggccgagaagagacagggcaccgagaagaccgcccagctgccccccaaccaggtggccagcgactggagaagagccgagggccaggccgagtggagagccgcccagaagtacgccgtggacgtgaccctggaccccgccagcgcccaccccagcctggaggtgagcgaggacggcaagagcgtgagcagcagaggcgccccccccggccccgcccccggccacccccagagattcagcgagcagacctgcgccctgagcctggagagattcagcgccggcagacactactgggaggtgcacgtgggcagaagaagcagatggttcctgggcgcctgcctggccgccgtgcccagagccggccccgccagactgagccccgccgccggctactgggtgctgggcctgtggaacggctgcgagtacttcgtgctggccccccacagagtggccctgaccctgagagtgccccccagaagactgggcgtgttcctggactacgaggccggcgagctgagcttcttcaacgtgagcgacggcagccacatcttcaccttccacgacaccttcagcggcgccctgtgcgcctacttcagacccagagcccacgacggcggcgagcaccccgaccccctgaccatctgccccctgcccgtgagaggcaccggcgtgcccgaggagaacgacagcgacacctggctgcagccctacgagcccgccgaccccgccctggactggtggtag

SEQ ID NO: 16697 - DNA, 1035 bp, Artificial Sequence
  Description of Artificial Sequence: Synthetic coding sequence
atggtggacctgagcgtgagccccgacagcctgaagcccgtgagcctgaccagcagcctggtgttcctgatgcacctgctgctgctgcagcccggcgagcccagcagcgaggtgaaggtgctgggccccgagtaccccatcctggccctggtgggcgaggaggtggagttcccctgccacctgtggccccagctggacgcccagcagatggagatcagatggttcagaagccagaccttcaacgtggtgcacctgtaccaggagcagcaggagctgcccggcagacagatgcccgccttcagaaacagaaccaagctggtgaaggacgacatcgcctacggcagcgtggtgctgcagctgcacagcatcatccccagcgacaagggcacctacggctgcagattccacagcgacaacttcagcggcgaggccctgtgggagctggaggtggccggcctgggcagcgacccccacctgagcctggagggcttcaaggagggcggcatccagctgagactgagaagcagcggctggtaccccaagcccaaggtgcagtggagagaccaccagggccagtgcctgccccccgagttcgaggccatcgtgtgggacgcccaggacctgttcagcctggagaccagcgtggtggtgagagccggcgccctgagcaacgtgagcgtgagcatccagaacctgctgctgagccagaagaaggagctggtggtgcagatcgccgacgtgttcgtgcccggcgccagcgcctggaagagcgccttcgtggccaccctgcccctgctgctggtgctggccgccctggccctgggcgtgctgagaaagcagagaagaagcagagagaagctgagaaagcaggccgagaagagacaggccagatacgacgcccaggccggccccctgctggtggccagcgactggagaagagccgagggccaggccgagtgcttcgtgctggccagccacccccccggcgagggcatccaggccgccagcaacagcaccaccaccctgaacgcctag

SEQ ID NO: 16698 - DNA, 3672 bp, Artificial Sequence
  Description of Artificial Sequence: Synthetic coding sequence
atgagaagactggccgccgaggagctgggcgtggtgaccatgcagagaatcttcaacagcttcgtgtacaccgagaagatcagcaacggcgagagcgaggtgcagcagctggccaagaagatcagagagaagttcaacagatacctggacgtggtgaacagaaacaagcaggtggtggaggccagctacaccgcccacctgaccagccccctgaccgccatccaggactgctgcaccatcccccccagcatgatggagttcgacggcaacttcaacaccaacgtgagcagaaccatcagctgcgacagactgagcaccaccgtgaacagcagagccttcaaccccggcagagacctgaacagcgtgctggccgacaacctgaagagcaaccccggcatcaagtggcagtacttcagcagcgaggagggcatcttcaccgtgttccccgcccacaagttcagatgcaagggcagctacgagcacagaagcagacccatctacgtgagcaccgtgagaccccagagcaagcacatcgtggtgatcctggaccacggcgccagcgtgaccgacacccagctgcagatcgccaaggacgccgcccaggtgatcctgagcgccatcgacgagcacgacaagatcagcgtgctgaccgtggccgacaccgtgagaacctgcagcctggaccagtgctacaagaccttcctgagccccgccaccagcgagaccaagagaaagatgagcaccttcgtgagcagcgtgaagagcagcgacagccccacccagcacgccgtgggcttccagaaggccttccagctgatcagaagcaccaacaacaacaccaagttccaggccaacaccgacatggtgatcatctacctgagcgccggcatcaccagcaaggacagcagcgaggaggacaagaaggccaccctgcaggtgatcaacgaggagaacagcttcctgaacaacagcgtgatgatcctgacctacgccctgatgaacgacggcgtgaccggcctgaaggagctggccttcctgagagacctggccgagcagaacagcggcaagtacggcgtgcccgacagaatggccctgcccgtgatcaagggcagcatgatggtgctgaaccagctgagcaacctggagaccaccgtgggcagattctacaccaacctgcccaacagaatgatcgacgaggccgtgttcagcctgcccttcagcgacgagatgggcgacggcctgatcatgaccgtgagcaagccctgctacttcggcaacctgctgctgggcatcgtgggcgtggacgtgaacctggcctacatcctggaggacgtgacctactaccaggacagcctggccagctacaccttcctgatcgacgacaagggctacaccctgatgcaccccagcctgaccagaccctacctgctgagcgagccccccctgcacaccgacatcatccactacgagaacatccccaagttcgagctggtgagacagaacatcctgagcctgcccctgggcagccagatcatcgccgtgcccgtgaacagcagcctgagctggcacatcaacaagctgagagagaccggcaaggaggcctacaacgtgagctacgcctggaagatggtgcaggacaccagcttcatcctgtgcatcgtggtgatccagcccgagatccccgtgaagcagctgaagaacctgaacaccgtgcccagcagcaagctgctgtaccacagactggacctgctgggccagcccagcgcctgcctgcacttcaagcagctggccaccctggagagccccaccatcatgctgagcgccggcagcttcagcagcccctacgagcacctgagccagcccgagaccaagagaatggtggagcactacaccgcctacctgagcgacaacaccagactgatcgccaaccccggcctgaagttcagcgtgagaaacgaggtgatggccaccagccacgtgaccgacgagtggatgacccagatggagatgagcagcctgaacacctacatcgtgagaagatacatcgccacccccaacggcgtgctgagaatctaccccggcagcctgatggacaaggccttcgaccccaccagaagacagtggtacctgcacgccgtggccaaccccggcctgatcagcctgaccggcccctacctggacgtgggcggcgccggctacgtggtgaccatcagccacaccatccacagcagcagcacccagctgagcagcggccacaccgtggccgtgatgggcatcgacttcaccctgagatacttctacaaggtgctgatggacctgctgcccgtgtgcaaccaggacggcggcaacaagatcagatgcttcatcatggaggacagaggctacctggtggcccaccccaccctgatcgaccccaagggccacgcccccgtggagcagcagcacatcacccacaaggagcccctggtggccaacgacatcctgaaccaccccaacttcgtgaagaagaacctgtgcaacagcttcagcgacagaaccgtgcagagattctacaagttcaacaccagcctggccggcgacctgaccaacctggtgcacggcagccactgcagcaagtacagactggccagaatccccggcaccaacgccttcgtgggcatcgtgaacgagacctgcgacagcctggccttctgcgcctgcagcatggtggacagactgtgcctgaactgccacagaatggagcagaacgagtgcgagtgcccctgcgagtgccccctggaggtgaacgagtgcaccggcaacctgaccaacgccgagaacagaaaccccagctgcgaggtgcaccaggagcccgtgacctacaccgccatcgaccccggcctgcaggacgccctgcaccagtgcgtgaacagcagatgcagccagagactggagagcggcgactgcttcggcgtgctggactgcgagtggtgcatggtggacagcgacggcaagacccacctggacaagccctactgcgccccccagaaggagtgcttcggcggcatcgtgggcgccaagagcccctacgtggacgacatgggcgccatcggcgacgaggtgatcaccctgaacatgatcaagagcgcccccgtgggccccgtggccggcggcatcatgggctgcatcatggtgctggtgctggccgtgtacgcctacagacaccagatccacagaagaagccaccagcacatgagccccctggccgcccaggagatgagcgtgagaatgagcaacctggagaacgacagagacgagagagacgacgacagccacgaggacagaggcatcatcagcaacaccagattcatcgccgccgtgatcgagagacacgcccacagccccgagagaagaagaagatactggggcagaagcggcaccgagagcgaccacggctacagcaccatgagcccccaggaggacagcgagaaccccccctgcaacaacgaccccctgagcgccggcgtggacgtgggcaaccacgacgaggacctggacctggacacccccccccagaccgccgccctgctgagccacaagttccaccactacagaagccaccaccccaccctgcaccacagccaccacctgcaggccgccgtgaccgtgcacaccgtggacgccgagtgctag

SEQ ID NO: 16699 - DNA, 3825 bp, Artificial Sequence
  Description of Artificial Sequence: Synthetic coding sequence
atggccagacagcccgaggaggaggagaccgccgtggccagagccagaagaccccccctgtggctgctgtgcctggtggcctgctggctgctgggcgccggcgccgaggccgacttcagcatcctggacgaggcccaggtgctggccagccagatgagaagactggccgccgaggagctgggcgtggtgaccatgcagagaatcttcaacagcttcgtgtacaccgagaagatcagcaacggcgagagcgaggtgcagcagctggccaagaagatcagagagaagttcaacagatacctggacgtggtgaacagaaacaagcaggtggtggaggccagctacaccgcccacctgaccagccccctgaccgccatccaggactgctgcaccatcccccccagcatgatggagttcgacggcaacttcaacaccaacgtgagcagaaccatcagctgcgacagactgagcaccaccgtgaacagcagagccttcaaccccggcagagacctgaacagcgtgctggccgacaacctgaagagcaaccccggcatcaagtggcagtacttcagcagcgaggagggcatcttcaccgtgttccccgcccacaagttcagatgcaagggcagctacgagcacagaagcagacccatctacgtgagcaccgtgagaccccagagcaagcacatcgtggtgatcctggaccacggcgccagcgtgaccgacacccagctgcagatcgccaaggacgccgcccaggtgatcctgagcgccatcgacgagcacgacaagatcagcgtgctgaccgtggccgacaccgtgagaacctgcagcctggaccagtgctacaagaccttcctgagccccgccaccagcgagaccaagagaaagatgagcaccttcgtgagcagcgtgaagagcagcgacagccccacccagcacgccgtgggcttccagaaggccttccagctgatcagaagcaccaacaacaacaccaagttccaggccaacaccgacatggtgatcatctacctgagcgccggcatcaccagcaaggacagcagcgaggaggacaagaaggccaccctgcaggtgatcaacgaggagaacagcttcctgaacaacagcgtgatgatcctgacctacgccctgatgaacgacggcgtgaccggcctgaaggagctggccttcctgagagacctggccgagcagaacagcggcaagtacggcgtgcccgacagaatggccctgcccgtgatcaagggcagcatgatggtgctgaaccagctgagcaacctggagaccaccgtgggcagattctacaccaacctgcccaacagaatgatcgacgaggccgtgttcagcctgcccttcagcgacgagatgggcgacggcctgatcatgaccgtgagcaagccctgctacttcggcaacctgctgctgggcatcgtgggcgtggacgtgaacctggcctacatcctggaggacgtgacctactaccaggacagcctggccagctacaccttcctgatcgacgacaagggctacaccctgatgcaccccagcctgaccagaccctacctgctgagcgagccccccctgcacaccgacatcatccactacgagaacatccccaagttcgagctggtgagacagaacatcctgagcctgcccctgggcagccagatcatcgccgtgcccgtgaacagcagcctgagctggcacatcaacaagctgagagagaccggcaaggaggcctacaacgtgagctacgcctggaagatggtgcaggacaccagcttcatcctgtgcatcgtggtgatccagcccgagatccccgtgaagcagctgaagaacctgaacaccgtgcccagcagcaagctgctgtaccacagactggacctgctgggccagcccagcgcctgcctgcacttcaagcagctggccaccctggagagccccaccatcatgctgagcgccggcagcttcagcagcccctacgagcacctgagccagcccgagaccaagagaatggtggagcactacaccgcctacctgagcgacaacaccagactgatcgccaaccccggcctgaagttcagcgtgagaaacgaggtgatggccaccagccacgtgaccgacgagtggatgacccagatggagatgagcagcctgaacacctacatcgtgagaagatacatcgccacccccaacggcgtgctgagaatctaccccggcagcctgatggacaaggccttcgaccccaccagaagacagtggtacctgcacgccgtggccaaccccggcctgatcagcctgaccggcccctacctggacgtgggcggcgccggctacgtggtgaccatcagccacaccatccacagcagcagcacccagctgagcagcggccacaccgtggccgtgatgggcatcgacttcaccctgagatacttctacaaggtgctgatggacctgctgcccgtgtgcaaccaggacggcggcaacaagatcagatgcttcatcatggaggacagaggctacctggtggcccaccccaccctgatcgaccccaagggccacgcccccgtggagcagcagcacatcacccacaaggagcccctggtggccaacgacatcctgaaccaccccaacttcgtgaagaagaacctgtgcaacagcttcagcgacagaaccgtgcagagattctacaagttcaacaccagcctggccggcgacctgaccaacctggtgcacggcagccactgcagcaagtacagactggccagaatccccggcaccaacgccttcgtgggcatcgtgaacgagacctgcgacagcctggccttctgcgcctgcagcatggtggacagactgtgcctgaactgccacagaatggagcagaacgagtgcgagtgcccctgcgagtgccccctggaggtgaacgagtgcaccggcaacctgaccaacgccgagaacagaaaccccagctgcgaggtgcaccaggagcccgtgacctacaccgccatcgaccccggcctgcaggacgccctgcaccagtgcgtgaacagcagatgcagccagagactggagagcggcgactgcttcggcgtgctggactgcgagtggtgcatggtggacagcgacggcaagacccacctggacaagccctactgcgccccccagaaggagtgcttcggcggcatcgtgggcgccaagagcccctacgtggacgacatgggcgccatcggcgacgaggtgatcaccctgaacatgatcaagagcgcccccgtgggccccgtggccggcggcatcatgggctgcatcatggtgctggtgctggccgtgtacgcctacagacaccagatccacagaagaagccaccagcacatgagccccctggccgcccaggagatgagcgtgagaatgagcaacctggagaacgacagagacgagagagacgacgacagccacgaggacagaggcatcatcagcaacaccagattcatcgccgccgtgatcgagagacacgcccacagccccgagagaagaagaagatactggggcagaagcggcaccgagagcgaccacggctacagcaccatgagcccccaggaggacagcgagaaccccccctgcaacaacgaccccctgagcgccggcgtggacgtgggcaaccacgacgaggacctggacctggacacccccccccagaccgccgccctgctgagccacaagttccaccactacagaagccaccaccccaccctgcaccacagccaccacctgcaggccgccgtgaccgtgcacaccgtggacgccgagtgctag

SEQ ID NO: 16700 - DNA, 2460 bp, Artificial Sequence
  Description of Artificial Sequence: Synthetic coding sequence
atgtggggcctggtgagactgctgctggcctggctgggcggctggggctgcatgggcagactggccgcccccgccagagcctgggccggcagcagagagcaccccggccccgccctgctgagaaccagaagaagctgggtgtggaaccagttcttcgtgatcgaggagtacgccggccccgagcccgtgctgatcggcaagctgcacagcgacgtggacagaggcgagggcagaaccaagtacctgctgaccggcgagggcgccggcaccgtgttcgtgatcgacgaggccaccggcaacatccacgtgaccaagagcctggacagagaggagaaggcccagtacgtgctgctggcccaggccgtggacagagccagcaacagacccctggagccccccagcgagttcatcatcaaggtgcaggacatcaacgacaacccccccatcttccccctgggcccctaccacgccaccgtgcccgagatgagcaacgtgggcaccagcgtgatccaggtgaccgcccacgacgccgacgaccccagctacggcaacagcgccaagctggtgtacaccgtgctggacggcctgcccttcttcagcgtggacccccagaccggcgtggtgagaaccgccatccccaacatggacagagagacccaggaggagttcctggtggtgatccaggccaaggacatgggcggccacatgggcggcctgagcggcagcaccaccgtgaccgtgaccctgagcgacgtgaacgacaacccccccaagttcccccagagcctgtaccagttcagcgtggtggagaccgccggccccggcaccctggtgggcagactgagagcccaggaccccgacctgggcgacaacgccctgatggcctacagcatcctggacggcgagggcagcgaggccttcagcatcagcaccgacctgcagggcagagacggcctgctgaccgtgagaaagcccctggacttcgagagccagagaagctacagcttcagagtggaggccaccaacaccctgatcgaccccgcctacctgagaagaggccccttcaaggacgtggccagcgtgagagtggccgtgcaggacgcccccgagccccccgccttcacccaggccgcctaccacctgaccgtgcccgagaacaaggcccccggcaccctggtgggccagatcagcgccgccgacctggacagccccgccagccccatcagatacagcatcctgccccacagcgaccccgagagatgcttcagcatccagcccgaggagggcaccatccacaccgccgcccccctggacagagaggccagagcctggcacaacctgaccgtgctggccaccgagctgggctggagctggggccccgagagaggctgggtgcccctgctggtggccgagtggagcgcccccgccgcccccccccagagaagccccgtgggcagcgccgtgggcatcccccaggacagcagcgcccaggccagcagagtgcaggtggccatccagaccctggacgagaacgacaacgccccccagctggccgagccctacgacaccttcgtgtgcgacagcgccgcccccggccagctgatccaggtgatcagagccctggacagagacgaggtgggcaacagcagccacgtgagcttccagggccccctgggccccgacgccaacttcaccgtgcaggacaacagagacggcagcgccagcctgctgctgcccagcagacccgccccccccagacacgccccctacctggtgcccatcgagctgtgggactggggccagcccgccctgagcagcaccgccaccgtgaccgtgagcgtgtgcagatgccagcccgacggcagcgtggccagctgctggcccgaggcccacctgagcgccgccggcctgagcaccggcgccctgctggccatcatcacctgcgtgggcgccctgctggccctggtggtgctgttcgtggccctgagaagacagaagcaggaggccctgatggtgctggaggaggaggacgtgagagagaacatcatcacctacgacgacgagggcggcggcgaggaggacaccgaggccttcgacatcaccgccctgcagaaccccgacggcgccgccccccccgcccccggcccccccgccagaagagacgtgctgcccagagccagagtgagcagacagcccagaccccccggccccgccgacgtggcccagctgctggccctgagactgagagaggccgacgaggaccccggcgtgcccccctacgacagcgtgcaggtgtacggctacgagggcagaggcagcagctgcggcagcctgagcagcctgggcagcggcagcgaggccggcggcgcccccggccccgccgagcccctggacgactggggccccctgttcagaaccctggccgagctgtacggcgccaaggagccccccgccccctag

SEQ ID NO: 16701 - DNA, 2460 bp, Artificial Sequence; identical to SEQ ID NO: 16700
  Description of Artificial Sequence: Synthetic coding sequence

SEQ ID NO: 16702 - DNA, 945 bp, Artificial Sequence
  Description of Artificial Sequence: Synthetic coding sequence
atgtggggcctggtgagactgctgctggcctggctgggcggctggggctgcatgggcagactggccgcccccgccagagcctgggccggcagcagagagcaccccggccccgccctgctgagaaccagaagaagctgggtgtggaaccagttcttcgtgatcgaggagtacgccggccccgagcccgtgctgatcggcaagctgcacagcgacgtggacagaggcgagggcagaaccaagtacctgctgaccggcgagggcgccggcaccgtgttcgtgatcgacgaggccaccggcaacatccacgtgaccaagagcctggacagagaggagaaggcccagtacgtgctgctggcccaggccgtggacagagccagcaacagacccctggagccccccagcgagttcatcatcaagatcatcacctgcgtgggcgccctgctggccctggtggtgctgttcgtggccctgagaagacagaagcaggaggccctgatggtgctggaggaggaggacgtgagagagaacatcatcacctacgacgacgagggcggcggcgaggaggacaccgaggccttcgacatcaccgccctgcagaaccccgacggcgccgccccccccgcccccggcccccccgccagaagagacgtgctgcccagagccagagtgagcagacagcccagaccccccggccccgccgacgtggcccagctgctggccctgagactgagagaggccgacgaggaccccggcgtgcccccctacgacagcgtgcaggtgtacggctacgagggcagaggcagcagctgcggcagcctgagcagcctgggcagcggcagcgaggccggcggcgcccccggccccgccgagcccctggacgactggggccccctgttcagaaccctggccgagctgtacggcgccaaggagccccccgccccctag

SEQ ID NO: 16703 - DNA, 2346 bp, Artificial Sequence
  Description of Artificial Sequence: Synthetic coding sequence
atgtggggcctggtgagactgctgctggcctggctgggcggctggggctgcatgggcagactggccgcccccgccagagcctgggccggcagcagagagcaccccggccccgccctgctgagaaccagaagaagctgggtgtggaaccagttcttcgtgatcgaggagtacgccggccccgagcccgtgctgatcggcaagctgcacagcgacgtggacagaggcgagggcagaaccaagtacctgctgaccggcgagggcgccggcaccgtgttcgtgatcgacgaggccaccggcaacatccacgtgaccaagagcctggacagagaggagaaggcccagtacgtgctgctggcccaggccgtggacagagccagcaacagacccctggagccccccagcgagttcatcatcaaggtgcaggacatcaacgacaacccccccatcttccccctgggcccctaccacgccaccgtgcccgagatgagcaacgtgggcaccagcgtgatccaggtgaccgcccacgacgccgacgaccccagctacggcaacagcgccaagctggtgtacaccgtgctggacggcctgcccttcttcagcgtggacccccagaccggcgtggtgagaaccgccatccccaacatggacagagagacccaggaggagttcctggtggtgatccaggccaaggacatgggcggccacatgggcggcctgagcggcagcaccaccgtgaccgtgaccctgagcgacgtgaacgacaacccccccaagttcccccagagcctgtaccagttcagcgtggtggagaccgccggccccggcaccctggtgggcagactgagagcccaggaccccgacctgggcgacaacgccctgatggcctacagcatcctggacggcgagggcagcgaggccttcagcatcagcaccgacctgcagggcagagacggcctgctgaccgtgagaaagcccctggacttcgagagccagagaagctacagcttcagagtggaggccaccaacaccctgatcgaccccgcctacctgagaagaggccccttcaaggacgtggccagcgtgagagtggccgtgcaggacgcccccgagccccccgccttcacccaggccgcctaccacctgaccgtgcccgagaacaaggcccccggcaccctggtgggccagatcagcgccgccgacctggacagccccgccagccccatcagatacagcatcctgccccacagcgaccccgagagatgcttcagcatccagcccgaggagggcaccatccacaccgccgcccccctggacagagaggccagagcctggcacaacctgaccgtgctggccaccgagctggacagcagcgcccaggccagcagagtgcaggtggccatccagaccctggacgagaacgacaacgccccccagctggccgagccctacgacaccttcgtgtgcgacagcgccgcccccggccagctgatccaggtgatcagagccctggacagagacgaggtgggcaacagcagccacgtgagcttccagggccccctgggccccgacgccaacttcaccgtgcaggacaacagagacggcagcgccagcctgctgctgcccagcagacccgccccccccagacacgccccctacctggtgcccatcgagctgtgggactggggccagcccgccctgagcagcaccgccaccgtgaccgtgagcgtgtgcagatgccagcccgacggcagcgtggccagctgctggcccgaggcccacctgagcgccgccggcctgagcaccggcgccctgctggccatcatcacctgcgtgggcgccctgctggccctggtggtgctgttcgtggccctgagaagacagaagcaggaggccctgatggtgctggaggaggaggacgtgagagagaacatcatcacctacgacgacgagggcggcggcgaggaggacaccgaggccttcgacatcaccgccctgcagaaccccgacggcgccgccccccccgcccccggcccccccgccagaagagacgtgctgcccagagccagagtgagcagacagcccagaccccccggccccgccgacgtggcccagctgctggccctgagactgagagaggccgacgaggaccccggcgtgcccccctacgacagcgtgcaggtgtacggctacgagggcagaggcagcagctgcggcagcctgagcagcctgggcagcggcagcgaggccggcggcgcccccggccccgccgagcccctggacgactggggccccctgttcagaaccctggccgagctgtacggcgccaaggagccccccgccccctag

SEQ ID NO: 16704 - DNA, 2346 bp, Artificial Sequence; identical to SEQ ID NO: 16703
  Description of Artificial Sequence: Synthetic coding sequence

SEQ ID NO: 16705 - DNA, 2559 bp, Artificial Sequence
  Description of Artificial Sequence: Synthetic coding sequence
atggccatgagaagcggcagacaccccagcctgctgctgctgctggtgctgctgctgtggctgctgcaggtgagcatcatcgacagcgtgcagcaggagaccgacgacctgaccaagcagaccaaggagaagatctaccagcccctgagaagaagcaagagaagatgggtgatcaccaccctggagctggaggaggaggaccccggccccttccccaagctgatcggcgagctgttcaacaacatgagctacaacatgagcctgatgtacctgatcagcggccccggcgtggacgagtaccccgagatcggcctgttcagcctggaggaccacgagaacggcagaatctacgtgcacagacccgtggacagagagatgacccccagcttcaccgtgtacttcgacgtggtggagagaagcaccggcaagatcgtggacaccagcctgatcttcaacatcagaatcagcgacgtgaacgaccacgccccccagttccccgagaaggagttcaacatcaccgtgcaggagaaccagagcgccggccagcccatcttccagatgctggccgtggacctggacgaggagaacacccccaacagccaggtgctgtacttcctgatcagccagacccccctgctgaaggagagcggcttcagagtggacagactgagcggcgagatcagactgagcggctgcctggactacgagaccgccccccagttcaccctgctgatcagagccagagactgcggcgagcccagcctgagcagcaccaccaccgtgcacgtggacgtgcaggagggcaacaaccacagacccgccttcacccaggagaactacaaggtgcagatccccgagggcagagccagccagggcgtgctgagactgctggtgcaggacagagacagccccttcaccagcgcctggagagccaagttcaacatcctgcacggcaacgaggagggccacttcgacatcagcaccgaccccgagaccaacgagggcatcctgaacgtgatcaagcccctggactacgagaccagacccgcccagagcctgatcatcgtggtggagaacgaggagagactggtgttctgcgagagaggcaagctgcagccccccagaaaggccgccgccagcgccaccgtgagcgtgcaggtgaccgacgccaacgacccccccgccttccacccccagagcttcatcgtgaacaaggaggagggcgccagacccggcaccctgctgggcaccttcaacgccatggaccccgacagccagatcagatacgagctggtgcacgaccccgccaactgggtgagcgtggacaagaacagcggcgtggtgatcaccgtggagcccatcgacagagagagcccccacgtgaacaacagcttctacgtgatcatcatccacgccgtggacgacggcttccccccccagaccgccaccggcaccctgatgctgttcctgagcgacatcaacgacaacgtgcccaccctgagacccagaagcagatacatggaggtgtgcgagagcgccgtgcacgagcccctgcacatcgaggccgaggaccccgacctggagcccttcagcgaccccttcaccttcgagctggacaacacctggggcaacgccgaggacacctggaagctgggcagaaactggggccagagcgtggagctgctgaccctgagaagcctgcccagaggcaactacctggtgcccctgttcatcggcgacaagcagggcctgagccagaagcagaccgtgcacgtgagaatctgcccctgcgccagcggcctgacctgcgtggagctggccgacgccgaggtgggcctgcacgtgggcgccctgttccccgtgtgcgccgccttcgtggccctggccgtggccctgctgttcctgctgagatgctacttcgtgctggagcccaagagacacggctgcagcgtgagcaacgacgagggccaccagaccctggtgatgtacaacgccgagagcaagggcaccagcgcccagacctggagcgacgtggagggccagagacccgccctgctgatctgcaccgccgccgccggccccacccagggcgtgaaggcctaccccgacgccaccatgcacagacagctgctggcccccgtggagggcagaatggccgagaccctgaaccagagcaaggagagaaacagattcagcctgagcagaggctgcatcatcccccagggcagagccaccgccggcagaggcctgccccaggacatctacaaggagatgatgcccagaagactgacccagaccggcaagagaaagcacggcgccctggccagaacccccagcttcaagaaggtggtgtacgaccacaaggaggacgaggagaacaaggccggcagaaagcagagaagccacctgttcaaggtgatgcagctgagaaacgagcagggcggcgtgagagtgcagagcgcccacagccccagccccctgaacaagaaggcctgcttccccggcgactacagaggcgagagcgccggcggccacaactgcagagccgtgagcggctag

SEQ ID NO: 16706 - DNA, 375 bp, Artificial Sequence
  Description of Artificial Sequence: Synthetic coding sequence
atgaagcccctgatctggacctggagcgacgtggagggccagagacccgccctgctgatctgcaccgccgccgccggccccacccagggcgtgaaggcctaccccgacgccaccatgcacagacagctgctggcccccgtggagggcagaatggccgagaccctgaaccagaagctgcacgtggccaacgtgctggaggacgaccccggctacctgccccacgtgtacagcgaggagggcgagtgcggcggcgcccccagcctgagcagcctggccagcctggagcaggagctgcagcccgacctgctggacagcctgggcagcaaggccacccccttcgaggagatctacagcgagagcggcgtgcccagctag

SEQ ID NO: 16707 - DNA, 2499 bp, Artificial Sequence
  Description of Artificial Sequence: Synthetic coding sequence
atggccatgagaagcggcagacaccccagcctgctgctgctgctggtgctgctgctgtggctgctgcaggtgagcatcatcgacagcgtgcagcaggagaccgacgacctgaccaagcagaccaaggagaagatctaccagcccctgagaagaagcaagagaagatgggtgatcaccaccctggagctggaggaggaggaccccggccccttccccaagctgatcggcgagctgttcaacaacatgagctacaacatgagcctgatgtacctgatcagcggccccggcgtggacgagtaccccgagatcggcctgttcagcctggaggaccacgagaacggcagaatctacgtgcacagacccgtggacagagagatgacccccagcttcaccgtgtacttcgacgtggtggagagaagcaccggcaagatcgtggacaccagcctgatcttcaacatcagaatcagcgacgtgaacgaccacgccccccagttccccgagaaggagttcaacatcaccgtgcaggagaaccagagcgccggccagcccatcttccagatgctggccgtggacctggacgaggagaacacccccaacagccaggtgctgtacttcctgatcagccagacccccctgctgaaggagagcggcttcagagtggacagactgagcggcgagatcagactgagcggctgcctggactacgagaccgccccccagttcaccctgctgatcagagccagagactgcggcgagcccagcctgagcagcaccaccaccgtgcacgtggacgtgcaggagggcaacaaccacagacccgccttcacccaggagaactacaaggtgcagatccccgagggcagagccagccagggcgtgctgagactgctggtgcaggacagagacagccccttcaccagcgcctggagagccaagttcaacatcctgcacggcaacgaggagggccacttcgacatcagcaccgaccccgagaccaacgagggcatcctgaacgtgatcaagcccctggactacgagaccagacccgcccagagcctgatcatcgtggtggagaacgaggagagactggtgttctgcgagagaggcaagctgcagccccccagaaaggccgccgccagcgccaccgtgagcgtgcaggtgaccgacgccaacgacccccccgccttccacccccagagcttcatcgtgaacaaggaggagggcgccagacccggcaccctgctgggcaccttcaacgccatggaccccgacagccagatcagatacgagctggtgcacgaccccgccaactgggtgagcgtggacaagaacagcggcgtggtgatcaccgtggagcccatcgacagagagagcccccacgtgaacaacagcttctacgtgatcatcatccacgccgtggacgacggcttccccccccagaccgccaccggcaccctgatgctgttcctgagcgacatcaacgacaacgtgcccaccctgagacccagaagcagatacatggaggtgtgcgagagcgccgtgcacgagcccctgcacatcgaggccgaggaccccgacctggagcccttcagcgaccccttcaccttcgagctggacaacacctggggcaacgccgaggacacctggaagctgggcagaaactggggccagagcgtggagctgctgaccctgagaagcctgcccagaggcaactacctggtgcccctgttcatcggcgacaagcagggcctgagccagaagcagaccgtgcacgtgagaatctgcccctgcgccagcggcctgacctgcgtggagctggccgacgccgaggtgggcctgcacgtgggcgccctgttccccgtgtgcgccgccttcgtggccctggccgtggccctgctgttcctgctgagatgctacttcgtgctggagcccaagagacacggctgcagcgtgagcaacgacgagggccaccagaccctggtgatgtacaacgccgagagcaagggcaccagcgcccagacctggagcgacgtggagggccagagacccgccctgctgatctgcaccgccgccgccggccccacccagggcgtgaaggacctggaggaggtgccccccagcgccgccagccagagcgcccaggccagatgcgccctgggcagctggggctacggcaagcccttcgagcccagaagcgtgaagaacatccacagcacccccgcctaccccgacgccaccatgcacagacagctgctggcccccgtggagggcagaatggccgagaccctgaaccagaagctgcacgtggccaacgtgctggaggacgaccccggctacctgccccacgtgtacagcgaggagggcgagtgcggcggcgcccccagcctgagcagcctggccagcctggagcaggagctgcagcccgacctgctggacagcctgggcagcaaggccacccccttcgaggagatctacagcgagagcggcgtgcccagctag

SEQ ID NO: 16708 - DNA, 498 bp, Artificial Sequence
  Description of Artificial Sequence: Synthetic coding sequence
atgaagcccctgatctggacctggagcgacgtggagggccagagacccgccctgctgatctgcaccgccgccgccggccccacccagggcgtgaaggacctggaggaggtgccccccagcgccgccagccagagcgcccaggccagatgcgccctgggcagctggggctacggcaagcccttcgagcccagaagcgtgaagaacatccacagcacccccgcctaccccgacgccaccatgcacagacagctgctggcccccgtggagggcagaatggccgagaccctgaaccagaagctgcacgtggccaacgtgctggaggacgaccccggctacctgccccacgtgtacagcgaggagggcgagtgcggcggcgcccccagcctgagcagcctggccagcctggagcaggagctgcagcccgacctgctggacagcctgggcagcaaggccacccccttcgaggagatctacagcgagagcggcgtgcccagctag

SEQ ID NO: 16709 - DNA, 1335 bp, Artificial Sequence
  Description of Artificial Sequence: Synthetic coding sequence
tgaagacccggcaccctgctgggcaccttcaacgccatggaccccgacagccagatcagatacgagctggtgcacgaccccgccaactgggtgagcgtggacaagaacagcggcgtggtgatcaccgtggagcccatcgacagagagagcccccacgtgaacaacagcttctacgtgatcatcatccacgccgtggacgacggcttccccccccagaccgccaccggcaccctgatgctgttcctgagcgacatcaacgacaacgtgcccaccctgagacccagaagcagatacatggaggtgtgcgagagcgccgtgcacgagcccctgcacatcgaggccgaggaccccgacctggagcccttcagcgaccccttcaccttcgagctggacaacacctggggcaacgccgaggacacctggaagctgggcagaaactggggccagagcgtggagctgctgaccctgagaagcctgcccagaggcaactacctggtgcccctgttcatcggcgacaagcagggcctgagccagaagcagaccgtgcacgtgagaatctgcccctgcgccagcggcctgacctgcgtggagctggccgacgccgaggtgggcctgcacgtgggcgccctgttccccgtgtgcgccgccttcgtggccctggccgtggccctgctgttcctgctgagatgctacttcgtgctggagcccaagagacacggctgcagcgtgagcaacgacgagggccaccagaccctggtgatgtacaacgccgagagcaagggcaccagcgcccagacctggagcgacgtggagggccagagacccgccctgctgatctgcaccgccgccgccggccccacccagggcgtgaaggcctaccccgacgccaccatgcacagacagctgctggcccccgtggagggcagaatggccgagaccctgaaccagagcaaggagagaaacagattcagcctgagcagaggctgcatcatcccccagggcagagccaccgccggcagaggcctgccccaggacatctacaaggagatgatgcccagaagactgacccagaccggcaagagaaagcacggcgccctggccagaacccccagcttcaagaaggtggtgtacgaccacaaggaggacgaggagaacaaggccggcagaaagcagagaagccacctgttcaaggtgatgcagctgagaaacgagcagggcggcgtgagagtgcagagcgcccacagccccagccccctgaacaagaaggcctgcttccccggcgactacagaggcgagagcgccggcggccacaactgcagagccgtgagcggctag

SEQ ID NO: 16710 - DNA, 3933 bp, Artificial Sequence
  Description of Artificial Sequence: Synthetic coding sequence
atggcccagctgtggctgagctgcttcctgctgcccgccctggtggtgagcgtggccgccaacgtggcccccaagttcctggccaacatgaccagcgtgatcctgcccgaggacctgcccgtgggcgcccaggccttctggctggtggccgaggaccaggacaacgaccccctgacctacggcatgagcggccccaacgcctacttcttcgccgtgacccccaagaccggcgaggtgaagctggccagcgccctggactacgagaccctgtacaccttcaaggtgaccatcagcgtgagcgacccctacatccaggtgcagagagagatgctggtgatcgtggaggacagaaacgacaacgcccccgtgttccagaacaccgccttcagcaccagcatcaacgagaccctgcccgtgggcagcgtggtgttcagcgtgctggccgtggacaaggacatgggcagcgccggcatggtggtgtacagcatcgagaaggtgatccccagcaccggcgacagcgagcacctgttcagaatcctggccaacggcagcatcgtgctgaacggcagcctgagctacaacaacaagagcgccttctaccagctggagctgaaggcctgcgacctgggcggcatgtaccacaacaccttcaccatccagtgcagcctgcccgtgttcctgagcatcagcgtggtggaccagcccgacctggacccccagttcgtgagagagttctacagcgccagcgtggccgaggacgccgccaagggcaccagcgtgctgaccgtggaggccgtggacggcgacaagggcatcaacgaccccgtgatctacagcatcagctacagcaccagacccggctggttcgacatcggcgccgacggcgtgatcagagtgaacggcagcctggacagagagcagctgctggaggccgacgaggaggtgcagctgcaggtgaccgccaccgagacccacctgaacatctacggccaggaggccaaggtgagcatctgggtgaccgtgagagtgatggacgtgaacgaccacaagcccgagttctacaactgcagcctgcccgcctgcaccttcacccccgaggaggcccaggtgaacttcaccggctacgtggacgagcacgccagccccagaatccccatcgacgacctgaccatggtggtgtacgaccccgacaagggcagcaacggcaccttcctgctgagcctgggcggccccgacgccgaggccttcagcgtgagccccgagagagccgtgggcagcgccagcgtgcaggtgctggtgagagtgagcgccctggtggactacgagagacagaccgccatggccgtgcaggtggtggccaccgacagcgtgagccagaacttcagcgtggccatggtgaccatccacctgagagacatcaacgaccacagacccaccttcccccagagcctgtacgtgctgaccgtgcccgagcacagcgccaccggcagcgtggtgaccgacagcatccacgccaccgaccccgacaccggcgcctggggccagatcacctacagcctgctgcccggcaacggcgccgacctgttccaggtggaccccgtgagcggcaccgtgaccgtgagaaacggcgagctgctggacagagagagccaggccgtgtactacctgaccctgcaggccaccgacggcggcaacctgagcagcagcaccaccctgcagatccacctgctggacatcaacgacaacgcccccgtggtgagcggcagctacaacatcttcgtgcaggaggaggagggcaacgtgagcgtgaccatccaggcccacgacaacgacgagcccggcaccaacaacagcagactgctgttcaacctgctgcccggcccctacagccacaacttcagcctggaccccgacaccggcctgctgagaaacctgggccccctggacagagaggccatcgaccccgccctggagggcagaatcgtgctgaccgtgctggtgagcgactgcggcgagcccgtgctgggcaccaaggtgaacgtgaccatcaccgtggaggacatcaacgacaacctgcccatcttcaaccagagcagctacaacttcaccgtgaaggaggaggaccccggcgtgctggtgggcgtggtgaaggcctgggacgccgaccagaccgaggccaacaacagaatcagcttcagcctgagcggcagcggcgccaactacttcatgatcagaggcctggtgctgggcgccggctgggccgagggctacctgagactgccccccgacgtgagcctggactacgagacccagcccgtgttcaacctgaccgtgagcgccgagaaccccgacccccagggcggcgagaccatcgtggacgtgtgcgtgaacgtgaaggacgtgaacgacaacccccccaccctggacgtggccagcctgagaggcatcagagtggccgagaacggcagccagcacggccaggtggccgtggtggtggccagcgacgtggacaccagcgcccagctggagatccagctggtgaacatcctgtgcaccaaggccggcgtggacgtgggcagcctgtgctggggctggttcagcgtggccgccaacggcagcgtgtacatcaaccagagcaaggccatcgactacgaggcctgcgacctggtgaccctggtggtgagagcctgcgacctggccaccgaccccggcttccaggcctacagcaacaacggcagcctgctgatcaccatcgaggacgtgaacgacaacgccccctacttcctgcccgagaacaagaccttcgtgatcatccccgagctggtgctgcccaacagagaggtggccagcgtgagagccagagacgacgacagcggcaacaacggcgtgatcctgttcagcatcctgagagtggacttcatcagcaaggacggcgccaccatccccttccagggcgtgttcagcatcttcaccagcagcgaggccgacgtgttcgccggcagcatccagcccgtgaccagcctggacagcaccctgcagggcacctaccaggtgaccgtgcaggccagagacagacccagcctgggccccttcctggaggccaccaccaccctgaacctgttcaccgtggaccagagctacagaagcagactgcagttcagcacccccaaggaggaggtgggcgccaacagacaggccatcaacgccgccctgacccaggccaccagaaccaccgtgtacatcgtggacatccaggacatcgacagcgccgccagagccagaccccacagctacctggacgcctacttcgtgttccccaacggcagcgccctgaccctggacgagctgagcgtgatgatcagaaacgaccaggacagcctgacccagctgctgcagctgggcctggtggtgctgggcagccaggagagccaggagagcgacctgagcaagcagctgatcagcgtgatcatcggcctgggcgtggccctgctgctggtgctggtgatcatgaccatggccttcgtgtgcgtgagaaagagctacaacagaaagctgcaggccatgaaggccgccaaggaggccagaaagaccgccgccggcgtgatgcccagcgcccccgccatccccggcaccaacatgtacaacaccgagagagccaaccccatgctgaacctgcccaacaaggacctgggcctggagtacctgagccccagcaacgacctggacagcgtgagcgtgaacagcctggacgacaacagcgtggacgtggacaagaacagccaggagatcaaggagcacagacccccccacaccccccccgagcccgaccccgagcccctgagcgtggtgctgctgggcagacaggccggcgccagcggccagctggagggccccagctacaccaacgccggcctggacaccaccgacctgtag

SEQ ID NO: 16711 - DNA, 3933 bp, Artificial Sequence; identical to SEQ ID NO: 16710
  Description of Artificial Sequence: Synthetic coding sequence

SEQ ID NO: 16712 - DNA, 3933 bp, Artificial Sequence; identical to SEQ ID NO: 16710
  Description of Artificial Sequence: Synthetic coding sequence

SEQ ID NO: 16713 - DNA, 2658 bp, Artificial Sequence
  Description of Artificial Sequence: Synthetic coding sequence
atgcaggaggccatcatcctgctggccctgctgggcgccatgagcggcggcgaggccctgcacctgatcctgctgcccgccaccggcaacgtggccgagaacagcccccccggcaccagcgtgcacaagttcagcgtgaagctgagcgccagcctgagccccgtgatccccggcttcccccagatcgtgaacagcaaccccctgaccgaggccttcagagtgaactggctgagcggcacctacttcgaggtggtgaccaccggcatggagcagctggacttcgagaccggccccaacatcttcgacctgcagatctacgtgaaggacgaggtgggcgtgaccgacctgcaggtgctgaccgtgcaggtgaccgacgtgaacgagcccccccagttccagggcaacctggccgagggcctgcacctgtacatcgtggagagagccaaccccggcttcatctaccaggtggaggccttcgaccccgaggacaccagcagaaacatccccctgagctacttcctgatcagcccccccaagagcttcagaatgagcgccaacggcaccctgttcagcaccaccgagctggacttcgaggccggccacagaagcttccacctgatcgtggaggtgagagacagcggcggcctgaaggccagcaccgagctgcaggtgaacatcgtgaacctgaacgacgaggtgcccagattcaccagccccaccagagtgtacaccgtgctggaggagctgagccccggcaccatcgtggccaacatcaccgccgaggaccccgacgacgagggcttccccagccacctgctgtacagcatcaccaccgtgagcaagtacttcatgatcaaccagctgaccggcaccatccaggtggcccagagaatcgacagagacgccggcgagctgagacagaaccccaccatcagcctggaggtgctggtgaaggacagaccctacggcggccaggagaacagaatccagatcaccttcatcgtggaggacgtgaacgacaaccccgccacctgccagaagttcaccttcagcatcatggtgcccgagagaaccgccaagggcaccctgctgctggacctgaacaagttctgcttcgacgacgacagcgaggcccccaacaacagattcaacttcaccatgcccagcggcgtgggcagcggcagcagattcctgcaggaccccgccggcagcggcaagatcgtgctgatcggcgacctggactacgagaaccccagcaacctggccgccggcaacaagtacaccgtgatcatccaggtgcaggacgtggcccccccctactacaagaacaacgtgtacgtgtacatcctgaccagccccgagaacgagttccccctgatcttcgacagacccagctacgtgttcgacgtgagcgagagaagacccgccagaaccagagtgggccaggtgagagccaccgacaaggacctgccccagagcagcctgctgtacagcatcagcaccggcggcgccagcctgcagtaccccaacgtgttctggatcaaccccaagaccggcgagctgcagctggtgaccaaggtggactgcgagaccacccccatctacatcctgagaatccaggccaccaacaacgaggacaccagcagcgtgaccgtgaccgtgaacatcctggaggagaacgacgagaagcccatctgcacccccaacagctacttcctggccctgcccgtggacctgaaggtgggcaccaacatccagaacttcaagctgacctgcaccgacctggacagcagccccagaagcttcagatacagcatcggccccggcaacgtgaacaaccacttcaccttcagccccaacgccggcagcaacgtgaccagactgctgctgaccagcagattcgactacgccggcggcttcgacaagatctgggactacaagctgctggtgtacgtgaccgacgacaacctgatgagcgacagaaagaaggccgaggccctggtggagaccggcaccgtgaccctgagcatcaaggtgatcccccaccccaccaccatcatcaccaccacccccagacccagagtgacctaccaggtgctgagaaagaacgtgtacagccccagcgcctggtacgtgcccttcgtgatcaccctgggcagcatcctgctgctgggcctgctggtgtacctggtggtgctgctggccaaggccatccacagacactgcccctgcaagaccggcaagaacaaggagcccctgaccaagaagggcgagaccaagaccgccgagagagacgtggtggtggagaccatccagatgaacaccatcttcgacggcgaggccatcgaccccgtgaccggcgagacctacgagttcaacagcaagaccggcgccagaaagtggaaggaccccctgacccagatgcccaagtggaaggagagcagccaccagggcgccgcccccagaagagtgaccgccggcgagggcatgggcagcctgagaagcgccaactgggaggaggacgagctgagcggcaaggcctgggccgaggacgccggcctgggcagcagaaacgagggcggcaagctgggcaaccccaagaacagaaaccccgccttcatgaacagagcctaccccaagccccaccccggcaagtag

SEQ ID NO: 16714 - DNA, 600 bp, Artificial Sequence
  Description of Artificial Sequence: Synthetic coding sequence
atggtgctgctgagactgctggtgttcctgttcgcccccgtggtgagcgacctgtgcagcctgccctgcttcatcaacgtgagcgagagccagggccccggcaccgtgctgcagttcctgagcttcaactgcagcagctacacccccacccccaccctggagctgctgaacgtgcagccccccaccaccttcttcaacccccccagcctggccagatggcagggcacctacgtgggcaagctgaccctgagcagcagcgcccagctggacgccctgatggtgaaccactacaaggtgcagctgaagttcacctgcggcaaccacgtgatggagggcagcctgagcgtggacgtgcagagagacctgagccacatccagtgcgccggccagttcgccagccccggcgaggccagaggcagcagacagggcggcggcagacacggcctgagcagaagcagcctgaccagcaccctggccagctggggcaacgacagcggcgccagagacagccacacctggggcagcgccgtgcacagcgccccccccagacccagaacccccagaagcgccggcaagcccagaacctgggacggcggctag

SEQ ID NO: 16715 - DNA, 2367 bp, Artificial Sequence
  Description of Artificial Sequence: Synthetic coding sequence
atggtgctgctgagactgctggtgttcctgttcgcccccgtggtgagcgacctgtgcagcctgccctgcttcatcaacgtgagcgagagccagggccccggcaccgtgctgcagttcctgagcttcaactgcagcagctacacccccacccccaccctggagctgctgaacgtgcagccccccaccaccttcttcaacccccccagcctggccagatggcagggcacctacgtgggcaagctgaccctgagcagcagcgcccagctggacgccctgatggtgaaccactacaaggtgcagctgaagttcacctgcggcaaccacgtgatggagggcagcctgagcgtggacgtgcagagagacctgagccacatccagtgcgccggccagttcgccagccccgccggcgagatgatccaggtgcccgagaccgtgacccccggcgccagactgtacaccctgctgctgcccggcctggagctgcacggcgcccagatgagcatcatcagcgcccaggacctgccccacttccccggccccttcagcatcaacgagcagggctggctgcaggcccccagccagggcctgctgggccaggcccagaaggtgttccagctgcagatcagcgtgagcttcggccagagacagagctgccagggcatggtgatcgtgaaggtgctgcccgtgcccagcagccaggtgagcttcctggagcaggcccagaacatcaccatccccgagaacctggcccccggcagcgaggtggtgcaggtgcaggccagaggcgtggacctgagatacgagatcctgagccccgtgcccagccccctgttcagcatcggcagagccgacggcgtggtgagaaccaccacccccctggagctggccagaaccagcggcaccgccgtgagcagactgcaggtgaaggccttcgagcagggccagctgtgggccagcgccaagctgaacctgaccatgaacgtgcagctggtgaacctgtggccccccagatgcctgcccgccctgctggtgagccagatccccgagaccgcccccgtgggcaccgtgctgaacaccctgacctgcgaggaccccgacagcgtgggcgccaccctggactacaagctgtggttcagaagcagcagcaaccccgccagcctgtgcctgtacgacagagtgctggaggtgaacgccaccctggactgcgacacccccggcgcctgcttccagcacgccgccagcatcctggtgctggacggcggccagccccagatgaccaccgaggtgcccgtgctggtgatggtgacccccatcaacgagttcagccccgcctgcgcccccagaaccttcagagtgcaggaggacgccgccccccacaccctgctgggcagcgtggtgggcaccgacatggactacccccacgacaacatcgagtactacaccagcggcggccccaccaccttcgccgtggacagactgagcggcgaggtgcacctgctgggccccctggactacgagcagcagagactgtacagactgaccgtgctggtgatcgaccacggccaggaccagaaccccaaccaccacctgagcggcagctgcaccatcaccatcgaggtggaggacgtgaacgaccacgcccccgagtgcgagccccccttccaggagctgaccatctacgcccccctgggcagaagcgtggaggtgaccaagatgagctgccagatcccccaggagccccagagactgatctacagctacagcatcgtgggcggcaacagccagaacagattcatcctgcagggcgccatcctggtgcacagcgacctggtgctgggccccttctggcccgagcagcccagaacctacgagctgctgatctgcgtggccgacgccggccccagcaccccccacctgagcaccaccgccaccatcatcgtgcacctggtgcccagaagagccagcaccgtggccaccagcacccacagaaccaccgtgcccagcaccatgacccccatgctggtgaccgacaccgaggccttctggcagccccagccctggttcgtggtggtgctgaccgccaccggcgccctgctgctgctggccctgggctggctgctgggcagactgctgcagggcctggcccagctgctgcaggcccccagcaagcccgcccaggccctgctgctgaacagcatccagggcaccgagggcagcatcgagggcttcctggaggcccccaagatggagatgagccaggcccccagcagcgtgatgagcctgcacttcgacggcagagcccaggacagcagaaccggcagagactacctgttcaacacccacaccggcgccagaagatggctgtag

SEQ ID NO: 16716 - DNA, 684 bp, Artificial Sequence
  Description of Artificial Sequence: Synthetic coding sequence
atgggcaactgcgtgaagtaccccctgagaaacctgagcagaaagatgtgccaggaggagcagaccagctacatggtggtgcagaccagcgaggagggcctggccgccgacgccgagctgcccggccccctgctgatgctggcccagaactgcgccgtgatgcacaacctgctgggccccgcctgcatcttcctgagaaagggcttcgccgagaacagacagcccgacagaagcctgagacccgaggagatcgaggagctgagagaggccttcagagagttcgacaaggacaaggacggctacatcaactgcagagacctgggcaactgcatgagaaccatgggctacatgcccaccgagatggagctgatcgagctgagccagcagatcaacatgaacctgggcggccacgtggacttcgacgacttcgtggagctgatgggccccaagctgctggccgagaccgccgacatgatcggcgtgaaggagctgagagacgccttcagagagttcgacaccaacggcgacggcgagatcagcaccagcgagctgagagaggccatgagaaagctgctgggccaccaggtgggccacagagacatcgaggagatcatcagagacgtggacctgaacggcgacggcagagtggacttcgaggagttcgtgagaatgatgagcagatag

SEQ ID NO: 16717 - DNA, 1113 bp, Artificial Sequence
  Description of Artificial Sequence: Synthetic coding sequence
atgggcggcggcgacggcgccgccttcaagagacccggcgacggcgccagactgcagagagtgctgggcctgggcagcagaagagagcccagaagcctgcccgccggcggccccgcccccagaagaaccgccccccccccccccggccacgccagcgccggccccgccgccatgagcagccacatcgccaagagcgagagcaagaccagcctgctgaaggccgccgccgccgccgccagcggcggcagcagagcccccagacacggccccgccagagaccccggcctgcccagcagaagactgcccggcagctgccccgccaccccccagagcagcggcgaccccagcagcagaagacccctgtgcagacccgcccccagagaggagggcgccagaggcagccagagagtgctgccccaggcccactgcagacccagagaggccctgcccgccgccgccagcagacccagccccagcagccccctgccccccgccagaggcagagacggcgaggagagaggcctgagccccgccctgggcctgagaggcagcctgagagccagaggcagaggcgacagcgtgcccgccgccgccagcgaggccgaccccttcctgcacagactgagacccatgctgagcagcgccttcggccaggacagaagcctgagacccgaggagatcgaggagctgagagaggccttcagagagttcgacaaggacaaggacggctacatcaactgcagagacctgggcaactgcatgagaaccatgggctacatgcccaccgagatggagctgatcgagctgagccagcagatcaacatgaacctgggcggccacgtggacttcgacgacttcgtggagctgatgggccccaagctgctggccgagaccgccgacatgatcggcgtgaaggagctgagagacgccttcagagagttcgacaccaacggcgacggcgagatcagcaccagcgagctgagagaggccatgagaaagctgctgggccaccaggtgggccacagagacatcgaggagatcatcagagacgtggacctgaacggcgacggcagagtggacttcgaggagttcgtgagaatgatgagcagatag

SEQ ID NO: 16718 - DNA, 504 bp, Artificial Sequence
  Description of Artificial Sequence: Synthetic coding sequence
atgggcaactgcgtgaagtaccccctgagaaacctgagcagaaaggacagaagcctgagacccgaggagatcgaggagctgagagaggccttcagagagttcgacaaggacaaggacggctacatcaactgcagagacctgggcaactgcatgagaaccatgggctacatgcccaccgagatggagctgatcgagctgagccagcagatcaacatgaacctgggcggccacgtggacttcgacgacttcgtggagctgatgggccccaagctgctggccgagaccgccgacatgatcggcgtgaaggagctgagagacgccttcagagagttcgacaccaacggcgacggcgagatcagcaccagcgagctgagagaggccatgagaaagctgctgggccaccaggtgggccacagagacatcgaggagatcatcagagacgtggacctgaacggcgacggcagagtggacttcgaggagttcgtgagaatgatgagcagatag

SEQ ID NO: 16719 - DNA, 1266 bp, Artificial Sequence
  Description of Artificial Sequence: Synthetic coding sequence
atggtggagatgctgcccaccgccatcctgctggtgctggccgtgagcgtggtggccaaggacaacgccacctgcgacggcccctgcggcctgagattcagacagaacccccagggcggcgtgagaatcgtgggcggcaaggccgcccagcacggcgcctggccctggatggtgagcctgcagatcttcacctacaacagccacagataccacacctgcggcggcagcctgctgaacagcagatgggtgctgaccgccgcccactgcttcgtgggcaagaacaacgtgcacgactggagactggtgttcggcgccaaggagatcacctacggcaacaacaagcccgtgaaggcccccctgcaggagagatacgtggagaagatcatcatccacgagaagtacaacagcgccaccgagggcaacgacatcgccctggtggagatcaccccccccatcagctgcggcagattcatcggccccggctgcctgccccacttcaaggccggcctgcccagaggcagccagagctgctgggtggccggctggggctacatcgaggagaaggcccccagacccagcagcatcctgatggaggccagagtggacctgatcgacctggacctgtgcaacagcacccagtggtacaacggcagagtgcagcccaccaacgtgtgcgccggctaccccgtgggcaagatcgacacctgccagggcgacagcggcggccccctgatgtgcaaggacagcaaggagagcgcctacgtggtggtgggcatcaccagctggggcgtgggctgcgccagagccaagagacccggcatctacaccgccacctggccctacctgaactggatcgccagcaagatcggcagcaacgccctgagaatgatccagagcgccaccccccccccccccaccaccagacccccccccatcagaccccccttcagccaccccatcagcgcccacctgccctggtacttccagcccccccccagacccctgccccccagaccccccgccgcccagcccagacccccccccagcccccccccccccccccccccccccgccagccccctgcccccccccccccccccccccccccccacccccagcagcaccaccaagctgccccagggcctgagcttcgccaagagactgcagcagctgatcgaggtgctgaagggcaagacctacagcgacggcaagaaccactacgacatggagaccaccgagctgcccgagctgaccagcaccagctag

SEQ ID NO: 16720 - DNA, 3333 bp, Artificial Sequence
  Description of Artificial Sequence: Synthetic coding sequence
atggccgccggctgcctgctggccctgaccctgaccctgttccagagcctgctgatcggccccagcagcgaggagcccttccccagcgccgtgaccatcaagagctgggtggacaagatgcaggaggacctggtgaccctggccaagaccgccagcggcgtgaaccagctggtggacatctacgagaagtaccaggacctgtacaccgtggagcccaacaacgccagacagctggtggagatcgccgccagagacatcgagaagctgctgagcaacagaagcaaggccctggtgagactggccctggaggccgagaaggtgcaggccgcccaccagtggagagaggacttcgccagcaacgaggtggtgtactacaacgccaaggacgacctggaccccgagaagaacgacagcgagcccggcagccagagaatcaagcccgtgttcatcgaggacgccaacttcggcagacagatcagctaccagcacgccgccgtgcacatccccaccgacatctacgagggcagcaccatcgtgctgaacgagctgaactggaccagcgccctggacgaggtgttcaagaagaacagagaggaggaccccagcctgctgtggcaggtgttcggcagcgccaccggcctggccagatactaccccgccagcccctgggtggacaacagcagaacccccaacaagatcgacctgtacgacgtgagaagaagaccctggtacatccagggcgccgccagccccaaggacatgctgatcctggtggacgtgagcggcagcgtgagcggcctgaccctgaagctgatcagaaccagcgtgagcgagatgctggagaccctgagcgacgacgacttcgtgaacgtggccagcttcaacagcaacgcccaggacgtgagctgcttccagcacctggtgcaggccaacgtgagaaacaagaaggtgctgaaggacgccgtgaacaacatcaccgccaagggcatcaccgactacaagaagggcttcagcttcgccttcgagcagctgctgaactacaacgtgagcagagccaactgcaacaagatcatcatgctgttcaccgacggcggcgaggagagagcccaggagatcttcaacaagtacaacaaggacaagaaggtgagagtgttcaccttcagcgtgggccagcacaactacgacagaggccccatccagtggatggcctgcgagaacaagggctactactacgagatccccagcatcggcgccatcagaatcaacacccaggagtacctggacgtgctgggcagacccatggtgctggccggcgacaaggccaagcaggtgcagtggaccaacgtgtacctggacgccctggagctgggcctggtgatcaccggcaccctgcccgtgttcaacatcaccggccagttcgagaacaagaccaacctgaagaaccagctgatcctgggcgtgatgggcgtggacgtgagcctggaggacatcaagagactgacccccagattcaccctgtgccccaacggctactacttcgccatcgaccccaacggctacgtgctgctgcaccccaacctgcagcccaagcccatcggcgtgggcatccccaccatcaacctgagaaagagaagacccaacatccagaaccccaagagccaggagcccgtgaccctggacttcctggacgccgagctggagaacgacatcaaggtggagatcagaaacaagatgatcgacggcgagagcggcgagaagaccttcagaaccctggtgaagagccaggacgagagatacatcgacaagggcaacagaacctacacctggacccccgtgaacggcaccgactacagcctggccctggtgctgcccacctacagcttctactacatcaaggccaagctggaggagaccatcacccaggccagatgcaagtactgcgagagaagcgacagcgagaccctgaagcccgacaacttcgaggagagcggctacaccttcatcgcccccagagactactgcaacgacctgaagatcagcgacaacaacaccgagttcctgctgaacttcaacgagttcatcgacagaaagacccccaacaaccccagctgcaacgccgacctgatcaacagagtgctgctggacgccggcttcaccaacgagctggtgcagaactactggagcaagcagaagaacatcaagggcgtgaaggccagattcgtggtgaccgacggcggcatcaccagagtgtaccccaaggaggccggcgagaactggcaggagaaccccgagacctacgaggacagcttctacaagagaagcctggacaacgacaactacgtgttcaccgccccctacttcaacaagagcggccccggcgcctacgagagcggcatcatggtgagcaaggccgtggagatctacatccagggcaagctgctgaagcccgccgtggtgggcatcaagatcgacgtgaacagctggatcgagaacttcaccaagaccagcatcagagacccctgcgccggccccgtgtgcgactgcaagagaaacagcgacgtgatggactgcgtgatcctggacgacggcggcttcctgctgatggccaaccacgacgactacaccaaccagatcggcagattcttcggcgagatcgaccccagcctgatgagacacctggtgaacatcagcgtgtacgccttcaacaagagctacgactaccagagcgtgtgcgagcccggcgccgcccccaagcagggcgccggccacagaagcgcctacgtgcccagcgtggccgacatcctgcagatcggctggtgggccaccgccgccgcctggagcatcctgcagcagttcctgctgagcctgaccttccccagactgctggaggccgtggagatggaggacgacgacttcaccgccagcctgagcaagcagagctgcatcaccgagcagacccagtacttcttcgacaacgacagcaagagcttcagcggcgtgctggactgcggcaactgcagcagaatcttccacggcgagaagctgatgaacaccaacctgatcttcatcatggtggagagcaagggcacctgcccctgcgacaccagactgctgatccaggccgagcagaccagcgacggccccaacccctgcgacatggtgaagcagcccagatacagaaagggccccgacgtgtgcttcgacaacaacgtgctggaggactacaccgactgcggcggcgtgagcggcctgaaccccagcctgtggtacatcatcggcatccagttcctgctgctgtggctggtgagcggcagcacccacagactgctgtag

SEQ ID NO: 16721 - DNA, 3312 bp, Artificial Sequence
  Description of Artificial Sequence: Synthetic coding sequence
atggccgccggctgcctgctggccctgaccctgaccctgttccagagcctgctgatcggccccagcagcgaggagcccttccccagcgccgtgaccatcaagagctgggtggacaagatgcaggaggacctggtgaccctggccaagaccgccagcggcgtgaaccagctggtggacatctacgagaagtaccaggacctgtacaccgtggagcccaacaacgccagacagctggtggagatcgccgccagagacatcgagaagctgctgagcaacagaagcaaggccctggtgagactggccctggaggccgagaaggtgcaggccgcccaccagtggagagaggacttcgccagcaacgaggtggtgtactacaacgccaaggacgacctggaccccgagaagaacgacagcgagcccggcagccagagaatcaagcccgtgttcatcgaggacgccaacttcggcagacagatcagctaccagcacgccgccgtgcacatccccaccgacatctacgagggcagcaccatcgtgctgaacgagctgaactggaccagcgccctggacgaggtgttcaagaagaacagagaggaggaccccagcctgctgtggcaggtgttcggcagcgccaccggcctggccagatactaccccgccagcccctgggtggacaacagcagaacccccaacaagatcgacctgtacgacgtgagaagaagaccctggtacatccagggcgccgccagccccaaggacatgctgatcctggtggacgtgagcggcagcgtgagcggcctgaccctgaagctgatcagaaccagcgtgagcgagatgctggagaccctgagcgacgacgacttcgtgaacgtggccagcttcaacagcaacgcccaggacgtgagctgcttccagcacctggtgcaggccaacgtgagaaacaagaaggtgctgaaggacgccgtgaacaacatcaccgccaagggcatcaccgactacaagaagggcttcagcttcgccttcgagcagctgctgaactacaacgtgagcagagccaactgcaacaagatcatcatgctgttcaccgacggcggcgaggagagagcccaggagatcttcaacaagtacaacaaggacaagaaggtgagagtgttcaccttcagcgtgggccagcacaactacgacagaggccccatccagtggatggcctgcgagaacaagggctactactacgagatccccagcatcggcgccatcagaatcaacacccaggagtacctggacgtgctgggcagacccatggtgctggccggcgacaaggccaagcaggtgcagtggaccaacgtgtacctggacgccctggagctgggcctggtgatcaccggcaccctgcccgtgttcaacatcaccggccagttcgagaacaagaccaacctgaagaaccagctgatcctgggcgtgatgggcgtggacgtgagcctggaggacatcaagagactgacccccagattcaccctgtgccccaacggctactacttcgccatcgaccccaacggctacgtgctgctgcaccccaacctgcagcccaagcccatcggcgtgggcatccccaccatcaacctgagaaagagaagacccaacatccagaaccccaagagccaggagcccgtgaccctggacttcctggacgccgagctggagaacgacatcaaggtggagatcagaaacaagatgatcgacggcgagagcggcgagaagaccttcagaaccctggtgaagagccaggacgagagatacatcgacaagggcaacagaacctacacctggacccccgtgaacggcaccgactacagcctggccctggtgctgcccacctacagcttctactacatcaaggccaagctggaggagaccatcacccaggccagatacagcgagaccctgaagcccgacaacttcgaggagagcggctacaccttcatcgcccccagagactactgcaacgacctgaagatcagcgacaacaacaccgagttcctgctgaacttcaacgagttcatcgacagaaagacccccaacaaccccagctgcaacgccgacctgatcaacagagtgctgctggacgccggcttcaccaacgagctggtgcagaactactggagcaagcagaagaacatcaagggcgtgaaggccagattcgtggtgaccgacggcggcatcaccagagtgtaccccaaggaggccggcgagaactggcaggagaaccccgagacctacgaggacagcttctacaagagaagcctggacaacgacaactacgtgttcaccgccccctacttcaacaagagcggccccggcgcctacgagagcggcatcatggtgagcaaggccgtggagatctacatccagggcaagctgctgaagcccgccgtggtgggcatcaagatcgacgtgaacagctggatcgagaacttcaccaagaccagcatcagagacccctgcgccggccccgtgtgcgactgcaagagaaacagcgacgtgatggactgcgtgatcctggacgacggcggcttcctgctgatggccaaccacgacgactacaccaaccagatcggcagattcttcggcgagatcgaccccagcctgatgagacacctggtgaacatcagcgtgtacgccttcaacaagagctacgactaccagagcgtgtgcgagcccggcgccgcccccaagcagggcgccggccacagaagcgcctacgtgcccagcgtggccgacatcctgcagatcggctggtgggccaccgccgccgcctggagcatcctgcagcagttcctgctgagcctgaccttccccagactgctggaggccgtggagatggaggacgacgacttcaccgccagcctgagcaagcagagctgcatcaccgagcagacccagtacttcttcgacaacgacagcaagagcttcagcggcgtgctggactgcggcaactgcagcagaatcttccacggcgagaagctgatgaacaccaacctgatcttcatcatggtggagagcaagggcacctgcccctgcgacaccagactgctgatccaggccgagcagaccagcgacggccccaacccctgcgacatggtgaagcagcccagatacagaaagggccccgacgtgtgcttcgacaacaacgtgctggaggactacaccgactgcggcggcgtgagcggcctgaaccccagcctgtggtacatcatcggcatccagttcctgctgctgtggctggtgagcggcagcacccacagactgctgtag

SEQ ID NO: 16722 - DNA, 3276 bp, Artificial Sequence
  Description of Artificial Sequence: Synthetic coding sequence
atggccgccggctgcctgctggccctgaccctgaccctgttccagagcctgctgatcggccccagcagcgaggagcccttccccagcgccgtgaccatcaagagctgggtggacaagatgcaggaggacctggtgaccctggccaagaccgccagcggcgtgaaccagctggtggacatctacgagaagtaccaggacctgtacaccgtggagcccaacaacgccagacagctggtggagatcgccgccagagacatcgagaagctgctgagcaacagaagcaaggccctggtgagactggccctggaggccgagaaggtgcaggccgcccaccagtggagagaggacttcgccagcaacgaggtggtgtactacaacgccaaggacgacctggaccccgagaagaacgacagcgagcccggcagccagagaatcaagcccgtgttcatcgaggacgccaacttcggcagacagatcagctaccagcacgccgccgtgcacatccccaccgacatctacgagggcagcaccatcgtgctgaacgagctgaactggaccagcgccctggacgaggtgttcaagaagaacagagaggaggaccccagcctgctgtggcaggtgttcggcagcgccaccggcctggccagatactaccccgccagcccctgggtggacaacagcagaacccccaacaagatcgacctgtacgacgtgagaagaagaccctggtacatccagggcgccgccagccccaaggacatgctgatcctggtggacgtgagcggcagcgtgagcggcctgaccctgaagctgatcagaaccagcgtgagcgagatgctggagaccctgagcgacgacgacttcgtgaacgtggccagcttcaacagcaacgcccaggacgtgagctgcttccagcacctggtgcaggccaacgtgagaaacaagaaggtgctgaaggacgccgtgaacaacatcaccgccaagggcatcaccgactacaagaagggcttcagcttcgccttcgagcagctgctgaactacaacgtgagcagagccaactgcaacaagatcatcatgctgttcaccgacggcggcgaggagagagcccaggagatcttcaacaagtacaacaaggacaagaaggtgagagtgttcaccttcagcgtgggccagcacaactacgacagaggccccatccagtggatggcctgcgagaacaagggctactactacgagatccccagcatcggcgccatcagaatcaacacccaggagtacctggacgtgctgggcagacccatggtgctggccggcgacaaggccaagcaggtgcagtggaccaacgtgtacctggacgccctggagctgggcctggtgatcaccggcaccctgcccgtgttcaacatcaccggccagttcgagaacaagaccaacctgaagaaccagctgatcctgggcgtgatgggcgtggacgtgagcctggaggacatcaagagactgacccccagattcaccctgtgccccaacggctactacttcgccatcgaccccaacggctacgtgctgctgcaccccaacctgcagcccaagaaccccaagagccaggagcccgtgaccctggacttcctggacgccgagctggagaacgacatcaaggtggagatcagaaacaagatgatcgacggcgagagcggcgagaagaccttcagaaccctggtgaagagccaggacgagagatacatcgacaagggcaacagaacctacacctggacccccgtgaacggcaccgactacagcctggccctggtgctgcccacctacagcttctactacatcaaggccaagctggaggagaccatcacccaggccagaagcaagaagggcaagatgaaggacagcgagaccctgaagcccgacaacttcgaggagagcggctacaccttcatcgcccccagagactactgcaacgacctgaagatcagcgacaacaacaccgagttcctgctgaacttcaacgagttcatcgacagaaagacccccaacaaccccagctgcaacgccgacctgatcaacagagtgctgctggacgccggcttcaccaacgagctggtgcagaactactggagcaagcagaagaacatcaagggcgtgaaggccagattcgtggtgaccgacggcggcatcaccagagtgtaccccaaggaggccggcgagaactggcaggagaaccccgagacctacgaggacagcttctacaagagaagcctggacaacgacaactacgtgttcaccgccccctacttcaacaagagcggccccggcgcctacgagagcggcatcatggtgagcaaggccgtggagatctacatccagggcaagctgctgaagcccgccgtggtgggcatcaagatcgacgtgaacagctggatcgagaacttcaccaagaccagcatcagagacccctgcgccggccccgtgtgcgactgcaagagaaacagcgacgtgatggactgcgtgatcctggacgacggcggcttcctgctgatggccaaccacgacgactacaccaaccagatcggcagattcttcggcgagatcgaccccagcctgatgagacacctggtgaacatcagcgtgtacgccttcaacaagagctacgactaccagagcgtgtgcgagcccggcgccgcccccaagcagggcgccggccacagaagcgcctacgtgcccagcgtggccgacatcctgcagatcggctggtgggccaccgccgccgcctggagcatcctgcagcagttcctgctgagcctgaccttccccagactgctggaggccgtggagatggaggacgacgacttcaccgccagcctgagcaagcagagctgcatcaccgagcagacccagtacttcttcgacaacgacagcaagagcttcagcggcgtgctggactgcggcaactgcagcagaatcttccacggcgagaagctgatgaacaccaacctgatcttcatcatggtggagagcaagggcacctgcccctgcgacaccagactgctgatccaggccgagcagaccagcgacggccccaacccctgcgacatggtgaagcagcccagatacagaaagggccccgacgtgtgcttcgacaacaacgtgctggaggactacaccgactgcggcggcgtgagcggcctgaaccccagcctgtggtacatcatcggcatccagttcctgctgctgtggctggtgagcggcagcacccacagactgctgtag

SEQ ID NO: 16723 - DNA, 912 bp, Artificial Sequence
  Description of Artificial Sequence: Synthetic coding sequence
atggtgggcctgcccgagttcatccccaagatcgtgggcatcaagatcgacgtgaacagctggatcgagaacttcaccaagaccagcatcagagacccctgcgccggccccgtgtgcgactgcaagagaaacagcgacgtgatggactgcgtgatcctggacgacggcggcttcctgctgatggccaaccacgacgactacaccaaccagatcggcagattcttcggcgagatcgaccccagcctgatgagacacctggtgaacatcagcgtgtacgccttcaacaagagctacgactaccagagcgtgtgcgagcccggcgccgcccccaagcagggcgccggccacagaagcgcctacgtgcccagcgtggccgacatcctgcagatcggctggtgggccaccgccgccgcctggagcatcctgcagcagttcctgctgagcctgaccttccccagactgctggaggccgtggagatggaggacgacgacttcaccgccagcctgagcaagcagagctgcatcaccgagcagacccagtacttcttcgacaacgacagcaagagcttcagcggcgtgctggactgcggcaactgcagcagaatcttccacggcgagaagctgatgaacaccaacctgatcttcatcatggtggagagcaagggcacctgcccctgcgacaccagactgctgatccaggccgagcagaccagcgacggccccaacccctgcgacatggtgaagcagcccagatacagaaagggccccgacgtgtgcttcgacaacaacgtgctggaggactacaccgactgcggcggcgtgagcggcctgaaccccagcctgtggtacatcatcggcatccagttcctgctgctgtggctggtgagcggcagcacccacagactgctgtag

SEQ ID NO: 16724 - DNA, 984 bp, Artificial Sequence
  Description of Artificial Sequence: Synthetic coding sequence
atggtgagatgcgacagaggcctgcagatgctgctgaccaccgccggcgccttcgccgccttcagcctgatggccatcgccatcggcaccgactactggctgtacagcagcgcccacatctgcaacggcaccaacctgaccatggacgacggccccccccccagaagagccagaggcgacctgacccacagcggcctgtggagagtgtgctgcatcgagggcatctacaagggccactgcttcagaatcaaccacttccccgaggacaacgactacgaccacgacagcagcgagtacctgctgagaatcgtgagagccagcagcgtgttccccatcctgagcaccatcctgctgctgctgggcggcctgtgcatcggcgccggcagaatctacagcagaaagaacaacatcgtgctgagcgccggcatcctgttcgtggccgccggcctgagcaacatcatcggcatcatcgtgtacatcagcagcaacaccggcgaccccagcgacaagagagacgaggacaagaagaaccactacaactacggctggagcttctacttcggcgccctgagcttcatcgtggccgagaccgtgggcgtgctggccgtgaacatctacatcgagaagaacaaggagctgagattcaagaccaagagagagttcctgaaggccagcagcagcagcccctacgccagaatgcccagctacagatacagaagaagaagaagcagaagcagcagcagaagcaccgaggccagccccagcagagacgtgagccccatgggcctgaagatcaccggcgccatccccatgggcgagctgagcatgtacaccctgagcagagagcccctgaaggtgaccaccgccgccagctacagccccgaccaggaggccagcttcctgcaggtgcacgacttcttccagcaggacctgaaggagggcttccacgtgagcatgctgaacagaagaaccacccccgtgtag

SEQ ID NO: 16725 - DNA, 6120 bp, Artificial Sequence
  Description of Artificial Sequence: Synthetic coding sequence
gagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactggatgcaggacgccatgggctacgagctgccctgggtgtacttcgtgagcctggtgatcttcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaacaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagaatgcactgctgcgacatgctggacggcggcaccttcccccccgccctgggccccagaagagcccccccctgcctgcaccagcagctgcagggcagcctggccggcctgagagaggacaccccctgcatcgtgcccggccacgccagcctgtgctgcagcagcagagtgggcgagtggctgcccgccggctgcaccgccccccagcacgccagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 16726 - DNA, 6522 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgggcaacgccgactacgtgttcaccagcatcttcaccctggagatcatcctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagagagagacacgtgcccatgtgcgaggacctggagctgagaagagacagcggcagcgccggcacccaggcccactgcctgctgctgagaaaggccaaccccagcagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 16727 - DNA, 6492 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacagaggcacccccgccggcatgctggaccagaagaagggcaagttcgcctggttcagccacagcaccgagacccacgtgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 16728 - DNA, 6753 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgagggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaagcaaggagaagcagatggccgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16729 - DNA, 7032 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgagggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaagcaaggagaagcagatggccgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccgacagacagctgttcgacaccatcagcctgctgatccagggcagcctggagtgggagctgaagctgatggacgagctggccggccccggcggccagcccagcgccttccccagcgcccccagcctgggcggcagcgacccccagatccccctggccgagatggaggccctgagcctgaccagcgagatcgtgagcgagcccagctgcagcctggccctgaccgacgacagcctgcccgacgacatgcacaccctgctgctgagcgccctggagagcaacatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16730 - DNA, 6516 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgagggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaagcaaggagaagcagatggccgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16731 - DNA, 7134 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccgacagacagctgttcgacaccatcagcctgctgatccagggcagcctggagtgggagctgaagctgatggacgagctggccggccccggcggccagcccagcgccttccccagcgcccccagcctgggcggcagcgacccccagatccccctggccgagatggaggccctgagcctgaccagcgagatcgtgagcgagcccagctgcagcctggccctgaccgacgacagcctgcccgacgacatgcacaccctgctgctgagcgccctggagagcaacatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16732 - DNA, 6786 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgagggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16733 - DNA, 4668 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggtgagccccagactgagaggcggcgccgtggtgaaggaggccggcggcggcaccggcccctgcctggtgatccccgccgacagcggcggcggcggcctgcacgaggagatcagccccagccaccccctgctgagcaaccaccagcacgtggccaagcccagccccagccacagcgcccccaagagcggccccatgggcagcctggccgtgctgaaggacgaggagaccgaggcccagagaggctag

SEQ ID NO: 16734 - DNA, 6801 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16735 - DNA, 6732 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgagggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16736 - DNA, 6921 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgagggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatccccctggccgagatggaggccctgagcctgaccagcgagatcgtgagcgagcccagctgcagcctggccctgaccgacgacagcctgcccgacgacatgcacaccctgctgctgagcgccctggagagcaacatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16737 - DNA, 5262 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgagggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccagctgtgggcctggagcagcctggagacctggagcgtgaccagacacacccccgtgagagcctgggccgtgatgccccccttcggcaccctggcctggcccagctag

SEQ ID NO: 16738 - DNA, 6753 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagaacttccacaagtgcagacagcaccaggaggaggaggaggccagaagaagagaggagaagagactgagaagactggagaagaagagaagaaacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16739 - DNA, 5208 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgagggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccagctgtgggcctggagcagcctggagacctggagcgtgaccagacacacccccgtgagagcctgggccgtgatgccccccttcggcaccctggcctggcccagctag

SEQ ID NO: 16740 - DNA, 5298 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaagcaaggagaagcagatggccgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccagctgtgggcctggagcagcctggagacctggagcgtgaccagacacacccccgtgagagcctgggccgtgatgccccccttcggcaccctggcctggcccagctag

SEQ ID NO: 16741 - DNA, 6618 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16742 - DNA, 5331 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccagctgtgggcctggagcagcctggagacctggagcgtgaccagacacacccccgtgagagcctgggccgtgatgccccccttcggcaccctggcctggcccagctag

SEQ ID NO: 16743 - DNA, 7101 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaagcaaggagaagcagatggccgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccgacagacagctgttcgacaccatcagcctgctgatccagggcagcctggagtgggagctgaagctgatggacgagctggccggccccggcggccagcccagcgccttccccagcgcccccagcctgggcggcagcgacccccagatccccctggccgagatggaggccctgagcctgaccagcgagatcgtgagcgagcccagctgcagcctggccctgaccgacgacagcctgcccgacgacatgcacaccctgctgctgagcgccctggagagcaacatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16744 - DNA, 6999 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccgacagacagctgttcgacaccatcagcctgctgatccagggcagcctggagtgggagctgaagctgatggacgagctggccggccccggcggccagcccagcgccttccccagcgcccccagcctgggcggcagcgacccccagatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16745 - DNA, 6834 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16746 - DNA, 6585 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaagcaaggagaagcagatggccgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16747 - DNA, 6897 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgagggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaagcaaggagaagcagatggccgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccgacagacagctgttcgacaccatcagcctgctgatccagggcagcctggagtgggagctgaagctgatggacgagctggccggccccggcggccagcccagcgccttccccagcgcccccagcctgggcggcagcgacccccagatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16748 - DNA, 6699 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagaacttccacaagtgcagacagcaccaggaggaggaggaggccagaagaagagaggagaagagactgagaagactggagaagaagagaagaaaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16749 - DNA, 5277 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccagctgtgggcctggagcagcctggagacctggagcgtgaccagacacacccccgtgagagcctgggccgtgatgccccccttcggcaccctggcctggcccagctag

SEQ ID NO: 16750 - DNA, 5241 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgagggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccctgtgggcctggagcagcctggagacctggagcgtgaccagacacacccccgtgagagcctgggccgtgatgccccccttcggcaccctggcctggcccagctag

SEQ ID NO: 16751 - DNA, 6822 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaagcaaggagaagcagatggccgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16752 - DNA, 6864 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagaacttccacaagtgcagacagcaccaggaggaggaggaggccagaagaagagaggagaagagactgagaagactggagaagaagagaagaagcaaggagaagcagatggccgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccgacagacagctgttcgacaccatcagcctgctgatccagggcagcctggagtgggagctgaagctgatggacgagctggccggccccggcggccagcccagcgccttccccagcgcccccagcctgggcggcagcgacccccagatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16753 - DNA, 6720 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagaacttccacaagtgcagacagcaccaggaggaggaggaggccagaagaagagaggagaagagactgagaagactggagaagaagagaagaagcaaggagaagcagatggccgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16754 - DNA, 6876 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaagcaaggagaagcagatggccgacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16755 - DNA, 6780 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16756 - DNA, 6684 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgagggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagaacttccacaagtgcagacagcaccaggaggaggaggaggccagaagaagagaggagaagagactgagaagactggagaagaagagaagaaacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16757 - DNA, 6855 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaacctgatgctggacgacgtgatcgccagcggcagcagcgccagcgccgccagcgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16758 - DNA, 6945 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaaaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccgacagacagctgttcgacaccatcagcctgctgatccagggcagcctggagtgggagctgaagctgatggacgagctggccggccccggcggccagcccagcgccttccccagcgcccccagcctgggcggcagcgacccccagatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16759 - DNA, 6966 bp, Artificial Sequence
  Description of Artificial Sequence: Synthetic coding sequence
atggacgaggaggaggacggcgccggcgccgaggagagcggccagcccagaagcttcatgagactgaacgacctgagcggcgccggcggcagacccggccccggcagcgccgagaaggaccccggcagcgccgacagcgaggccgagggcctgccctaccccgccctggcccccgtggtgttcttctacctgagccaggacagcagacccagaagctggtgcctgagaaccgtgtgcaacccctggttcgagagaatcagcatgctggtgatcctgctgaactgcgtgaccctgggcatgttcagaccctgcgaggacatcgcctgcgacagccagagatgcagaatcctgcaggccttcgacgacttcatcttcgccttcttcgccgtggagatggtggtgaagatggtggccctgggcatcttcggcaagaagtgctacctgggcgacacctggaacagactggacttcttcatcgtgatcgccggcatgctggagtacagcctggacctgcagaacgtgagcttcagcgccgtgagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctgcccgagaacttcagcctgcccctgagcgtggacctggagagatactaccagaccgagaacgaggacgagagccccttcatctgcagccagcccagagagaacggcatgagaagctgcagaagcgtgcccaccctgagaggcgacggcggcggcggccccccctgcggcctggactacgaggcctacaacagcagcagcaacaccacctgcgtgaactggaaccagtactacaccaactgcagcgccggcgagcacaaccccttcaagggcgccatcaacttcgacaacatcggctacgcctggatcgccatcttccaggtgatcaccctggagggctgggtggacatcatgtacttcgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagtgagattcctgagcaacgccagcaccctggccagcttcagcgagcccggcagctgctacgaggagctgctgaagtacctggtgtacatcctgagaaaggccgccagaagactggcccaggtgagcagagccgccggcgtgagagtgggcctgctgagcagccccgcccccctgggcggccaggagacccagcccagcagcagctgcagcagaagccacagaagactgagcgtgcaccacctggtgcaccaccaccaccaccaccaccaccactaccacctgggcaacggcaccctgagagcccccagagccagccccgagatccaggacagagacgccaacggcagcagaagactgatgctgcccccccccagcacccccgccctgagcggcgccccccccggcggcgccgagagcgtgcacagcttctaccacgccgactgccacctggagcccgtgagatgccaggcccccccccccagaagccccagcgaggccagcggcagaaccgtgggcagcggcaaggtgtaccccaccgtgcacaccagccccccccccgagaccctgaaggagaaggccctggtggaggtggccgccagcagcggcccccccaccctgaccagcctgaacatcccccccggcccctacagcagcatgcacaagctgctggagacccagagcaccggcgcctgccagagcagctgcaagatcagcagcccctgcctgaaggccgacagcggcgcctgcggccccgacagctgcccctactgcgccagagccggcgccggcgaggtggagctggccgacagagagatgcccgacagcgacagcgaggccgtgtacgagttcacccaggacgcccagcacagcgacctgagagacccccacagcagaagacagagaagcctgggccccgacgccgagcccagcagcgtgctggccttctggagactgatctgcgacaccttcagaaagatcgtggacagcaagtacttcggcagaggcatcatgatcgccatcctggtgaacaccctgagcatgggcatcgagtaccacgagcagcccgaggagctgaccaacgccctggagatcagcaacatcgtgttcaccagcctgttcgccctggagatgctgctgaagctgctggtgtacggccccttcggctacatcaagaacccctacaacatcttcgacggcgtgatcgtggtgatcagcgtgtgggagatcgtgggccagcagggcggcggcctgagcgtgctgagaaccttcagactgatgagagtgctgaagctggtgagattcctgcccgccctgcagagacagctggtggtgctgatgaagaccatggacaacgtggccaccttctgcatgctgctgatgctgttcatcttcatcttcagcatcctgggcatgcacctgttcggctgcaagttcgccagcgagagagacggcgacaccctgcccgacagaaagaacttcgacagcctgctgtgggccatcgtgaccgtgttccagatcctgacccaggaggactggaacaaggtgctgtacaacggcatggccagcaccagcagctgggccgccctgtacttcatcgccctgatgaccttcggcaactacgtgctgttcaacctgctggtggccatcctggtggagggcttccaggccgaggagatcagcaagagagaggacgccagcggccagctgagctgcatccagctgcccgtggacagccagggcggcgacgccaacaagagcgagagcgagcccgacttcttcagccccagcctggacggcgacggcgacagaaagaagtgcctggccctggtgagcctgggcgagcaccccgagctgagaaagagcctgctgccccccctgatcatccacaccgccgccacccccatgagcctgcccaagagcaccagcaccggcctgggcgaggccctgggccccgccagcagaagaaccagcagcagcggcagcgccgagcccggcgccgcccacgagatgaagagcccccccagcgccagaagcagcccccacagcccctggagcgccgccagcagctggaccagcagaagaagcagcagaaacagcctgggcagagcccccagcctgaagagaagaagccccagcggcgagagaagaagcctgctgagcggcgagggccaggagagccaggacgaggaggagagcagcgaggaggagagagccagccccgccggcagcgaccacagacacagaggcagcctggagagagaggccaagagcagcttcgacctgcccgacaccctgcaggtgcccggcctgcacagaaccgccagcggcagaggcagcgccagcgagcaccaggactgcaacggcaagagcgccagcggcagactggccagagccctgagacccgacgacccccccctggacggcgacgacgccgacgacgagggcaacctgagcaagggcgagagagtgagagcctggatcagagccagactgcccgcctgctgcctggagagagacagctggagcgcctacatcttccccccccagagcagattcagactgctgtgccacagaatcatcacccacaagatgttcgaccacgtggtgctggtgatcatcttcctgaactgcatcaccatcgccatggagagacccaagatcgacccccacagcgccgagagaatcttcctgaccctgagcaactacatcttcaccgccgtgttcctggccgagatgaccgtgaaggtggtggccctgggctggtgcttcggcgagcaggcctacctgagaagcagctggaacgtgctggacggcctgctggtgctgatcagcgtgatcgacatcctggtgagcatggtgagcgacagcggcaccaagatcctgggcatgctgagagtgctgagactgctgagaaccctgagacccctgagagtgatcagcagagcccagggcctgaagctggtggtggagaccctgatgagcagcctgaagcccatcggcaacatcgtggtgatctgctgcgccttcttcatcatcttcggcatcctgggcgtgcagctgttcaagggcaagttcttcgtgtgccagggcgaggacaccagaaacatcaccaacaagagcgactgcgccgaggccagctacagatgggtgagacacaagtacaacttcgacaacctgggccaggccctgatgagcctgttcgtgctggccagcaaggacggctgggtggacatcatgtacgacggcctggacgccgtgggcgtggaccagcagcccatcatgaaccacaacccctggatgctgctgtacttcatcagcttcctgctgatcgtggccttcttcgtgctgaacatgttcgtgggcgtggtggtggagaacttccacaagtgcagacagcaccaggaggaggaggaggccagaagaagagaggagaagagactgagaagactggagaagaagagaagaagcaaggagaagcagatggccgaggcccagtgcaagccctactacagcgactacagcagattcagactgctggtgcaccacctgtgcaccagccactacctggacctgttcatcaccggcgtgatcggcctgaacgtggtgaccatggccatggagcactaccagcagccccagatcctggacgaggccctgaagatctgcaactacatcttcaccgtgatcttcgtgctggagagcgtgttcaagctggtggccttcggcttcagaagattcttccaggacagatggaaccagctggacctggccatcgtgctgctgagcatcatgggcatcaccctggaggagatcgaggtgaacgccagcctgcccatcaaccccaccatcatcagaatcatgagagtgctgagaatcgccagagtgctgaagctgctgaagatggccgtgggcatgagagccctgctggacaccgtgatgcaggccctgccccaggtgggcaacctgggcctgctgttcatgctgctgttcttcatcttcgccgccctgggcgtggagctgttcggcgacctggagtgcgacgagacccacccctgcgagggcctgggcagacacgccaccttcagaaacttcggcatggccttcctgaccctgttcagagtgagcaccggcgacaactggaacggcatcatgaaggacaccctgagagactgcgaccaggagagcacctgctacaacaccgtgatcagccccatctacttcgtgagcttcgtgctgaccgcccagttcgtgctggtgaacgtggtgatcgccgtgctgatgaagcacctggaggagagcaacaaggaggccaaggaggaggccgagctggaggccgagctggagctggagatgaagaccctgagcccccagccccacagccccctgggcagccccttcctgtggcccggcgtggagggccccgacagccccgacagccccaagcccggcgccctgcaccccgccgcccacgccagaagcgccagccacttcagcctggagcaccccaccgacagacagctgttcgacaccatcagcctgctgatccagggcagcctggagtgggagctgaagctgatggacgagctggccggccccggcggccagcccagcgccttccccagcgcccccagcctgggcggcagcgacccccagatgcagccccaccccaccgagctgcccggccccgacctgctgaccgtgagaaagagcggcgtgagcagaacccacagcctgcccaacgacagctacatgtgcagacacggcagcaccgccgagggccccctgggccacagaggctggggcctgcccaaggcccagagcggcagcgtgctgagcgtgcacagccagcccgccgacaccagctacatcctgcagctgcccaaggacgccccccacctgctgcagccccacagcgcccccacctggggcaccatccccaagctgcccccccccggcagaagccccctggcccagagacccctgagaagacaggccgccatcagaaccgacagcctggacgtgcagggcctgggcagcagagaggacctgctggccgaggtgagcggccccagcccccccctggccagagcctacagcttctggggccagagcagcacccaggcccagcagcacagcagaagccacagcaagatcagcaagcacatgaccccccccgccccctgccccggccccgagcccaactggggcaagggcccccccgagaccagaagcagcctggagctggacaccgagctgagctggatcagcggcgacctgctgccccccggcggccaggaggagccccccagccccagagacctgaagaagtgctacagcgtggaggcccagagctgccagagaagacccaccagctggctggacgagcagagaagacacagcatcgccgtgagctgcctggacagcggcagccagccccacctgggcaccgaccccagcaacctgggcggccagcccctgggcggccccggcagcagacccaagaagaagctgagcccccccagcatcaccatcgacccccccgagagccagggccccagaaccccccccagccccggcatctgcctgagaagaagagcccccagcagcgacagcaaggaccccctggccagcggcccccccgacagcatggccgccagccccagccccaagaaggacgtgctgagcctgagcggcctgagcagcgaccccgccgacctggacccctag

SEQ ID NO: 16760 - DNA, 1035 bp, Artificial Sequence
  Description of Artificial Sequence: Synthetic coding sequence
atggacaagttcagaatgctgttccagcacttccagagcagcagcgagagcgtgatgaacggcatctgcctgctgctggccgccgtgaccgtgaagctgtacagcagcttcgacttcaactgcccctgcctggtgcactacaacgccctgtacggcctgggcctgctgctgaccccccccctggccctgttcctgtgcggcctgctggccaacagacagagcgtggtgatggtggaggagtggagaagacccgccggccacagaagaaaggaccccggcatcatcagatacatgtgcagcagcgtgctgcagagagccctggccgcccccctggtgtggatcctgctggccctgctggacggcaagtgcttcgtgtgcgccttcagcagcagcgtggaccccgagaagttcctggacttcgccaacatgacccccagccaggtgcagctgttcctggccaaggtgccctgcaaggaggacgagctggtgagagacagccccgccagaaaggccgtgagcagatacctgagatgcctgagccaggccatcggctggagcgtgaccctgctgctgatcatcgccgccttcctggccagatgcctgagaccctgcttcgaccagaccgtgttcctgcagagaagatactggagcaactacgtggacctggagcagaagctgttcgacgagacctgctgcgagcacgccagagacttcgcccacagatgcgtgctgcacttcttcgccagcatgagaagcgagctgcaggccagaggcctgagaagaggcaacgccggcagaagactggagctgcccgccgtgcccgagccccccgagggcctggacagcggcagcggcaaggcccacctgagagccatcagcagcagagagcaggtggacagactgctgagcacctggtacagcagcaagccccccctggacctggccgccagccccggcctgtgcggcggcggcctgagccacagagcccccaccctggccctgggcaccagactgagccagcacaccgacgtgtag

SEQ ID NO: 16761 - DNA, 1431 bp, Artificial Sequence
  Description of Artificial Sequence: Synthetic coding sequence
atgggcagaaaggaggaggacgactgcagcagctggaagaagcagaccaccaacatcagaaagaccttcatcttcatggaggtgctgggcagcggcgccttcagcgaggtgttcctggtgaagcagagactgaccggcaagctgttcgccctgaagtgcatcaagaagagccccgccttcagagacagcagcctggagaacgagatcgccgtgctgaagaagatcaagcacgagaacatcgtgaccctggaggacatctacgagagcaccacccactactacctggtgatgcagctggtgagcggcggcgagctgttcgacagaatcctggagagaggcgtgtacaccgagaaggacgccagcctggtgatccagcaggtgctgagcgccgtgaagtacctgcacgagaacggcatcgtgcacagagacctgaagcccgagaacctgctgtacctgacccccgaggagaacagcaagatcatgatcaccgacttcggcctgagcaagatggagcagaacggcatcatgagcaccgcctgcggcacccccggctacgtggcccccgaggtgctggcccagaagccctacagcaaggccgtggactgctggagcatcggcgtgatcacctacatcctgctgtgcggctacccccccttctacgaggagaccgagagcaagctgttcgagaagatcaaggagggctactacgagttcgagagccccttctgggacgacatcagcgagagcgccaaggacttcatctgccacctgctggagaaggaccccaacgagagatacacctgcgagaaggccctgagccacccctggatcgacggcaacaccgccctgcacagagacatctaccccagcgtgagcctgcagatccagaagaacttcgccaagagcaagtggagacaggccttcaacgccgccgccgtggtgcaccacatgagaaagctgcacatgaacctgcacagccccggcgtgagacccgaggtggagaacagaccccccgagacccaggccagcgagaccagcagacccagcagccccgagatcaccatcaccgaggcccccgtgctggaccacagcgtggccctgcccgccctgacccagctgccctgccagcacggcagaagacccaccgcccccggcggcagaagcctgaactgcctggtgaacggcagcctgcacatcagcagcagcctggtgcccatgcaccagggcagcctggccgccggcccctgcggctgctgcagcagctgcctgaacatcggcagcaagggcaagagcagctactgcagcgagcccaccctgctgaagaaggccaacaagaagcagaacttcaagagcgaggtgatggtgcccgtgaaggccagcggcagcagccactgcagagccggccagaccggcgtgtgcctgatcatgtag

SEQ ID NO: 16762 - DNA, 1431 bp, Artificial Sequence; identical to SEQ ID NO: 16761
  Description of Artificial Sequence: Synthetic coding sequence

SEQ ID NO: 16763 - DNA, 654 bp, Artificial Sequence
  Description of Artificial Sequence: Synthetic coding sequence
atggtgaagctgggctgcagcttcagcggcaagcccggcaaggaccccggcgaccaggacggcgccgccatggacagcgtgcccctgatcagccccctggacatcagccagctgcagccccccctgcccgaccaggtggtgatcaagacccagaccgagtaccagctgagcagccccgaccagcagaacttccccgacctggagggccagagactgaactgcagccaccccgaggagggcagaagactgcccaccgccagaatgatcgccttcgccatggccctgctgggctgcgtgctgatcatgtacaaggccatctggtacgaccagttcacctgccccgacggcttcctgctgagacacaagatctgcacccccctgaccctggagatgtactacaccgagatggaccccgagagacacagaagcatcctggccgccatcggcgcctaccccctgagcagaaagcacggcaccgagacccccgccgcctggggcgacggctacagagccgccaaggaggagagaaagggccccacccaggccggcgccgccgccgccgccaccgagccccccggcaagcccagcgccaaggccgagaaggaggccgccagaaaggccgccggcagcgccgcccccccccccgcccagtag

SEQ ID NO: 16764 - DNA, 477 bp, Artificial Sequence
  Description of Artificial Sequence: Synthetic coding sequence
atggtgaagctgggctgcagcttcagcggcaagcccggcaaggaccccggcgaccaggacggcgccgccatggacagcgtgcccctgatcagccccctggacatcagccagctgcagccccccctgcccgaccaggtggtgatcaagacccagaccgagtaccagctgagcagccccgaccagcagaacttccccgacctggagggccagagactgaactgcagccaccccgaggagggcagaagagtgaccacccccaccccccccaccgtgggcacccaggacagaagaagaagatggaaggccgccggcggcgcctgggtgcccagcagacccgtgtggggccccctggccctgagagaggagagagtggccgtgagccaccccgcccagagctggccccacagactgccctgcacccaccaggcccccagcagaggctgcagatgcagactgaccaagcagtggagaagctag

SEQ ID NO: 16765 - DNA, 375 bp, Artificial Sequence
  Description of Artificial Sequence: Synthetic coding sequence
atggtgaagctgggctgcagcttcagcggcaagcccggcaaggaccccggcgaccaggacggcgccgccatggacagcgtgcccctgatcagccccctggacatcagccagctgcagccccccctgcccgaccaggtggtgatcaagacccagaccgagtaccagctgagcagccccgaccagcagaacttccccgacctggagggccagagactgaactgcagccaccccgaggagggcagaagactgcccaccgccagaatgatcgccttcgccatggccctgctgggctgcgtgctgatcatgtacaaggccatctggtacgaccagttcacctgccccgacggcttcctgctgagaggccccgagttctag

SEQ ID NO: 16766 - DNA, 375 bp, Artificial Sequence; identical to SEQ ID NO: 16765
  Description of Artificial Sequence: Synthetic coding sequence

SEQ ID NO: 16767 - DNA, 1833 bp, Artificial Sequence
  Description of Artificial Sequence: Synthetic coding sequence
atgcacttccaggccttctggctgtgcctgggcctgctgttcatcagcatcaacgccgagttcatggacgacgacgtggagaccgaggacttcgaggagaacagcgaggagatcgacgtgaacgagagcgagctgagcagcgagatcaagtacaagaccccccagcccatcggcgaggtgtacttcgccgagaccttcgacagcggcagactggccggctgggtgctgagcaaggccaagaaggacgacatggacgaggagatcagcatctacgacggcagatgggagatcgaggagctgaaggagaaccaggtgcccggcgacagaggcctggtgctgaagagcagagccaagcaccacgccatcagcgccgtgctggccaagcccttcatcttcgccgacaagcccctgatcgtgcagtacgaggtgaacttccaggacggcatcgactgcggcggcgcctacatcaagctgctggccgacaccgacgacctgatcctggagaacttctacgacaagaccagctacatcatcatgttcggccccgacaagtgcggcgaggactacaagctgcacttcatcttcagacacaagcaccccaagaccggcgtgttcgaggagaagcacgccaagccccccgacgtggacctgaagaagttcttcaccgacagaaagacccacctgtacaccctggtgatgaaccccgacgacaccttcgaggtgctggtggaccagaccgtggtgaacaagggcagcctgctggaggacgtggtgccccccatcaagccccccaaggagatcgaggaccccaacgacaagaagcccgaggagtgggacgagagagccaagatccccgaccccagcgccgtgaagcccgaggactgggacgagagcgagcccgcccagatcgaggacagcagcgtggtgaagcccgccggctggctggacgacgagcccaagttcatccccgaccccaacgccgagaagcccgacgactggaacgaggacaccgacggcgagtgggaggccccccagatcctgaaccccgcctgcagaatcggctgcggcgagtggaagccccccatgatcgacaaccccaagtacaagggcgtgtggagaccccccctggtggacaaccccaactaccagggcatctggagccccagaaagatccccaaccccgactacttcgaggacgaccaccccttcctgctgaccagcttcagcgccctgggcctggagctgtggagcatgaccagcgacatctacttcgacaacttcatcatctgcagcgagaaggaggtggccgaccactgggccgccgacggctggagatggaagatcatgatcgccaacgccaacaagcccggcgtgctgaagcagctgatggccgccgccgagggccacccctggctgtggctgatctacctggtgaccgccggcgtgcccatcgccctgatcaccagcttctgctggcccagaaaggtgaagaagaagcacaaggacaccgagtacaagaagaccgacatctgcatcccccagaccaagggcgtgctggagcaggaggagaaggaggagaaggccgccctggagaagcccatggacctggaggaggagaagaagcagaacgacggcgagatgctggagaaggaggaggagagcgagcccgaggagaagagcgaggaggagatcgagatcatcgagggccaggaggagagcaaccagagcaacaagagcggcagcgaggacgagatgaaggaggccgacgagagcaccggcagcggcgacggccccatcaagagcgtgagaaagagaagagtgagaaaggactag

SEQ ID NO: 16768 - DNA, 1833 bp, Artificial Sequence; identical to SEQ ID NO: 16767
  Description of Artificial Sequence: Synthetic coding sequence

SEQ ID NO: 16769 - DNA, 540 bp, Artificial Sequence
  Description of Artificial Sequence: Synthetic coding sequence
atgcacttccaggccttctggctgtgcctgggcctgctgttcatcagcatcaacgccgagttcatggacgacgacgtggagaccgaggacttcgaggagaacagcgaggagatcgacgtgaacgagagcgagctgagcagcgagatcaagtacaagaccccccagcccatcggcgaggtgtacttcgccgagaccttcgacagcggcagactggccggctgggtgctgagcaaggccaagaaggacgacatggacgaggagatcagcatctacgacggcagatgggagatcgaggagctgaaggagaaccaggtgcccggcgacagaggcctggtgctgaagagcagagccaagcaccacgccatcagcgccgtgctggccaagcccttcatcttcgccgacaagcccctgatcgtgcagtacgaggtgaacttccaggacggcatcgactgcggcggcgcctacatcaagctgctggccgacaccgacgacctgatcctggagaacttctacgacaagaccagctacatcatcatgtag

SEQ ID NO: 16770 - DNA, 1833 bp, Artificial Sequence; identical to SEQ ID NO: 16767
  Description of Artificial Sequence: Synthetic coding sequence

SEQ ID NO: 16771 - DNA, 1584 bp, Artificial Sequence
  Description of Artificial Sequence: Synthetic coding sequence
atggacgaggagatcagcatctacgacggcagatgggagatcgaggagctgaaggagaaccaggtgcccggcgacagaggcctggtgctgaagagcagagccaagcaccacgccatcagcgccgtgctggccaagcccttcatcttcgccgacaagcccctgatcgtgcagtacgaggtgaacttccaggacggcatcgactgcggcggcgcctacatcaagctgctggccgacaccgacgacctgatcctggagaacttctacgacaagaccagctacatcatcatgttcggccccgacaagtgcggcgaggactacaagctgcacttcatcttcagacacaagcaccccaagaccggcgtgttcgaggagaagcacgccaagccccccgacgtggacctgaagaagttcttcaccgacagaaagacccacctgtacaccctggtgatgaaccccgacgacaccttcgaggtgctggtggaccagaccgtggtgaacaagggcagcctgctggaggacgtggtgccccccatcaagccccccaaggagatcgaggaccccaacgacaagaagcccgaggagtgggacgagagagccaagatccccgaccccagcgccgtgaagcccgaggactgggacgagagcgagcccgcccagatcgaggacagcagcgtggtgaagcccgccggctggctggacgacgagcccaagttcatccccgaccccaacgccgagaagcccgacgactggaacgaggacaccgacggcgagtgggaggccccccagatcctgaaccccgcctgcagaatcggctgcggcgagtggaagccccccatgatcgacaaccccaagtacaagggcgtgtggagaccccccctggtggacaaccccaactaccagggcatctggagccccagaaagatccccaaccccgactacttcgaggacgaccaccccttcctgctgaccagcttcagcgccctgggcctggagctgtggagcatgaccagcgacatctacttcgacaacttcatcatctgcagcgagaaggaggtggccgaccactgggccgccgacggctggagatggaagatcatgatcgccaacgccaacaagcccggcgtgctgaagcagctgatggccgccgccgagggccacccctggctgtggctgatctacctggtgaccgccggcgtgcccatcgccctgatcaccagcttctgctggcccagaaaggtgaagaagaagcacaaggacaccgagtacaagaagaccgacatctgcatcccccagaccaagggcgtgctggagcaggaggagaaggaggagaaggccgccctggagaagcccatggacctggaggaggagaagaagcagaacgacggcgagatgctggagaaggaggaggagagcgagcccgaggagaagagcgaggaggagatcgagatcatcgagggccaggaggagagcaaccagagcaacaagagcggcagcgaggacgagatgaaggaggccgacgagagcaccggcagcggcgacggccccatcaagagcgtgagaaagagaagagtgagaaaggactag

SEQ ID NO: 16772 - DNA, 3750 bp, Artificial Sequence
  Description of Artificial Sequence: Synthetic coding sequence
atggtggaggccgccccccccggccccggccccctgagaagaaccttcctggtgcccgagatcaagagcctggaccagtacgacttcagcagagccaaggccgccgccagcctggcctgggtgctgagagccgccttcggcggcgccgagcacgtgccccccgagctgtgggagcccttctacaccgaccagtacgcccaggagcacgtgaagccccccgtgaccagactgctgctgagcgccgagctgtactgcagagcctggagacaggccctgccccagctggagaccccccccaaccccagcgccctgctggccctgctggccagaagaggcaccgtgcccgccctgcccgagagacccgtgagagaggccgacctgagacaccagcccatcctgatgggcgcccacctggccgtgatcgacgccctgatggccgccttcgccttcgagtggaccaagaccctgcccggccccctggccctgaccagcctggagcacaagctgctgttctgggtggacaccaccgtgagaagactgcaggagaagaccgagcaggaggccgcccagagagccagccccgccgcccccgccgacggcgccgcccccgcccagcccagcatcagatacagaaaggacagagtggtggccagaagagccccctgcttccccaccgtgaccagcctgcaggacctggccagcggcgccgccctggccgccaccatccactgctactgcccccagctgctgagactggaggaggtgtgcctgaaggaccccatgagcgtggccgacagcctgtacaacctgcagctggtgcaggacttctgcgccagcagactgcccagaggctgccccctgagcctggaggacctgctgtacgtgcccccccccctgaaggtgaacctggtggtgatgctggccgagctgttcatgtgcttcgaggtgctgaagcccgacttcgtgcaggtgaaggacctgcccgacggccacgccgccagccccagaggcaccgaggccagccccccccagaacaacagcggcagcagcagccccgtgttcaccttcagacaccccctgctgagcagcggcggcccccagagccccctgagaggcagcaccggcagcctgaagagcagccccagcatgagccacatggaggccctgggcaaggcctggaacagacagctgagcagacccctgagccaggccgtgagcttcagcacccccttcggcctggacagcgacgtggacgtggtgatgggcgaccccgtgctgctgagaagcgtgagcagcgacagcctgggcccccccagacccgcccccgccagaacccccacccagcccccccccgagcccggcgacctgcccaccatcgaggaggccctgcagatcatccacagcgccgagcccagactgctgcccgacggcgccgccgacggcagcttctacctgcacagccccgagggccccagcaagcccagcctggccagcccctacctgcccgagggcaccagcaagcccctgagcgacagacccaccaaggcccccgtgtacatgccccaccccgagacccccagcaagcccagcccctgcctggtgggcgaggccagcaagccccccgcccccagcgagggcagccccaaggccgtggccagcagccccgccgccaccaacagcgaggtgaagatgaccagcttcgccgagagaaagaagcagctggtgaaggccgaggccgaggccggcgccggcagccccaccagcacccccgccccccccgaggccctgagcagcgagatgagcgagctgagcgccagactggaggagaagagaagagccatcgaggcccagaagagaagaatcgaggccatcttcgccaagcacagacagagactgggcaagagcgccttcctgcaggtgcagcccagagaggccagcggcgaggccgaggccgaggccgaggaggccgacagcggccccgtgcccggcggcgagagacccgccggcgagggccagggcgagcccaccagcagacccaaggccgtgaccttcagccccgacctgggccccgtgccccacgagggcctgggcgagtacaacagagccgtgagcaagctgagcgccgccctgagcagcctgcagagagacatgcagagactgaccgaccagcagcagagactgctggccccccccgaggcccccggcagcgcccccccccccgccgcctgggtgatccccggccccaccaccggccccaaggccgccagccccagccccgccagaagagtgcccgccaccagaagaagccccggccccggccccagccagagccccagaagccccaagcacaccagacccgccgagctgagactggcccccctgaccagagtgctgacccccccccacgacgtggacagcctgccccacctgagaaagttcagccccagccaggtgcccgtgcagaccagaagcagcatcctgctggccgaggagaccccccccgaggagcccgccgccagacccggcctgatcgagatccccctgggcagcctggccgaccccgccgccgaggacgagggcgacggcagccccgccggcgccgaggacagcctggaggaggaggccagcagcgagggcgagcccagagtgggcctgggcttcttctacaaggacgaggacaagcccgaggacgagatggcccagaagagagccagcctgctggagagacagcagagaagagccgaggaggccagaagaagaaagcagtggcaggaggtggagaaggagcagagaagagaggaggccgccagactggcccaggaggaggcccccggccccgcccccctggtgagcgccgtgcccatggccacccccgcccccgccgccagagcccccgccgaggaggaggtgggccccagaaagggcgacttcaccagacaggagtacgagagaagagcccagctgaagctgatggacgacctggacaaggtgctgagacccagagccgccggcagcggcggccccggcagaggcggcagaagagccaccagacccagaagcggctgctgcgacgacagcgccctggccagaagccccgccagaggcctgctgggcagcagactgagcaagatctacagccagagcaccctgagcctgagcaccgtggccaacgaggcccacaacaacctgggcgtgaagagacccaccagcagagcccccagccccagcggcctgatgagccccagcagactgcccggcagcagagagagagactgggagaacggcagcaacgccagcagccccgccagcgtgcccgagtacaccggccccagactgtacaaggagcccagcgccaagagcaacaagttcatcatccacaacgccctgagccactgctgcctggccggcaaggtgaacgagccccagaagaacagaatcctggaggagatcgagaagagcaaggccaaccacttcctgatcctgttcagagacagcagctgccagttcagagccctgtacaccctgagcggcgagaccgaggagctgagcagactggccggctacggccccagaaccgtgacccccgccatggtggagggcatctacaagtacaacagcgacagaaagagattcacccagatccccgccaagaccatgagcatgagcgtggacgccttcaccatccagggccacctgtggcagggcaagaagcccaccacccccaagaagggcggcggcacccccaagtag

SEQ ID NO: 16773 - DNA, 3831 bp, Artificial Sequence
  Description of Artificial Sequence: Synthetic coding sequence
atggtggaggccgccccccccggccccggccccctgagaagaaccttcctggtgcccgagatcaagagcctggaccagtacgacttcagcagagccaaggccgccgccagcctggcctgggtgctgagagccgccttcggcggcgccgagcacgtgccccccgagctgtgggagcccttctacaccgaccagtacgcccaggagcacgtgaagccccccgtgaccagactgctgctgagcgccgagctgtactgcagagcctggagacaggccctgccccagctggagaccccccccaaccccagcgccctgctggccctgctggccagaagaggcaccgtgcccgccctgcccgagagacccgtgagagaggccgacctgagacaccagcccatcctgatgggcgcccacctggccgtgatcgacgccctgatggccgccttcgccttcgagtggaccaagaccctgcccggccccctggccctgaccagcctggagcacaagctgctgttctgggtggacaccaccgtgagaagactgcaggagaagaccgagcaggaggccgcccagagagccagccccgccgcccccgccgacggcgccgcccccgcccagcccagctgccccaccagatggtactggaagctggtgccccacgccatcgccttctgcctgaaggagagcggcagcaagccccccatgatcagatacagaaaggacagagtggtggccagaagagccccctgcttccccaccgtgaccagcctgcaggacctggccagcggcgccgccctggccgccaccatccactgctactgcccccagctgctgagactggaggaggtgtgcctgaaggaccccatgagcgtggccgacagcctgtacaacctgcagctggtgcaggacttctgcgccagcagactgcccagaggctgccccctgagcctggaggacctgctgtacgtgcccccccccctgaaggtgaacctggtggtgatgctggccgagctgttcatgtgcttcgaggtgctgaagcccgacttcgtgcaggtgaaggacctgcccgacggccacgccgccagccccagaggcaccgaggccagccccccccagaacaacagcggcagcagcagccccgtgttcaccttcagacaccccctgctgagcagcggcggcccccagagccccctgagaggcagcaccggcagcctgaagagcagccccagcatgagccacatggaggccctgggcaaggcctggaacagacagctgagcagacccctgagccaggccgtgagcttcagcacccccttcggcctggacagcgacgtggacgtggtgatgggcgaccccgtgctgctgagaagcgtgagcagcgacagcctgggcccccccagacccgcccccgccagaacccccacccagcccccccccgagcccggcgacctgcccaccatcgaggaggccctgcagatcatccacagcgccgagcccagactgctgcccgacggcgccgccgacggcagcttctacctgcacagccccgagggccccagcaagcccagcctggccagcccctacctgcccgagggcaccagcaagcccctgagcgacagacccaccaaggcccccgtgtacatgccccaccccgagacccccagcaagcccagcccctgcctggtgggcgaggccagcaagccccccgcccccagcgagggcagccccaaggccgtggccagcagccccgccgccaccaacagcgaggtgaagatgaccagcttcgccgagagaaagaagcagctggtgaaggccgaggccgaggccggcgccggcagccccaccagcacccccgccccccccgaggccctgagcagcgagatgagcgagctgagcgccagactggaggagaagagaagagccatcgaggcccagaagagaagaatcgaggccatcttcgccaagcacagacagagactgggcaagagcgccttcctgcaggtgcagcccagagaggccagcggcgaggccgaggccgaggccgaggaggccgacagcggccccgtgcccggcggcgagagacccgccggcgagggccagggcgagcccaccagcagacccaaggccgtgaccttcagccccgacctgggccccgtgccccacgagggcctgggcgagtacaacagagccgtgagcaagctgagcgccgccctgagcagcctgcagagagacatgcagagactgaccgaccagcagcagagactgctggccccccccgaggcccccggcagcgcccccccccccgccgcctgggtgatccccggccccaccaccggccccaaggccgccagccccagccccgccagaagagtgcccgccaccagaagaagccccggccccggccccagccagagccccagaagccccaagcacaccagacccgccgagctgagactggcccccctgaccagagtgctgacccccccccacgacgtggacagcctgccccacctgagaaagttcagccccagccaggtgcccgtgcagaccagaagcagcatcctgctggccgaggagaccccccccgaggagcccgccgccagacccggcctgatcgagatccccctgggcagcctggccgaccccgccgccgaggacgagggcgacggcagccccgccggcgccgaggacagcctggaggaggaggccagcagcgagggcgagcccagagtgggcctgggcttcttctacaaggacgaggacaagcccgaggacgagatggcccagaagagagccagcctgctggagagacagcagagaagagccgaggaggccagaagaagaaagcagtggcaggaggtggagaaggagcagagaagagaggaggccgccagactggcccaggaggaggcccccggccccgcccccctggtgagcgccgtgcccatggccacccccgcccccgccgccagagcccccgccgaggaggaggtgggccccagaaagggcgacttcaccagacaggagtacgagagaagagcccagctgaagctgatggacgacctggacaaggtgctgagacccagagccgccggcagcggcggccccggcagaggcggcagaagagccaccagacccagaagcggctgctgcgacgacagcgccctggccagaagccccgccagaggcctgctgggcagcagactgagcaagatctacagccagagcaccctgagcctgagcaccgtggccaacgaggcccacaacaacctgggcgtgaagagacccaccagcagagcccccagccccagcggcctgatgagccccagcagactgcccggcagcagagagagagactgggagaacggcagcaacgccagcagccccgccagcgtgcccgagtacaccggccccagactgtacaaggagcccagcgccaagagcaacaagttcatcatccacaacgccctgagccactgctgcctggccggcaaggtgaacgagccccagaagaacagaatcctggaggagatcgagaagagcaaggccaaccacttcctgatcctgttcagagacagcagctgccagttcagagccctgtacaccctgagcggcgagaccgaggagctgagcagactggccggctacggccccagaaccgtgacccccgccatggtggagggcatctacaagtacaacagcgacagaaagagattcacccagatccccgccaagaccatgagcatgagcgtggacgccttcaccatccagggccacctgtggcagggcaagaagcccaccacccccaagaagggcggcggcacccccaagtag

SEQ ID NO: 16774 - DNA, 660 bp, Artificial Sequence
  Description of Artificial Sequence: Synthetic coding sequence
atgcccttccaccacgtgaccgccggcctgctgtacaagggcaactacctgaacagaagcctgagcgccggcagcgacagcgagcagctggccaacatcagcgtggaggagctggacgagatcagagaggccttcagagtgctggacagagacggcaacggcttcatcagcaagcaggagctgggcatggccatgagaagcctgggctacatgcccagcgaggtggagctggccatcatcatgcagagactggacatggacggcgacggccaggtggacttcgacgagttcatgaccatcctgggccccaagctggtgagcagcgagggcagagacggcttcctgggcaacaccatcgacagcatcttctggcagttcgacatgcagagaatcaccctggaggagctgaagcacatcctgtaccacgccttcagagaccacctgaccatgaaggacatcgagaacatcatcatcaacgaggaggagagcctgaacgagaccagcggcaactgccagaccgagttcgagggcgtgcacagccagaagcagaacagacagacctgcgtgagaaagagcctgatctgcgccttcgccatggccttcatcatcagcgtgatgctgatcgccgccaaccagatcctgagaagcggcatggagtag

SEQ ID NO: 16775 - DNA, 786 bp, Artificial Sequence
  Description of Artificial Sequence: Synthetic coding sequence
atgagactgcccgagcagcccggcgagggcaagcccgagaacgagaagaagggcgacggcggcgccctgggcggcggcgaggagccccccagaagccaggcccccgacttccccacctgggagaagatgcccttccaccacgtgaccgccggcctgctgtacaagggcaactacctgaacagaagcctgagcgccggcagcgacagcgagcagctggccaacatcagcgtggaggagctggacgagatcagagaggccttcagagtgctggacagagacggcaacggcttcatcagcaagcaggagctgggcatggccatgagaagcctgggctacatgcccagcgaggtggagctggccatcatcatgcagagactggacatggacggcgacggccaggtggacttcgacgagttcatgaccatcctgggccccaagctggtgagcagcgagggcagagacggcttcctgggcaacaccatcgacagcatcttctggcagttcgacatgcagagaatcaccctggaggagctgaagcacatcctgtaccacgccttcagagaccacctgaccatgaaggacatcgagaacatcatcatcaacgaggaggagagcctgaacgagaccagcggcaactgccagaccgagttcgagggcgtgcacagccagaagcagaacagacagacctgcgtgagaaagagcctgatctgcgccttcgccatggccttcatcatcagcgtgatgctgatcgccgccaaccagatcctgagaagcggcatggagtag

SEQ ID NO: 16776 - DNA, 660 bp, Artificial Sequence; identical to SEQ ID NO: 16774
  Description of Artificial Sequence: Synthetic coding sequence

SEQ ID NO: 16777 - DNA, 660 bp, Artificial Sequence; identical to SEQ ID NO: 16774
  Description of Artificial Sequence: Synthetic coding sequence

SEQ ID NO: 16778 - DNA, 786 bp, Artificial Sequence; identical to SEQ ID NO: 16775
  Description of Artificial Sequence: Synthetic coding sequence

SEQ ID NO: 16779 - DNA, 660 bp, Artificial Sequence; identical to SEQ ID NO: 16774
  Description of Artificial Sequence: Synthetic coding sequence

SEQ ID NO: 16780 - DNA, 378 bp, Artificial Sequence
  Description of Artificial Sequence: Synthetic coding sequence
atgcccttccaccacgtgaccgccggcctgctgtacaagggcaactacctgaacagaagcctgagcgccggcagcgacagcgagcagctggccaacatcagcgtggaggagctggacgagatcagagaggccttcagagtgctggacagagacggcaacggcttcatcagcaagcaggagctgggcatggccatgagaagcctgggctacatgcccagcgaggtggagctggccatcatcatgcagagactggacatggacggcgacggccaggtggacttcgacgagttcatgaccatcctgggccccaagctggtgagcagcgagggcagagacggcttcctgggcaacaccatcgacagcatcttctggcagtag

SEQ ID NO: 16781 - DNA, 747 bp, Artificial Sequence
  Description of Artificial Sequence: Synthetic coding sequence
atgttcctggccaaggccctgctggagggcgccgacagaggcctgggcgaggccctgggcggcctgttcggcggcggcggccagagaagagagggcggcggcagaaacatcggcggcatcgtgggcggcatcgtgaacttcatcagcgaggccgccgccgcccagtacacccccgagcccccccccacccagcagcacttcaccagcgtggaggccagcgagagcgaggaggtgagaagattcagacagcagttcacccagctggccggccccgacatggaggtgggcgccaccgacctgatgaacatcctgaacaaggtgctgagcaagcacaaggacctgaagaccgacggcttcagcctggacacctgcagaagcatcgtgagcgtgatggacagcgacaccaccggcaagctgggcttcgaggagttcaagtacctgtggaacaacatcaagaagtggcagtgcgtgtacaagcagtacgacagagaccacagcggcagcctgggcagcagccagctgagaggcgccctgcaggccgccggcttccagctgaacgagcagctgtaccagatgatcgtgagaagatacgccaacgaggacggcgacatggacttcaacaacttcatcagctgcctggtgagactggacgccatgttcagagccttcaagagcctggacagagacagagacggcctgatccaggtgagcatcaaggagtggctgcagctgaccatgtacagctag

SEQ ID NO: 16782 - DNA, 2868 bp, Artificial Sequence
  Description of Artificial Sequence: Synthetic coding sequence
atgctgcccggcagactgtgctgggtgcccctgctgctggccctgggcgtgggcagcggcagcggcggcggcggcgacagcagacagagaagactgctggccgccaaggtgaacaagcacaagccctggatcgagaccagctaccacggcgtgatcaccgagaacaacgacaccgtgatcctggacccccccctggtggccctggacaaggacgcccccgtgcccttcgccggcgagatctgcgccttcaagatccacggccaggagctgcccttcgaggccgtggtgctgaacaagaccagcggcgagggcagactgagagccaagagccccatcgactgcgagctgcagaaggagtacaccttcatcatccaggcctacgactgcggcgccggcccccacgagaccgcctggaagaagagccacaaggccgtggtgcacatccaggtgaaggacgtgaacgagttcgcccccaccttcaaggagcccgcctacaaggccgtggtgaccgagggcaagatctacgacagcatcctgcaggtggaggccatcgacgaggactgcagcccccagtacagccagatctgcaactacgagatcgtgaccaccgacgtgcccttcgccatcgacagaaacggcaacatcagaaacaccgagaagctgagctacgacaagcagcaccagtacgagatcctggtgaccgcctacgactgcggccagaagcccgccgcccaggacaccctggtgcaggtggacgtgaagcccgtgtgcaagcccggctggcaggactggaccaagagaatcgagtaccagcccggcagcggcagcatgcccctgttccccagcatccacctggagacctgcgacggcgccgtgagcagcctgcagatcgtgaccgagctgcagaccaactacatcggcaagggctgcgacagagagacctacagcgagaagagcctgcagaagctgtgcggcgccagcagcggcatcatcgacctgctgcccagccccagcgccgccaccaactggaccgccggcctgctggtggacagcagcgagatgatcttcaagttcgacggcagacagggcgccaaggtgcccgacggcatcgtgcccaagaacctgaccgaccagttcaccatcaccatgtggatgaagcacggccccagccccggcgtgagagccgagaaggagaccatcctgtgcaacagcgacaagaccgagatgaacagacaccactacgccctgtacgtgcacaactgcagactggtgttcctgctgagaaaggacttcgaccaggccgacaccttcagacccgccgagttccactggaagctggaccagatctgcgacaaggagtggcactactacgtgatcaacgtggagttccccgtggtgaccctgtacatggacggcgccacctacgagccctacctggtgaccaacgactggcccatccaccccagccacatcgccatgcagctgaccgtgggcgcctgctggcagggcggcgaggtgaccaagccccagttcgcccagttcttccacggcagcctggccagcctgaccatcagacccggcaagatggagagccagaaggtgatcagctgcctgcaggcctgcaaggagggcctggacatcaacagcctggagagcctgggccagggcatcaagtaccacttcaaccccagccagagcatcctggtgatggagggcgacgacatcggcaacatcaacagagccctgcagaaggtgagctacatcaacagcagacagttccccaccgccggcgtgagaagactgaaggtgagcagcaaggtgcagtgcttcggcgaggacgtgtgcatcagcatccccgaggtggacgcctacgtgatggtgctgcaggccatcgagcccagaatcaccctgagaggcaccgaccacttctggagacccgccgcccagttcgagagcgccagaggcgtgaccctgttccccgacatcaagatcgtgagcaccttcgccaagaccgaggcccccggcgacgtgaagaccaccgaccccaagagcgaggtgctggaggagatgctgcacaacctggacttctgcgacatcctggtgatcggcggcgacctggaccccagacaggagtgcctggagctgaaccacagcgagctgcaccagagacacctggacgccaccaacagcaccgccggctacagcatctacggcgtgggcagcatgagcagatacgagcaggtgctgcaccacatcagatacagaaactggagacccgccagcctggaggccagaagattcagaatcaagtgcagcgagctgaacggcagatacaccagcaacgagttcaacctggaggtgagcatcctgcacgaggaccaggtgagcgacaaggagcacgtgaaccacctgatcgtgcagccccccttcctgcagagcgtgcaccaccccgagagcagaagcagcatccagcacagcagcgtggtgcccagcatcgccaccgtggtgatcatcatcagcgtgtgcatgctggtgttcgtggtggccatgggcgtgtacagagtgagaatcgcccaccagcacttcatccaggagaccgaggccgccaaggagagcgagatggactgggacgacagcgccctgaccatcaccgtgaaccccatggagaagcacgagggccccggccacggcgaggacgagaccgagggcgaggaggaggaggaggccgaggaggagatgagcagcagcagcggcagcgacgacagcgaggaggaggaggaggaggagggcatgggcagaggcagacacggccagaacggcgccagacaggcccagctggagtgggacgacagcaccctgccctactag

SEQ ID NO: 16783 - DNA, 2871 bp, Artificial Sequence
  Description of Artificial Sequence: Synthetic coding sequence
atgaccctgctgctgctgcccctgctgctggccagcctgctggccagctgcagctgcaacaaggccaacaagcacaagccctggatcgaggccgagtaccagggcatcgtgatggagaacgacaacaccgtgctgctgaacccccccctgttcgccctggacaaggacgcccccctgagatacgccggcgagatctgcggcttcagactgcacggcagcggcgtgcccttcgaggccgtgatcctggacaaggccaccggcgagggcctgatcagagccaaggagcccgtggactgcgaggcccagaaggagcacaccttcaccatccaggcctacgactgcggcgagggccccgacggcgccaacaccaagaagagccacaaggccaccgtgcacgtgagagtgaacgacgtgaacgagttcgcccccgtgttcgtggagagactgtacagagccgccgtgaccgagggcaagctgtacgacagaatcctgagagtggaggccatcgacggcgactgcagcccccagtacagccagatctgctactacgagatcctgacccccaacacccccttcctgatcgacaacgacggcaacatcgagaacaccgagaagctgcagtacagcggcgagagactgtacaagttcaccgtgaccgcctacgactgcggcaagaagagagccgccgacgacgccgaggtggagatccaggtgaagcccacctgcaagcccagctggcagggctggaacaagagaatcgagtacgcccccggcgccggcagcctggccctgttccccggcatcagactggagacctgcgacgagcccctgtggaacatccaggccaccatcgagctgcagaccagccacgtggccaagggctgcgacagagacaactacagcgagagagccctgagaaagctgtgcggcgccgccaccggcgaggtggacctgctgcccatgcccggccccaacgccaactggaccgccggcctgagcgtgcactacagccaggacagcagcctgatctactggttcaacggcacccaggccgtgcaggtgcccctgggcggccccagcggcctgggcagcggcccccaggacagcctgagcgaccacttcaccctgagcttctggatgaagcacggcgtgacccccaacaagggcaagaaggaggaggagaccatcgtgtgcaacaccgtgcagaacgaggacggcttcagccactacagcctgaccgtgcacggctgcagaatcgccttcctgtactggcccctgctggagagcgccagacccgtgaagttcctgtggaagctggagcaggtgtgcgacgacgagtggcaccactacgccctgaacctggagttccccaccgtgaccctgtacaccgacggcatcagcttcgaccccgccctgatccacgacaacggcctgatccacccccccagaagagagcccgccctgatgatcggcgcctgctggaccgaggagaagaacaaggagaaggagaagggcgacaacagcaccgacaccacccagggcgaccccctgagcatccaccactacttccacggctacctggccggcttcagcgtgagaagcggcagactggagagcagagaggtgatcgagtgcctgtacgcctgcagagagggcctggactacagagacttcgagagcctgggcaagggcatgaaggtgcacgtgaaccccagccagagcctgctgaccctggagggcgacgacgtggagaccttcaaccacgccctgcagcacgtggcctacatgaacaccctgagattcgccacccccggcgtgagacccctgagactgaccaccgccgtgaagtgcttcagcgaggagagctgcgtgagcatccccgaggtggagggctacgtggtggtgctgcagcccgacgccccccagatcctgctgagcggcaccgcccacttcgccagacccgccgtggacttcgagggcaccaacggcgtgcccctgttccccgacctgcagatcacctgcagcatcagccaccaggtggaggccaagaaggacgagagctggcagggcaccgtgaccgacaccagaatgagcgacgagatcgtgcacaacctggacggctgcgagatcagcctggtgggcgacgacctggaccccgagagagagagcctgctgctggacaccaccagcctgcagcagagaggcctggagctgaccaacaccagcgcctacctgaccatcgccggcgtggagagcatcaccgtgtacgaggagatcctgagacaggccagatacagactgagacacggcgccgccctgtacaccagaaagttcagactgagctgcagcgagatgaacggcagatacagcagcaacgagttcatcgtggaggtgaacgtgctgcacagcatgaacagagtggcccaccccagccacgtgctgagcagccagcagttcctgcacagaggccaccagcccccccccgagatggccggccacagcctggccagcagccacagaaacagcatgatccccagcgccgccaccctgatcatcgtggtgtgcgtgggcttcctggtgctgatggtggtgctgggcctggtgagaatccacagcctgcacagaagagtgagcggcgccggcggcccccccggcgccagcagcgaccccaaggaccccgacctgttctgggacgacagcgccctgaccatcatcgtgaaccccatggagagctaccagaacagacagagctgcgtgaccggcgccgtgggcggccagcaggaggacgaggacagcagcgacagcgaggtggccgacagccccagcagcgacgagagaagaatcatcgagacccccccccacagatactag

SEQ ID NO: 16784 - DNA, 2907 bp, Artificial Sequence
  Description of Artificial Sequence: Synthetic coding sequence
atggtgctgggctgcgagctgagcggcagcaccagagtggtggtgggcgtggaggccctgctgaccggcgccagcagccccctgcccggcgtgggccccgccaacaagcacaagccctggatcgaggccgagtaccagggcatcgtgatggagaacgacaacaccgtgctgctgaacccccccctgttcgccctggacaaggacgcccccctgagatacgccggcgagatctgcggcttcagactgcacggcagcggcgtgcccttcgaggccgtgatcctggacaaggccaccggcgagggcctgatcagagccaaggagcccgtggactgcgaggcccagaaggagcacaccttcaccatccaggcctacgactgcggcgagggccccgacggcgccaacaccaagaagagccacaaggccaccgtgcacgtgagagtgaacgacgtgaacgagttcgcccccgtgttcgtggagagactgtacagagccgccgtgaccgagggcaagctgtacgacagaatcctgagagtggaggccatcgacggcgactgcagcccccagtacagccagatctgctactacgagatcctgacccccaacacccccttcctgatcgacaacgacggcaacatcgagaacaccgagaagctgcagtacagcggcgagagactgtacaagttcaccgtgaccgcctacgactgcggcaagaagagagccgccgacgacgccgaggtggagatccaggtgaagcccacctgcaagcccagctggcagggctggaacaagagaatcgagtacgcccccggcgccggcagcctggccctgttccccggcatcagactggagacctgcgacgagcccctgtggaacatccaggccaccatcgagctgcagaccagccacgtggccaagggctgcgacagagacaactacagcgagagagccctgagaaagctgtgcggcgccgccaccggcgaggtggacctgctgcccatgcccggccccaacgccaactggaccgccggcctgagcgtgcactacagccaggacagcagcctgatctactggttcaacggcacccaggccgtgcaggtgcccctgggcggccccagcggcctgggcagcggcccccaggacagcctgagcgaccacttcaccctgagcttctggatgaagcacggcgtgacccccaacaagggcaagaaggaggaggagaccatcgtgtgcaacaccgtgcagaacgaggacggcttcagccactacagcctgaccgtgcacggctgcagaatcgccttcctgtactggcccctgctggagagcgccagacccgtgaagttcctgtggaagctggagcaggtgtgcgacgacgagtggcaccactacgccctgaacctggagttccccaccgtgaccctgtacaccgacggcatcagcttcgaccccgccctgatccacgacaacggcctgatccacccccccagaagagagcccgccctgatgatcggcgcctgctggaccgaggagaagaacaaggagaaggagaagggcgacaacagcaccgacaccacccagggcgaccccctgagcatccaccactacttccacggctacctggccggcttcagcgtgagaagcggcagactggagagcagagaggtgatcgagtgcctgtacgcctgcagagagggcctggactacagagacttcgagagcctgggcaagggcatgaaggtgcacgtgaaccccagccagagcctgctgaccctggagggcgacgacgtggagaccttcaaccacgccctgcagcacgtggcctacatgaacaccctgagattcgccacccccggcgtgagacccctgagactgaccaccgccgtgaagtgcttcagcgaggagagctgcgtgagcatccccgaggtggagggctacgtggtggtgctgcagcccgacgccccccagatcctgctgagcggcaccgcccacttcgccagacccgccgtggacttcgagggcaccaacggcgtgcccctgttccccgacctgcagatcacctgcagcatcagccaccaggtggaggccaagaaggacgagagctggcagggcaccgtgaccgacaccagaatgagcgacgagatcgtgcacaacctggacggctgcgagatcagcctggtgggcgacgacctggaccccgagagagagagcctgctgctggacaccaccagcctgcagcagagaggcctggagctgaccaacaccagcgcctacctgaccatcgccggcgtggagagcatcaccgtgtacgaggagatcctgagacaggccagatacagactgagacacggcgccgccctgtacaccagaaagttcagactgagctgcagcgagatgaacggcagatacagcagcaacgagttcatcgtggaggtgaacgtgctgcacagcatgaacagagtggcccaccccagccacgtgctgagcagccagcagttcctgcacagaggccaccagcccccccccgagatggccggccacagcctggccagcagccacagaaacagcatgatccccagcgccgccaccctgatcatcgtggtgtgcgtgggcttcctggtgctgatggtggtgctgggcctggtgagaatccacagcctgcacagaagagtgagcggcgccggcggcccccccggcgccagcagcgaccccaaggaccccgacctgttctgggacgacagcgccctgaccatcatcgtgaaccccatggagagctaccagaacagacagagctgcgtgaccggcgccgtgggcggccagcaggaggacgaggacagcagcgacagcgaggtggccgacagccccagcagcgacgagagaagaatcatcgagacccccccccacagatactag

SEQ ID NO: 16785 - DNA, 405 bp, Artificial Sequence
  Description of Artificial Sequence: Synthetic coding sequence
atgaccctgctgctgctgcccctgctgctggccagcctgctggccagctgcagctgcaacaaggccaacaagcacaagccctggatcgaggccgagtaccagggcatcgtgatggagaacgacaacaccgtgctgctgaacccccccctgttcgccctggacaaggacgcccccctgagatacgccggcgagatctgcggcttcagactgcacggcagcggcgtgcccttcgaggccgtgatcctggacaaggccaccggcgagggcctgatcagagccaaggagcccgtggactgcgaggcccagaaggagcacaccttcaccatccaggcctacgactgcggcgagggccccgacggcgccaacaccaagaagagccacaaggccaccgtgcacgtgagatag

SEQ ID NO: 16786 - DNA, 1422 bp, Artificial Sequence
  Description of Artificial Sequence: Synthetic coding sequence
atgcccttcggctgcgtgaccctgggcgacaagaagaactacaaccagcccagcgaggtgaccgacagatacgacctgggccaggtgatcaagaccgaggagttctgcgagatcttcagagccaaggacaagaccaccggcaagctgcacacctgcaagaagttccagaagagagacggcagaaaggtgagaaaggccgccaagaacgagatcggcatcctgaagatggtgaagcaccccaacatcctgcagctggtggacgtgttcgtgaccagaaaggagtacttcatcttcctggagctggccaccggcagagaggtgttcgactggatcctggaccagggctactacagcgagagagacaccagcaacgtggtgagacaggtgctggaggccgtggcctacctgcacagcctgaagatcgtgcacagaaacctgaagctggagaacctggtgtactacaacagactgaagaacagcaagatcgtgatcagcgacttccacctggccaagctggagaacggcctgatcaaggagccctgcggcacccccgagtacctgggcaacccccccttctacgaggaggtggaggaggacgactacgagaaccacgacaagaacctgttcagaaagatcctggccggcgactacgagttcgacagcccctactgggacgacatcagccaggccgccaaggacctggtgaccagactgatggaggtggagcaggaccagagaatcaccgccgaggaggccatcagccacgagtggatcagcggcaacgccgccagcgacaagaacatcaaggacggcgtgtgcgcccagatcgagaagaacttcgccagagccaagtggaagaaggccgtgagagtgaccaccctgatgaagagactgagagcccccgagcagagcagcaccgccgccgcccagagcgccagcgccaccgacaccgccacccccggcgccgccggcggcgccaccgccgccgccgccagcggcgccaccagcgcccccgagggcgacgccgccagagccgccaagagcgacaacgtggcccccgccgacagaagcgccacccccgccaccgacggcagcgccacccccgccaccgacggcagcgtgacccccgccaccgacggcagcatcacccccgccaccgacggcagcgtgacccccgccaccgacagaagcgccacccccgccaccgacggcagagccacccccgccaccgaggagagcaccgtgcccaccacccagagcagcgccatgctggccaccaaggccgccgccacccccgagcccgccatggcccagcccgacagcaccgcccccgagggcgccaccggccaggccccccccagcagcaagggcgaggaggccgccggctacgcccaggagagccagagagaggaggccagctag

SEQ ID NO: 16787 - DNA, 1506 bp, Artificial Sequence
  Description of Artificial Sequence: Synthetic coding sequence
atgcccttcggctgcgtgaccctgggcgacaagaagaactacaaccagcccagcgaggtgaccgacagatacgacctgggccaggtgatcaagaccgaggagttctgcgagatcttcagagccaaggacaagaccaccggcaagctgcacacctgcaagaagttccagaagagagacggcagaaaggtgagaaaggccgccaagaacgagatcggcatcctgaagatggtgaagcaccccaacatcctgcagctggtggacgtgttcgtgaccagaaaggagtacttcatcttcctggagctggccaccggcagagaggtgttcgactggatcctggaccagggctactacagcgagagagacaccagcaacgtggtgagacaggtgctggaggccgtggcctacctgcacagcctgaagatcgtgcacagaaacctgaagctggagaacctggtgtactacaacagactgaagaacagcaagatcgtgatcagcgacttccacctggccaagctggagaacggcctgatcaaggagccctgcggcacccccgagtacctggcccccgaggtggtgggcagacagagatacggcagacccgtggactgctgggccatcggcgtgatcatgtacatcctgctgagcggcaacccccccttctacgaggaggtggaggaggacgactacgagaaccacgacaagaacctgttcagaaagatcctggccggcgactacgagttcgacagcccctactgggacgacatcagccaggccgccaaggacctggtgaccagactgatggaggtggagcaggaccagagaatcaccgccgaggaggccatcagccacgagtggatcagcggcaacgccgccagcgacaagaacatcaaggacggcgtgtgcgcccagatcgagaagaacttcgccagagccaagtggaagaaggccgtgagagtgaccaccctgatgaagagactgagagcccccgagcagagcagcaccgccgccgcccagagcgccagcgccaccgacaccgccacccccggcgccgccggcggcgccaccgccgccgccgccagcggcgccaccagcgcccccgagggcgacgccgccagagccgccaagagcgacaacgtggcccccgccgacagaagcgccacccccgccaccgacggcagcgccacccccgccaccgacggcagcgtgacccccgccaccgacggcagcatcacccccgccaccgacggcagcgtgacccccgccaccgacagaagcgccacccccgccaccgacggcagagccacccccgccaccgaggagagcaccgtgcccaccacccagagcagcgccatgctggccaccaaggccgccgccacccccgagcccgccatggcccagcccgacagcaccgcccccgagggcgccaccggccaggccccccccagcagcaagggcgaggaggccgccggctacgcccaggagagccagagagaggaggccagctag

SEQ ID NO: 16788 - DNA, 1413 bp, Artificial Sequence
  Description of Artificial Sequence: Synthetic coding sequence
atgcccttcggctgcgtgaccctgggcgacaagaagaactacaaccagcccagcgaggtgaccgacagatacgacctgggccaggtgatcaagaccgaggagttctgcgagatcttcagagccaaggacaagaccaccggcaagctgcacacctgcaagaagttccagaagagagacggcagaaaggtgagaaaggccgccaagaacgagatcggcatcctgaagatggtgaagcaccccaacatcctgcagctggtggacgtgttcgtgaccagaaaggagtacttcatcttcctggagctggccaccggcagagaggtgttcgactggatcctggaccagggctactacagcgagagagacaccagcaacgtggtgagacaggtgctggaggccgtggcctacctgcacagcctgaagatcgtgcacagaaacctgaagctggagaacctggtgtactacaacagactgaagaacagcaagatcgtgatcagcgacttccacctggccaagctggagaacggcctgatcaaggagccctgcggcacccccgagtacctggcccccgaggtggtgggcagacagagatacggcagacccgtggactgctgggccatcggcgtgatcatgtacatcctgctgagcggcaacccccccttctacgaggaggtggaggaggacgactacgagaaccacgacaagaacctgttcagaaagatcctggccggcgactacgagttcgacagcccctactgggacgacatcagccaggccgccaaggacctggtgaccagactgatggaggtggagcaggaccagagaatcaccgccgaggaggccatcagccacgagtggatcagcggcaacgccgccagcgacaagaacatcaaggacggcgtgtgcgcccagatcgagaagaacttcgccagagccaagtggaagaaggccgtgagagtgaccaccctgatgaagagactgagagcccccgagcagagcagcaccgccgccgcccagagcgccagcgccaccgacaccgccacccccggcgccgccgacagaagcgccacccccgccaccgacggcagcgccacccccgccaccgacggcagcgtgacccccgccaccgacggcagcatcacccccgccaccgacggcagcgtgacccccgccaccgacagaagcgccacccccgccaccgacggcagagccacccccgccaccgaggagagcaccgtgcccaccacccagagcagcgccatgctggccaccaaggccgccgccacccccgagcccgccatggcccagcccgacagcaccgcccccgagggcgccaccggccaggccccccccagcagcaagggcgaggaggccgccggctacgcccaggagagccagagagaggaggccagctag

SEQ ID NO: 16789 - DNA, 1560 bp, Artificial Sequence
  Description of Artificial Sequence: Synthetic coding sequence
atggacgccgtgctggagcccttccccgccgacagactgttccccggcagcagcttcctggacctgggcgacctgaacgagagcgacttcctgaacaacgcccacttccccgagcacctggaccacttcaccgagaacatggaggacttcagcaacgacctgttcagcagcttcttcgacgaccccgtgctggacgagaagagccccctgctggacatggagctggacagccccacccccggcatccaggccgagcacagctacagcctgagcggcgacagcgccccccagagccccctggtgcccatcaagatggaggacaccacccaggacgccgagcacggcgcctgggccctgggccacaagctgtgcagcatcatggtgaagcaggagcagagccccgagctgcccgtggaccccctggccgcccccagcgccatggccgccgccgccgccatggccaccacccccctgctgggcctgagccccctgagcagactgcccatcccccaccaggcccccggcgagatgacccagctgcccgtgatcaaggccgagcccctggaggtgaaccagttcctgaaggtgacccccgaggacctggtgcagatgccccccaccccccccagcagccacggcagcgacagcgacggcagccagagccccagaagcctgccccccagcagccccgtgagacccatggccagaagcagcaccgccatcagcaccagccccctgctgaccgccccccacaagctgcagggcaccagcggccccctgctgctgaccgaggaggagaagagaaccctgatcgccgagggctaccccatccccaccaagctgcccctgaccaaggccgaggagaaggccctgaagagagtgagaagaaagatcaagaacaagatcagcgcccaggagagcagaagaaagaagaaggagtacgtggagtgcctggagaagaaggtggagaccttcaccagcgagaacaacgagctgtggaagaaggtggagaccctggagaacgccaacagaaccctgctgcagcagctgcagaagctgcagaccctggtgaccaacaagatcagcagaccctacaagatggccgccacccagaccggcacctgcctgatggtggccgccctgtgcttcgtgctggtgctgggcagcctggtgccctgcctgcccgagttcagcagcggcagccagaccgtgaaggaggaccccctggccgccgacggcgtgtacaccgccagccagatgcccagcagaagcctgctgttctacgacgacggcgccggcctgtgggaggacggcagaagcaccctgctgcccatggagccccccgacggctgggagatcaaccccggcggccccgccgagcagagacccagagaccacctgcagcacgaccacctggacagcacccacgagaccaccaagtacctgagcgaggcctggcccaaggacggcggcaacggcaccagccccgacttcagccacagcaaggagtggttccacgacagagacctgggccccaacaccaccatcaagctgagctag

SEQ ID NO: 16790 - DNA, 1296 bp, Artificial Sequence
  Description of Artificial Sequence: Synthetic coding sequence
atggacgccgtgctggagcccttccccgccgacagactgttccccggcagcagcttcctggacctgggcgacctgaacgagagcgacttcctgaacaacgcccacttccccgagcacctggaccacttcaccgagaacatggaggacttcagcaacgacctgttcagcagcttcttcgacgaccccgtgctggacgagaagagccccctgctggacatggagctggacagccccacccccggcatccaggccgagcacagctacagcctgagcggcgacagcgccccccagagccccctggtgcccatcaagatggaggacaccacccaggaggacctggtgcagatgccccccaccccccccagcagccacggcagcgacagcgacggcagccagagccccagaagcctgccccccagcagccccgtgagacccatggccagaagcagcaccgccatcagcaccagccccctgctgaccgccccccacaagctgcagggcaccagcggccccctgctgctgaccgaggaggagaagagaaccctgatcgccgagggctaccccatccccaccaagctgcccctgaccaaggccgaggagaaggccctgaagagagtgagaagaaagatcaagaacaagatcagcgcccaggagagcagaagaaagaagaaggagtacgtggagtgcctggagaagaaggtggagaccttcaccagcgagaacaacgagctgtggaagaaggtggagaccctggagaacgccaacagaaccctgctgcagcagctgcagaagctgcagaccctggtgaccaacaagatcagcagaccctacaagatggccgccacccagaccggcacctgcctgatggtggccgccctgtgcttcgtgctggtgctgggcagcctggtgccctgcctgcccgagttcagcagcggcagccagaccgtgaaggaggaccccctggccgccgacggcgtgtacaccgccagccagatgcccagcagaagcctgctgttctacgacgacggcgccggcctgtgggaggacggcagaagcaccctgctgcccatggagccccccgacggctgggagatcaaccccggcggccccgccgagcagagacccagagaccacctgcagcacgaccacctggacagcacccacgagaccaccaagtacctgagcgaggcctggcccaaggacggcggcaacggcaccagccccgacttcagccacagcaaggagtggttccacgacagagacctgggccccaacaccaccatcaagctgagctag

SEQ ID NO: 16791 - DNA, 1560 bp, Artificial Sequence; identical to SEQ ID NO: 16789
  Description of Artificial Sequence: Synthetic coding sequence

SEQ ID NO: 16792 - DNA, 1563 bp, Artificial Sequence
  Description of Artificial Sequence: Synthetic coding sequence
atggaggtgctggagagcggcgagcagggcgtgctgcagtgggacagaaagctgagcgagctgagcgagcccggcgacggcgaggccctgatgtaccacacccacttcagcgagctgctggacgagttcagccagaacgtgctgggccagctgctgaacgaccccttcctgagcgagaagagcgtgagcatggaggtggagcccagccccaccagccccgcccccctgatccaggccgagcacagctacagcctgtgcgaggagcccagagcccagagccccttcacccacatcaccaccagcgacagcttcaacgacgacgaggtggagagcgagaagtggtacctgagcaccgacttccccagcaccagcatcaagaccgagcccgtgaccgacgagcccccccccggcctggtgcccagcgtgaccctgaccatcaccgccatcagcacccccctggagaaggaggagccccccctggagatgaacaccggcgtggacagcagctgccagaccatcatccccaagatcaagctggagccccacgaggtggaccagttcctgaacttcagccccaaggaggcccccgtggaccacctgcacctgccccccaccccccccagcagccacggcagcgacagcgagggcagcctgagccccaaccccagactgcaccccttcagcctgccccagacccacagccccagcagagccgcccccagagcccccagcgccctgagcagcagccccctgctgaccgccccccacaagctgcagggcagcggccccctggtgctgaccgaggaggagaagagaaccctgatcgccgagggctaccccatccccaccaagctgcccctgagcaagagcgaggagaaggccctgaagaagatcagaagaaagatcaagaacaagatcagcgcccaggagagcagaagaaagaagaaggagtacatggacagcctggagaagaaggtggagagctgcagcaccgagaacctggagctgagaaagaaggtggaggtgctggagaacaccaacagaaccctgctgcagcagctgcagaagctgcagaccctggtgatgggcaaggtgagcagaacctgcaagctggccggcacccagaccggcacctgcctgatggtggtggtgctgtgcttcgccgtggccttcggcagcttcttccagggctacggcccctaccccagcgccaccaagatggccctgcccagccagcacagcctgcaggagccctacaccgccagcgtggtgagaagcagaaacctgctgatctacgaggagcacagcccccccgaggagagcagcagccccggcagcgccggcgagctgggcggctgggacagaggcagcagcctgctgagagtgagcggcctggagagcagacccgacgtggacctgccccacttcatcatcagcaacgagaccagcctggagaagagcgtgctgctggagctgcagcagcacctggtgagcgccaagctggagggcaacgagaccctgaaggtggtggagctggacagaagagtgaacaccaccttctag

SEQ ID NO: 16793 - DNA, 528 bp, Artificial Sequence
  Description of Artificial Sequence: Synthetic coding sequence
atggaggtgctggagagcggcgagcagggcgtgctgcagtgggacagaaagctgagcgagctgagcgagcccggcgacggcgaggccctgatgtaccacacccacttcagcgagctgctggacgagttcagccagaacgtgctgggccagctgctgaacgaccccttcctgagcgagaagagcgtgagcatggaggtggagcccagccccaccagccccgcccccctgatccaggccgagcacagctacagcctgtgcgaggagcccagagcccagagccccttcacccacatcaccaccagcgacagcttcaacgacgacgaggtggagagcgagaagtggtacctgagcaccgacttccccagcaccagcatcaagaccgagcccgtgaccgacgagcccccccccggcctggtgcccagcgtgaccctgaccatcaccgccatcagcacccccctggagaaggaggagccccccctggagatgaacaccggcgtggacagcagctgccagaccaacaccacctag

SEQ ID NO: 16794 - DNA, 747 bp, Artificial Sequence
  Description of Artificial Sequence: Synthetic coding sequence
atggaggtgctggagagcggcgagcagggcgtgctgcagtgggacagaaagctgagcgagctgagcgagcccggcgacggcgaggccctgatgtaccacacccacttcagcgagctgctggacgagttcagccagaacgtgctgggccagctgctgaacgaccccttcctgagcgagaagagcgtgagcatggaggtggagcccagccccaccagccccgcccccctgatccaggccgagcacagctacagcctgtgcgaggagcccagagcccagagccccttcacccacatcaccaccagcgacagcttcaacgacgacgaggtggagagcgagaagtggtacctgagcaccgacttccccagcaccagcatcaagaccgagcccgtgaccgacgagcccccccccggcctggtgcccagcgtgaccctgaccatcaccgccatcagcacccccctggagaaggaggagccccccctggagatgaacaccggcgtggacagcagctgccagaccatcatccccaagatcaagctggagccccacgaggtggaccagttcctgaacttcagccccaaggagggcctgagcgccctgcccgtgagcctgtgggtgatggacatggtgagcggcagcaccgagagagagtacggcgagagagccggcatgagcctgtaccacagatgctgcagctggctgtacgagatcgccctgttcctgaagaacaagaacttcgccagcaagtag

SEQ ID NO: 16795 - DNA, 1383 bp, Artificial Sequence
  Description of Artificial Sequence: Synthetic coding sequence
atggaggtgctggagagcggcgagcagggcgtgctgcagtgggacagaaagctgagcgagctgagcgagcccggcgacggcgaggccctgatgtaccacacccacttcagcgagctgctggacgagttcagccagaacgtgctgggccagctgctgaacgaccccttcctgagcgagaagagcgtgagcatggaggtggagcccagccccaccagccccgcccccctgatccaggccgagcacagctacagcctgtgcgaggagcccagagcccagagccccttcacccacatcaccaccagcgacagcttcaacgacgacgaggtggagagcgagaagtggtacctgagcaccgacttccccagcaccagcatcaagaccgagcccgtgaccgacgagcccccccccggcctggtgcccagcgtgaccctgaccatcaccgccatcagcacccccctggagaaggaggagccccccctggagatgaacaccggcgtggacagcagctgccagaccatcatccccaagatcaagctggagccccacgaggtggaccagttcctgaacttcagccccaaggaggcccccgtggaccacctgcacctgccccccaccccccccagcagccacggcagcgacagcgagggcagcctgagccccaaccccagactgcaccccttcagcctgccccagacccacagccccagcagagccgcccccagagcccccagcgccctgagcagcagccccctgctgaccgccccccacaagctgcagggcagcggccccctggtgctgaccgaggaggagaagagaaccctgatcgccgagggctaccccatccccaccaagctgcccctgagcaagagcgaggagaaggccctgaagaagatcagaagaaagatcaagaacaagatcagcgcccaggagagcagaagaaagaagaaggagtacatggacagcctggagaagaaggtggagagctgcagcaccgagaacctggagctgagaaagaaggtggaggtgctggagaacaccaacagaaccctgctgcagcagctgcagaagctgcagaccctggtgatgggcaaggtgagcagaacctgcaagctggccggcacccagaccggcacctgcctgatggtggtggtgctgtgcttcgccgtggccttcggcagcttcttccagggctacggcccctaccccagcgccaccaagatggccctgcccagccagcacagcctgcaggagccctacaccgccagcgtgggcaagaccgcctgcggcaagctgggcagagtgctgttctacttccccagagccggcttcctgagcctgcccaagggcatcttctgcgagagccccatgttcaagaagtggtag

SEQ ID NO: 16796 - DNA, 453 bp, Artificial Sequence
  Description of Artificial Sequence: Synthetic coding sequence
atggaggtgctggagagcggcgagcagggcgtgctgcagtgggacagaaagctgagcgagctgagcgagcccggcgacggcgaggccctgatgtaccacacccacttcagcgagctgctggacgagttcagccagaacgtgctgggccagctgctgaacgaccccttcctgagcgagaagagcgtgagcatggaggtggagcccagccccaccagccccgcccccctgatccaggccgagcacagctacagcctgtgcgaggagcccagagcccagagccccttcacccacatcaccaccagcgacagcttcaacgacgacgaggtggagagcgagaagtggtacctgagcaccgacttccccagcaccagcatctgccacagcgaccaccacagccacctgcaccccgtgggcaagggcggcaccagcagcggcaacgagcactggggctag

SEQ ID NO: 16797 - DNA, 1311 bp, Artificial Sequence
  Description of Artificial Sequence: Synthetic coding sequence
atggtgggcttcggcgccaacagaagagccggcagactgcccagcctggtgctggtggtgctgctggtggtgatcgtggtgctggccttcaactactggagcatcagcagcagacacgtgctgctgcaggaggaggtggccgagctgcagggccaggtgcagagaaccgaggtggccagaggcagactggagaagagaaacagcgacctgctgctgctggtggacacccacaagaagcagatcgaccagaaggaggccgactacggcagactgagcagcagactgcaggccagagagggcctgggcaagagatgcgaggacgacaaggtgaagctgcagaacaacatcagctaccagatggccgacatccaccacctgaaggagcagctggccgagctgagacaggagttcctgagacaggaggaccagctgcaggactacagaaagaacaacacctacctggtgaagagactggagtacgagagcttccagtgcggccagcagatgaaggagctgagagcccagcacgaggagaacatcaagaagctggccgaccagttcctggaggagcagaagcaggagacccagaagatccagagcaacgacggcaaggagctggacatcaacaaccaggtggtgcccaagaacatccccaaggtggccgagaacgtggccgacaagaacgaggagcccagcagcaaccacatcccccacggcaaggagcagatcaagagaggcggcgacgccggcatgcccggcatcgaggagaacgacctggccaaggtggacgacctgccccccgccctgagaaagccccccatcagcgtgagccagcacgagagccaccaggccatcagccacctgcccaccggccagcccctgagccccaacatgccccccgacagccacatcaaccacaacggcaaccccggcaccagcaagcagaaccccagcagccccctgcagagactgatccccggcagcaacctggacagcgagcccagaatccagaccgacatcctgaagcaggccaccaaggacagagtgagcgacttccacaagctgaagcagagcagattcttcgacgagaacgagagccccgtggacccccagcacggcagcaagctggccgactacaacggcgacgacggcaacgtgggcgagtacgaggccgacaagcaggccgagctggcctacaacgaggaggaggacggcgacggcggcgaggaggacgtgcaggacgacgaggagagagagctgcagatggaccccgccgactacggcaagcagcacttcaacgacgtgctgtag

SEQ ID NO: 16798 - DNA, 1143 bp, Artificial Sequence
  Description of Artificial Sequence: Synthetic coding sequence
atggtgggcttcggcgccaacagaagagccggcagactgcccagcctggtgctggtggtgctgctggtggtgatcgtggtgctggccttcaactactggagcatcagcagcagacacgtgctgctgcaggaggaggtggccgagctgcagggccaggtgcagagaaccgaggtggccagaggcagactggagaagagaaacagcgacctgctgctgctggtggacacccacaagaagcagatcgaccagaaggaggccgactacggcagactgagcagcagactgcaggccagagagggcctgggcaagagatgcgaggacgacaaggtgaagctgcagaacaacatcagctaccagatggccgacatccaccacctgaaggagcagctggccgagctgagacaggagttcctgagacaggaggaccagctgcaggactacagaaagaacaacacctacctggtgaagagactggagtacgagagcttccagtgcggccagcagatgaaggagctgagagcccagcacgaggagaacatcaagaagctggccgaccagttcctggaggagcagaagcaggagacccagaagatccagagcaacgacggcaaggagctggacatcaacaaccaggtggtgcccaagaacatccccaaggtggccgagaacgtggccgacaagaacgaggagcccagcagcaaccacatcccccacggcaaggagcagatcaagagaggcggcgacgccggcatgcccggcatcgaggagaacgacctggccaaggtggacgacctgccccccgccctgagaaagccccccatcagcgtgagccagcacgagagccaccaggccatcagccacctgcccaccggccagcccctgagccccaacatgccccccgacagccacatcaaccacaacggcaaccccggcaccagcaagcagaaccccagcagccccctgcagagactgatccccggcagcaacctggacagcgagcccagaatccagaccgacatcctgaagcaggccaccaaggacagagtgagcgacttccacaagctgaagcagaacgacgaggagagagagctgcagatggaccccgccgactacggcaagcagcacttcaacgacgtgctgtag

SEQ ID NO: 16799 - DNA, 534 bp, Artificial Sequence
  Description of Artificial Sequence: Synthetic coding sequence
atggtgggcttcggcgccaacagaagagccggcagactgcccagcctggtgctggtggtgctgctggtggtgatcgtggtgctggccttcaactactggagcatcagcagcagacacgtgctgctgcaggaggaggtggccgagctgcagggccaggtgcagagaaccgaggtggccagaggcagactggagaagagaaacagcgacctgctgctgctggtggacacccacaagaagcagatcgaccagaaggaggccgactacggcagactgagcagcagactgcaggccagagagggcctgggcaagagatgcgaggacgacaaggtgaagctgcagaacaacatcagctaccagatggccgacatccaccacctgaaggagcagctggccgagctgagacaggagttcctgagacaggaggaccagctgcaggactacagaaagaacaacacctacctggtgaagagactggagtacgagagcaagagacccaagagattcaaccagatgatggagagaaactggatctag

SEQ ID NO: 16800 - DNA, 1248 bp, Artificial Sequence
  Description of Artificial Sequence: Synthetic coding sequence
atggtggtgatcgtggtgctggccttcaactactggagcatcagcagcagacacgtgctgctgcaggaggaggtggccgagctgcagggccaggtgcagagaaccgaggtggccagaggcagactggagaagagaaacagcgacctgctgctgctggtggacacccacaagaagcagatcgaccagaaggaggccgactacggcagactgagcagcagactgcaggccagagagggcctgggcaagagatgcgaggacgacaaggtgaagctgcagaacaacatcagctaccagatggccgacatccaccacctgaaggagcagctggccgagctgagacaggagttcctgagacaggaggaccagctgcaggactacagaaagaacaacacctacctggtgaagagactggagtacgagagcttccagtgcggccagcagatgaaggagctgagagcccagcacgaggagaacatcaagaagctggccgaccagttcctggaggagcagaagcaggagacccagaagatccagagcaacgacggcaaggagctggacatcaacaaccaggtggtgcccaagaacatccccaaggtggccgagaacgtggccgacaagaacgaggagcccagcagcaaccacatcccccacggcaaggagcagatcaagagaggcggcgacgccggcatgcccggcatcgaggagaacgacctggccaaggtggacgacctgccccccgccctgagaaagccccccatcagcgtgagccagcacgagagccaccaggccatcagccacctgcccaccggccagcccctgagccccaacatgccccccgacagccacatcaaccacaacggcaaccccggcaccagcaagcagaaccccagcagccccctgcagagactgatccccggcagcaacctggacagcgagcccagaatccagaccgacatcctgaagcaggccaccaaggacagagtgagcgacttccacaagctgaagcagagcagattcttcgacgagaacgagagccccgtggacccccagcacggcagcaagctggccgactacaacggcgacgacggcaacgtgggcgagtacgaggccgacaagcaggccgagctggcctacaacgaggaggaggacggcgacggcggcgaggaggacgtgcaggacgacgaggagagagagctgcagatggaccccgccgactacggcaagcagcacttcaacgacgtgctgtag

SEQ ID NO: 16801 - DNA, 75 bp, Artificial Sequence
  Description of Artificial Sequence: Synthetic coding sequence
caggacgacgaggagagagagctgcagatggaccccgccgactacggcaagcagcacttcaacgacgtgctgtag

SEQ ID NO: 16802 - DNA, 1302 bp, Artificial Sequence
  Description of Artificial Sequence: Synthetic coding sequence
atggtgggcttcggcgccaacagaagagccggcagactgcccagcctggtgctggtggtgctgctggtggtgatcgtggtgctggccttcaactactggagcatcagcagcagacacgtgctgctgcaggaggaggtggccgagctgcagggccaggtgcagagaaccgaggtggccagaggcagactggagaagagaaacagcgacctgctgctgctggtggacacccacaagaagcagatcgaccagaaggaggccgactacggcagactgagcagcagactgcaggccagagagggcctgggcaagagatgcgaggacgacaaggtgaagctgcagaacaacatcagctaccagatggccgacatccaccacctgaaggagcagctggccgagctgagacaggagttcctgagacaggaggaccagctgcaggactacagaaagaacaacacctacctggtgaagagactggagtacgagagcttccagtgcggccagcagatgaaggagctgagagcccagcacgaggagaacatcaagaagctggccgaccagttcctggaggagcagaagcaggagacccagaagatccagagcaacgacggcaaggagctggacatcaacaaccaggtggtgcccaagaacatccccaaggtggccgagaacgtggccgacaagaacgaggagcccagcagcaaccacatcccccacggcaaggagcagatcaagagaggcggcgacgccggcatgcccggcatcgaggagaacgacctggccaaggtggacgacctgccccccgccctgagaaagccccccatcagcgtgagccagcacgagagccaccaggccatcagccacctgcccaccggccagcccctgagccccaacatgccccccgacagccacatcaaccacaacggcaaccccggcaccagcaagcagaaccccagcagccccctgcagagactgatccccggcagcaacctggacagcgagcccagaatccagaccgacatcctgaagcaggccaccaaggacagagtgagcgacttccacaagctgaagcagagcagattcttcgacgagaacgagagccccgtggacccccagcacggcagcaagctggccgactacaacggcgacgacggcaacgtgggcgagtacgaggccgacaagcaggccgagctggcctacaacgaggaggaggacggcgacggcggcgaggaggacgtgcagggcgagagaggccccggcctgcacgccatcaccatgaagcccaccagcaagttcttcggctag

SEQ ID NO: 16803 - DNA, 549 bp, Artificial Sequence
  Description of Artificial Sequence: Synthetic coding sequence
atgaagggctggggctggctggccctgctgctgggcgccctgctgggcaccgcctgggccagaagaagccaggacctgcactgcggcgcctgcagagccctggtggacgagctggagtgggagatcgcccaggtggaccccaagaagaccatccagatgggcagcttcagaatcaaccccgacggcagccagagcgtggtggaggtgccctacgccagaagcgaggcccacctgaccgagctgctggaggagatctgcgacagaatgaaggagtacggcgagcagatcgaccccagcacccacagaaagaactacgtgagagtggtgggcagaaacggcgagagcagcgagctggacctgcagggcatcagaatcgacagcgacatcagcggcaccctgaagttcgcctgcgagagcatcgtggaggagtacgaggacgagctgatcgagttcttcagcagagaggccgacaacgtgaaggacaagctgtgcagcaagagaaccgacctgtgcgaccacgccctgcacatcagccacgacgagctgtag

SEQ ID NO: 16804 - DNA, 507 bp, Artificial Sequence
  Description of Artificial Sequence: Synthetic coding sequence
atgaagggctggggctggctggccctgctgctgggcgccctgctgggcaccgcctgggccagaagaagccaggacctgcactgcggcgcctgcagagccctggtggacgagctggagtgggagatcgcccaggtggaccccaagaagaccatccagatgggcagcttcagaatcaaccccgacggcagccagagcgtggtggaggtgccctacgccagaagcgaggcccacctgaccgagctgctggaggagatctgcgacagaatgaaggagtacggcgagcagatcgaccccagcacccacagaaagaactacgtgagagtggtgggcagaaacggcgagagcagcgagctggacctgcagggcatcagaatcgacagcgacatcagcggcaccctgaagttcgcctgcgagagcatcgtggaggagtacgaggacgagctgatcgagttcttcagcagagaggccgacaacgtgaaggacaagctgtgcagcaagagaacctag

SEQ ID NO: 16805 - DNA, 1644 bp, Artificial Sequence
  Description of Artificial Sequence: Synthetic coding sequence
atgaccaagaccgaccccgcccccatggcccccccccccagaggcgaggaggaggaggaggaggaggaggacgagcccgtgcccgaggcccccagccccacccaggagagaagacagaagcccgtggtgcaccccagcgcccccgcccccctgcccaaggactacgccttcaccttcttcgaccccaacgaccccgcctgccaggagatcctgttcgacccccagaccaccatccccgagctgttcgccatcgtgagacagtgggtgccccaggtgcagcacaagatcgacgtgatcggcaacgagatcctgagaagaggctgccacgtgaacgacagagacggcctgaccgacatgaccctgctgcactacgcctgcaaggccggcgcccacggcgtgggcgaccccgccgccgccgtgagactgagccagcagctgctggccctgggcgccgacgtgaccctgagaagcagatggaccaacatgaacgccctgcactacgccgcctacttcgacgtgcccgacctggtgagagtgctgctgaagggcgccagacccagagtggtgaacagcacctgcagcgacttcaaccacggcagcgccctgcacatcgccgccagcagcctgtgcctgggcgccgccaagtgcctgctggagcacggcgccaaccccgccctgagaaacagaaagggccaggtgcccgccgaggtggtgcccgaccccatggacatgagcctggacaaggccgaggccgccctggtggccaaggagctgagaaccctgctggaggaggccgtgcccctgagctgcgccctgcccaaggtgaccctgcccaactacgacaacgtgcccggcaacctgatgctgagcgccctgggcctgagactgggcgacagagtgctgctggacggccagaagaccggcaccctgagattctgcggcaccaccgagttcgccagcggccagtgggtgggcgtggagctggacgagcccgagggcaagaacgacggcagcgtgggcggcgtgagatacttcatctgcccccccaagcagggcctgttcgccagcgtgagcaagatcagcaaggccgtggacgccccccccagcagcgtgaccagcacccccagaacccccagaatggacttcagcagagtgaccggcaagggcagaagagagcacaagggcaagaagaagacccccagcagccccagcctgggcagcctgcagcagagagacggcgccaaggccgaggtgggcgaccaggtgctggtggccggccagaagcagggcatcgtgagattctacggcaagaccgacttcgcccccggctactggtacggcatcgagctggaccagcccaccggcaagcacgacggcagcgtgttcggcgtgagatacttcacctgcccccccagacacggcgtgttcgcccccgccagcagaatccagagaatcggcggcagcaccgacagccccggcgacagcgtgggcgccaagaaggtgcaccaggtgaccatgacccagcccaagagaaccttcaccaccgtgagaacccccaaggacatcgccagcgagaacagcatcagcagactgctgttctgctgctggttcccctggatgctgagagccgagatgcagagctag

SEQ ID NO: 16806 - DNA, 1572 bp, Artificial Sequence
  Description of Artificial Sequence: Synthetic coding sequence
atgaaccccagccccagaccccccgccccccccagaagcgccggcagaagcctgctgtgcacccccagacacctgccccccagcctgagaaccaccctgaccttcttcgaccccaacgaccccgcctgccaggagatcctgttcgacccccagaccaccatccccgagctgttcgccatcgtgagacagtgggtgccccaggtgcagcacaagatcgacgtgatcggcaacgagatcctgagaagaggctgccacgtgaacgacagagacggcctgaccgacatgaccctgctgcactacgcctgcaaggccggcgcccacggcgtgggcgaccccgccgccgccgtgagactgagccagcagctgctggccctgggcgccgacgtgaccctgagaagcagatggaccaacatgaacgccctgcactacgccgcctacttcgacgtgcccgacctggtgagagtgctgctgaagggcgccagacccagagtggtgaacagcacctgcagcgacttcaaccacggcagcgccctgcacatcgccgccagcagcctgtgcctgggcgccgccaagtgcctgctggagcacggcgccaaccccgccctgagaaacagaaagggccaggtgcccgccgaggtggtgcccgaccccatggacatgagcctggacaaggccgaggccgccctggtggccaaggagctgagaaccctgctggaggaggccgtgcccctgagctgcgccctgcccaaggtgaccctgcccaactacgacaacgtgcccggcaacctgatgctgagcgccctgggcctgagactgggcgacagagtgctgctggacggccagaagaccggcaccctgagattctgcggcaccaccgagttcgccagcggccagtgggtgggcgtggagctggacgagcccgagggcaagaacgacggcagcgtgggcggcgtgagatacttcatctgcccccccaagcagggcctgttcgccagcgtgagcaagatcagcaaggccgtggacgccccccccagcagcgtgaccagcacccccagaacccccagaatggacttcagcagagtgaccggcaagggcagaagagagcacaagggcaagaagaagacccccagcagccccagcctgggcagcctgcagcagagagacggcgccaaggccgaggtgggcgaccaggtgctggtggccggccagaagcagggcatcgtgagattctacggcaagaccgacttcgcccccggctactggtacggcatcgagctggaccagcccaccggcaagcacgacggcagcgtgttcggcgtgagatacttcacctgcccccccagacacggcgtgttcgcccccgccagcagaatccagagaatcggcggcagcaccgacagccccggcgacagcgtgggcgccaagaaggtgcaccaggtgaccatgacccagcccaagagaaccttcaccaccgtgagaacccccaaggacatcgccagcgagaacagcatcagcagactgctgttctgctgctggttcccctggatgctgagagccgagatgcagagctag

SEQ ID NO: 16807 - DNA, 1290 bp, Artificial Sequence
  Description of Artificial Sequence: Synthetic coding sequence
atgaccctgctgcactacgcctgcaaggccggcgcccacggcgtgggcgaccccgccgccgccgtgagactgagccagcagctgctggccctgggcgccgacgtgaccctgagaagcagatggaccaacatgaacgccctgcactacgccgcctacttcgacgtgcccgacctggtgagagtgctgctgaagggcgccagacccagagtggtgaacagcacctgcagcgacttcaaccacggcagcgccctgcacatcgccgccagcagcctgtgcctgggcgccgccaagtgcctgctggagcacggcgccaaccccgccctgagaaacagaaagggccaggtgcccgccgaggtggtgcccgaccccatggacatgagcctggacaaggccgaggccgccctggtggccaaggagctgagaaccctgctggaggaggccgtgcccctgagctgcgccctgcccaaggtgaccctgcccaactacgacaacgtgcccggcaacctgatgctgagcgccctgggcctgagactgggcgacagagtgctgctggacggccagaagaccggcaccctgagattctgcggcaccaccgagttcgccagcggccagtgggtgggcgtggagctggacgagcccgagggcaagaacgacggcagcgtgggcggcgtgagatacttcatctgcccccccaagcagggcctgttcgccagcgtgagcaagatcagcaaggccgtggacgccccccccagcagcgtgaccagcacccccagaacccccagaatggacttcagcagagtgaccggcaagggcagaagagagcacaagggcaagaagaagacccccagcagccccagcctgggcagcctgcagcagagagacggcgccaaggccgaggtgggcgaccaggtgctggtggccggccagaagcagggcatcgtgagattctacggcaagaccgacttcgcccccggctactggtacggcatcgagctggaccagcccaccggcaagcacgacggcagcgtgttcggcgtgagatacttcacctgcccccccagacacggcgtgttcgcccccgccagcagaatccagagaatcggcggcagcaccgacagccccggcgacagcgtgggcgccaagaaggtgcaccaggtgaccatgacccagcccaagagaaccttcaccaccgtgagaacccccaaggacatcgccagcgagaacagcatcagcagactgctgttctgctgctggttcccctggatgctgagagccgagatgcagagctag

SEQ ID NO: 16808 - DNA, 1059 bp, Artificial Sequence
  Description of Artificial Sequence: Synthetic coding sequence
atgaagcccgccctgctggaggtgatgagaatgaacagaatctgcagaatggtgctggccacctgcctgggcagcttcatcctggtgatcttctacttccagagcatgctgcaccccgtgatgagaagaaaccccttcggcgtggacatctgctgcagaaagggcagcagaagccccctgcaggagctgtacaaccccatccagctggagctgagcaacaccgccgtgctgcaccagatgagaagagaccaggtgaccgacacctgcagagccaacagcgccaccagcagaaagagaagagtgctgacccccaacgacctgaagcacctggtggtggacgaggaccacgagctgatctactgctacgtgcccaaggtggcctgcaccaactggaagagactgatgatggtgctgaccggcagaggcaagtacagcgaccccatggagatccccgccaacgaggcccacgtgagcgccaacctgaagaccctgaaccagtacagcatccccgagatcaaccacagactgaagagctacatgaagttcctgttcgtgagagagcccttcgagagactggtgagcgcctacagaaacaagttcacccagaagtacaacatcagcttccacaagagatacggcaccaagatcatcaagagacagagaaagaacgccacccaggaggccctgagaaagggcgacgacgtgaagttcgaggagttcgtggcctacctgatcgacccccacacccagagagaggagcccttcaacgagcactggcagaccgtgtacagcctgtgccacccctgccacatccactacgacctggtgggcaagtacgagaccctggaggaggacagcaactacgtgctgcagctggccggcgtgggcagctacctgaagttccccacctacgccaagagcaccagaaccaccgacgagatgaccaccgagttcttccagaacatcagcagcgagcaccagacccagctgtacgaggtgtacaagctggacttcctgatgttcaactacagcgtgcccagctacctgaagctggagtag

SEQ ID NO: 16809 - DNA, 1044 bp, Artificial Sequence
  Description of Artificial Sequence: Synthetic coding sequence
atgaagcccgccctgctggaggtgatgagaatgaacagaatctgcagaatggtgctggccacctgcctgggcagcttcatcctggtgatcttctacttccagatcatgagaagaaaccccttcggcgtggacatctgctgcagaaagggcagcagaagccccctgcaggagctgtacaaccccatccagctggagctgagcaacaccgccgtgctgcaccagatgagaagagaccaggtgaccgacacctgcagagccaacagcgccaccagcagaaagagaagagtgctgacccccaacgacctgaagcacctggtggtggacgaggaccacgagctgatctactgctacgtgcccaaggtggcctgcaccaactggaagagactgatgatggtgctgaccggcagaggcaagtacagcgaccccatggagatccccgccaacgaggcccacgtgagcgccaacctgaagaccctgaaccagtacagcatccccgagatcaaccacagactgaagagctacatgaagttcctgttcgtgagagagcccttcgagagactggtgagcgcctacagaaacaagttcacccagaagtacaacatcagcttccacaagagatacggcaccaagatcatcaagagacagagaaagaacgccacccaggaggccctgagaaagggcgacgacgtgaagttcgaggagttcgtggcctacctgatcgacccccacacccagagagaggagcccttcaacgagcactggcagaccgtgtacagcctgtgccacccctgccacatccactacgacctggtgggcaagtacgagaccctggaggaggacagcaactacgtgctgcagctggccggcgtgggcagctacctgaagttccccacctacgccaagagcaccagaaccaccgacgagatgaccaccgagttcttccagaacatcagcagcgagcaccagacccagctgtacgaggtgtacaagctggacttcctgatgttcaactacagcgtgcccagctacctgaagctggagtag

SEQ ID NO: 16810 - DNA, 1245 bp, Artificial Sequence
  Description of Artificial Sequence: Synthetic coding sequence
atgaccaaggccagactgttcagactgtggctggtgctgggcagcgtgttcatgatcctgctgatcatcgtgtactgggacagcgccggcgccgcccacttctacctgcacaccagcttcagcagaccccacaccggcccccccctgcccacccccggccccgacagagacagagagctgaccgccgacagcgacgtggacgagttcctggacaagttcctgagcgccggcgtgaagcagagcgacctgcccagaaaggagaccgagcagccccccgcccccggcagcatggaggagagcgtgagaggctacgactggagccccagagacgccagaagaagccccgaccagggcagacagcaggccgagagaagaagcgtgctgagaggcttctgcgccaacagcagcctggccttccccaccaaggagagagccttcgacgacatccccaacagcgagctgagccacctgatcgtggacgacagacacggcgccatctactgctacgtgcccaaggtggcctgcaccaactggaagagagtgatgatcgtgctgagcggcagcctgctgcacagaggcgccccctacagagaccccctgagaatccccagagagcacgtgcacaacgccagcgcccacctgaccttcaacaagttctggagaagatacggcaagctgagcagacacctgatgaaggtgaagctgaagaagtacaccaagttcctgttcgtgagagaccccttcgtgagactgatcagcgccttcagaagcaagttcgagctggagaacgaggagttctacagaaagttcgccgtgcccatgctgagactgtacgccaaccacaccagcctgcccgccagcgccagagaggccttcagagccggcctgaaggtgagcttcgccaacttcatccagtacctgctggacccccacaccgagaagctggcccccttcaacgagcactggagacaggtgtacagactgtgccacccctgccagatcgactacgacttcgtgggcaagctggagaccctggacgaggacgccgcccagctgctgcagctgctgcaggtggacagacagctgagattcccccccagctacagaaacagaaccgccagcagctgggaggaggactggttcgccaagatccccctggcctggagacagcagctgtacaagctgtacgaggccgacttcgtgctgttcggctaccccaagcccgagaacctgctgagagactag

SEQ ID NO: 16811 - DNA, 738 bp, Artificial Sequence
  Description of Artificial Sequence: Synthetic coding sequence
atgaccaaggccagactgttcagactgtggctggtgctgggcagcgtgttcatgatcctgctgatcatcgtgtactgggacagcgccggcgccgcccacttctacctgcacaccagcttcagcagaccccacaccggcccccccctgcccacccccggccccgacagagacagagagctgaccgccgacagcgacgtggacgagttcctggacaagttcctgagcgccggcgtgaagcagagcgacctgcccagaaaggagaccgagcagccccccgcccccggcagcatggaggagagcgtgagaggctacgactggagccccagagacgccagaagaagccccgaccagggcagacagcaggccgagagaagaagcgtgctgagaggcttctgcgccaacagcagcctggccttccccaccaaggagagagccttcgacgacatccccaacagcgagctgagccacctgatcgtggacgacagacacggcgccatctactgctacgtgcccaaggtggcctgcaccaactggaagagagtgatgatcgtgctgagcggcagcctgctgcacagaggcgccccctacagagaccccctgagaatccccagagagcacgtgcacaacgccagcgcccacctgaccttcaacaagttctggagaagatacggcaagctgagcagacacctgatgaaggtgaagctgaagaagtacaccaagttcctgttcgtgagatag

SEQ ID NO: 16812 - DNA, 1026 bp, Artificial Sequence
  Description of Artificial Sequence: Synthetic coding sequence
atgggcagaagatgctgcagaagaagagtgctggccgccgcctgcctgggcgccgccctgctgctgctgtgcgccgcccccagaagcctgagacccgccttcggcaacagagccctgggcagcagctggctgggcggcgagaagagaagccccctgcagaagctgtacgacctggaccaggaccccagaagcaccctggccaaggtgcacagacagagaagagacctgctgaacagcgcctgcagcagacacagcagaagacagagactgctgcagcccgaggacctgagacacgtgctggtggacgacgcccacggcctgctgtactgctacgtgcccaaggtggcctgcaccaactggaagagagtgctgctggccctgagcggccaggccagaggcgaccccagagccatcagcgcccaggaggcccacgcccccggcagactgcccagcctggccgacttcagccccgccgagatcaacagaagactgagagcctacctggccttcctgttcgtgagagagcccttcgagagactggccagcgcctacagaaacaagctggccagaccctacagcgccgccttccagagaagatacggcgccagaatcgtgcagagactgagacccagagccctgcccgacgccagagccagaggccacgacgtgagattcgccgagttcctggcctacctgctggaccccagaaccagaagagaggagcccttcaacgagcactgggagagagcccacgccctgtgccacccctgcagactgagatacgacgtggtgggcaagttcgagaccctggccgaggacgccgccttcgtgctgggcctggccggcgccagcgacctgagcttccccggcccccccagacccagaggcgccgccgccagcagagacctggccgccagactgttcagagacatcagccccttctaccagagaagactgttcgacctgtacaagatggacttcctgctgttcaactacagcgcccccagctacctgagactgctgtag

SEQ ID NO: 16813 - DNA, 678 bp, Artificial Sequence
  Description of Artificial Sequence: Synthetic coding sequence
atgggcagaagatgctgcagaagaagagtgctggccgccgcctgcctgggcgccgccctgctgctgctgtgcgccgcccccagaagcctgagacccgccttcggcaacagagccctgggcagcagctggctgggcggcgagaagagaagccccctgcagaagctgtacgacctggaccaggaccccagaagcaccctggccaaggtgcacagacagagaagagacctgctgaacagcgcctgcagcagacacagcagaagacagagactgctgcagcccgaggacctgagacacgtgctggtggacgacgcccacggcctgctgtactgctacgtgcccaaggtggcctgcaccaactggaagagagtgctgctggccctgagcggccaggccagaggcgaccccagagccatcagcgcccaggaggcccacgcccccggcagactgcccagcctggccgacttcagccccgccgagatcaacagaagactgagagcctacctggccttcctgttcgtgagagagcccttcgagagactggccagcgcctacagaaacaagctggccagaaccagaagcgccaccagagtggccagcgccaccaccagctgggccagcagcagaagatggagaagaaccagacccagctgctgggcctggagagcccaccccacctag

SEQ ID NO: 16814 - DNA, 1161 bp, Artificial Sequence
  Description of Artificial Sequence: Synthetic coding sequence
atgctgctgcccaagaagatgaagctgctgctgttcctggtgagccagatggccatcctggccctgttcttccacatgtacagccacaacatcagcagcctgagcatgaaggcccagcccgagagaatgcacgtgctggtgctgagcagctggagaagcggcagcagcttcgtgggccagctgttcggccagcaccccgacgtgttctacctgatggagcccgcctggcacgtgtggatgaccttcaagcagagcaccgcctggatgctgcacatggccgtgagagacctgatcagagccgtgttcctgtgcgacatgagcgtgttcgacgcctacatggagcccggccccagaagacagagcagcctgttccagtgggagaacagcagagccctgtgcagcgcccccgcctgcgacatcatcccccaggacgagatcatccccagagcccactgcagactgctgtgcagccagcagcccttcgaggtggtggagaaggcctgcagaagctacagccacgtggtgctgaaggaggtgagattcttcaacctgcagagcctgtaccccctgctgaaggaccccagcctgaacctgcacatcgtgcacctggtgagagaccccagagccgtgttcagaagcagagagagaaccaagggcgacctgatgatcgacagcagaatcgtgatgggccagcacgagcagaagctgaagaaggaggaccagccctactacgtgatgcaggtgatctgccagagccagctggagatctacaagaccatccagagcctgcccaaggccctgcaggagagatacctgctggtgagatacgaggacctggccagagcccccgtggcccagaccagcagaatgtacgagttcgtgggcctggagttcctgccccacctgcagacctgggtgcacaacatcaccagaggcaagggcatgggcgaccacgccttccacaccaacgccagagacgccctgaacgtgagccaggcctggagatggagcctgccctacgagaaggtgagcagactgcagaaggcctgcggcgacgccatgaacctgctgggctacagacacgtgagaagcgagcaggagcagagaaacctgctgctggacctgctgagcacctggaccgtgcccgagcagatccactag

SEQ ID NO: 16815 - DNA, 1161 bp, Artificial Sequence; identical to SEQ ID NO: 16814
  Description of Artificial Sequence: Synthetic coding sequence

SEQ ID NO: 16816 - DNA, 918 bp, Artificial Sequence
  Description of Artificial Sequence: Synthetic coding sequence
atgctgggcagaaacacctggaagaccagcgccttcagcttcctggtggagcagatgtgggcccccctgtggagcagaagcatgagacccggcagatggtgcagccagagaagctgcgcctggcagaccagcaacaacaccctgcaccccctgtggaccgtgcccgtgagcgtgcccggcggcaccagacagagccccatcaacatccagtggagagacagcgtgtacgacccccagctgaagcccctgagagtgagctacgaggccgccagctgcctgtacatctggaacaccggctacctgttccaggtggagttcgacgacgccaccgaggccagcggcatcagcggcggccccctggagaaccactacagactgaagcagttccacttccactggggcgccgtgaacgagggcggcagcgagcacaccgtggacggccacgcctaccccgccgagctgcacctggtgcactggaacagcgtgaagtaccagaactacaaggaggccgtggtgggcgagaacggcctggccgtgatcggcgtgttcctgaagctgggcgcccaccaccagaccctgcagagactggtggacatcctgcccgagatcaagcacaaggacgccagagccgccatgagacccttcgaccccagcaccctgctgcccacctgctgggactactggacctacgccggcagcctgaccaccccccccctgaccgagagcgtgacctggatcatccagaaggagcccgtggaggtggcccccagccagctgagcgccttcagaaccctgctgttcagcgccctgggcgaggaggagaagatgatggtgaacaactacagacccctgcagcccctgatgaacagaaaggtgtgggccagcttccaggccaccaacgagggcaccagaagctag

SEQ ID NO: 16817 - DNA, 714 bp, Artificial Sequence
  Description of Artificial Sequence: Synthetic coding sequence
atggacaaggtgtgcgccgtgttcggcggcagcagaggcatcggcagagccgtggcccagctgatggccagaaagggctacagactggccgtgatcgccagaaacctggagggcgccaaggccgccgccggcgacctgggcggcgaccacctggccttcagctgcgacgtggccaaggagcacgacgtgcagaacaccttcgaggagctggagaagcacctgggcagagtgaacttcctggtgaacgccgccggcatcaacagagacggcctgctggtgagaaccaagaccgaggacatggtgagccagctgcacaccaacctgctgggcagcatgctgacctgcaaggccgccatgagaaccatgatccagcagcagggcggcagcatcgtgaacgtgggcagcatcgtgggcctgaagggcaacagcggccagagcgtgtacagcgccagcaagggcggcctggtgggcttcagcagagccctggccaaggaggtggccagaaagaagatcagagtgaacgtggtggcccccggcttcgtgcacaccgacatgaccaaggacctgaaggaggagcacctgaagaagaacatccccctgggcagattcggcgagaccatcgaggtggcccacgccgtggtgttcctgctggagagcccctacatcaccggccacgtgctggtggtggacggcggcctgcagctgatcctgtag

SEQ ID NO: 16818 - DNA, 540 bp, Artificial Sequence
  Description of Artificial Sequence: Synthetic coding sequence
atggacaaggtgtgcgccgtgttcggcggcagcagaggcatcggcagagccgtggcccagctgatggccagaaagggctacagactggccgtgatcgccagaaacctggagggcgccaaggccgccgccggcgacctgggcggcgaccacctggccttcagctgcgacgtggccaaggagcacgacgtgcagaacaccttcgaggagctggagaagcacctgggcagagtgaacttcctggtgaacgccgccggcatcaacagagacggcctgctggtgagaaccaagaccgaggacatggtgagccagctgcacaccaacctgctgggcagcatgctgacctgcaaggccgccatgagaaccatgatccagcagcagggcggcagcatcgtgaacgtgggcagcatcgtgggcctgaagggcaacagcggccagagcgtgtacagcgccagcaagggcggcctggtgggcttcagcagagccctggccaaggaggtggccagaaagaagatcagagtgaacgtggtggcccccggctag

SEQ ID NO: 16819 - DNA, 1872 bp, Artificial Sequence
  Description of Artificial Sequence: Synthetic coding sequence
atgaccgcccagagcagaagccccaccacccccaccttccccggccccagccagagaacccccctgaccccctgccccgtgcagacccccagactgggcaaggccctgatccactgctggaccgaccccggccagcccctgggcgagcagcagagagtgagaagacagagaaccgagaccagcgagcccaccatgagactgcacagactgagagccagactgagcgccgtggcctgcggcctgctgctgctgctggtgagaggccagggccaggacagcgccagccccatcagaaccacccacaccggccaggtgctgggcagcctggtgcacgtgaagggcgccaacgccggcgtgcagaccttcctgggcatccccttcgccaagccccccctgggccccctgagattcgccccccccgagccccccgagagctggagcggcgtgagagacggcaccacccaccccgccatgtgcctgcaggacctgaccgccgtggagagcgagttcctgagccagttcaacatgaccttccccagcgacagcatgagcgaggactgcctgtacctgagcatctacacccccgcccacagccacgagggcagcaacctgcccgtgatggtgtggatccacggcggcgccctggtgttcggcatggccagcctgtacgacggcagcatgctggccgccctggagaacgtggtggtggtgatcatccagtacagactgggcgtgctgggcttcttcagcaccggcgacaagcacgccaccggcaactggggctacctggaccaggtggccgccctgagatgggtgcagcagaacatcgcccacttcggcggcaaccccgacagagtgaccatcttcggcgagagcgccggcggcaccagcgtgagcagcctggtggtgagccccatcagccagggcctgttccacggcgccatcatggagagcggcgtggccctgctgcccggcctgatcgccagcagcgccgacgtgatcagcaccgtggtggccaacctgagcgcctgcgaccaggtggacagcgaggccctggtgggctgcctgagaggcaagagcaaggaggagatcctggccatcaacaagcccttcaagatgatccccggcgtggtggacggcgtgttcctgcccagacacccccaggagctgctggccagcgccgacttccagcccgtgcccagcatcgtgggcgtgaacaacaacgagttcggctggctgatccccaaggtgatgagaatctacgacacccagaaggagatggacagagaggccagccaggccgccctgcagaagatgctgaccctgctgatgctgccccccaccttcggcgacctgctgagagaggagtacatcggcgacaacggcgacccccagaccctgcaggcccagttccaggagatgatggccgacagcatgttcgtgatccccgccctgcaggtggcccacttccagtgcagcagagcccccgtgtacttctacgagttccagcaccagcccagctggctgaagaacatcagacccccccacatgaaggccgaccacggcgacgagctgcccttcgtgttcagaagcttcttcggcggcaactacatcaagttcaccgaggaggaggagcagctgagcagaaagatgatgaagtactgggccaacttcgccagaaacggcaaccccaacggcgagggcctgccccactggcccctgttcgaccaggaggagcagtacctgcagctgaacctgcagcccgccgtgggcagagccctgaaggcccacagactgcagttctggaagaaggccctgccccagaagatccaggagctggaggagcccgaggagagacacaccgagctgtag

SEQ ID NO: 16820 - DNA, 1824 bp, Artificial Sequence
  Description of Artificial Sequence: Synthetic coding sequence
atgaccgcccagagcagaagccccaccacccccaccttccccggccccagccagagaacccccctgaccccctgccccgtgcagacccccagactgggcaaggccctgatccactgctggaccgaccccggccagcccctgggcgagcagcagagagtgagaagacagagaaccgagaccagcgagcccaccatgagactgcacagactgagagccagactgagcgccgtggcctgcggcctgctgctgctgctggtgagaggccagggccaggacagcgccagccccatcagaaccacccacaccggccaggtgctgggcagcctggtgcacgtgaagggcgccaacgccggcgtgcagaccttcctgggcatccccttcgccaagccccccctgggccccctgagattcgccccccccgagccccccgagagctggagcggcgtgagagacggcaccacccaccccgccatgtgcctgcaggacctgaccgccgtggagagcgagttcctgagccagttcaacatgaccttccccagcgacagcatgagcgaggactgcctgtacctgagcatctacacccccgcccacagccacgagggcagcaacctgcccgtgatggtgtggatccacggcggcgccctggtgttcggcatggccagcctgtacgacggcagcatgctggccgccctggagaacgtggtggtggtgatcatccagtacagactgggcgtgctgggcttcttcagcaccggcgacaagcacgccaccggcaactggggctacctggaccaggtggccgccctgagatgggtgcagcagaacatcgcccacttcggcggcaaccccgacagagtgaccatcttcggcgagagcgccggcggcaccagcgtgagcagcctggtggtgagccccatcagccagggcctgttccacggcgccatcatggagagcggcgtggccctgctgcccggcctgatcgccagcagcgccgacgtgatcagcaccgtggtggccaacctgagcgcctgcgaccaggtggacagcgaggccctggtgggctgcctgagaggcaagagcaaggaggagatcctggccatcaacaagcccttcaagatgatccccggcgtggtggacggcgtgttcctgcccagacacccccaggagctgctggccagcgccgacttccagcccgtgcccagcatcgtgggcgtgaacaacaacgagttcggctggctgatccccaaggtgatgagaatctacgacacccagaaggagatggacagagaggccagccaggccgccctgcagaagatgctgaccctgctgatgctgccccccaccttcggcgacctgctgagagaggagtacatcggcgacaacggcgacccccagaccctgcaggcccagttccaggagatgatggccgacagcatgttcgtgatccccgccctgcaggtggcccacttccagtgcagcagagcccccgtgtacttctacgagttccagcaccagcccagctggctgaagaacatcagacccccccacatgaaggccgaccacgtgaagttcaccgaggaggaggagcagctgagcagaaagatgatgaagtactgggccaacttcgccagaaacggcaaccccaacggcgagggcctgccccactggcccctgttcgaccaggaggagcagtacctgcagctgaacctgcagcccgccgtgggcagagccctgaaggcccacagactgcagttctggaagaaggccctgccccagaagatccaggagctggaggagcccgaggagagacacaccgagctgtag

SEQ ID NO: 16821 - DNA, 903 bp, Artificial Sequence
  Description of Artificial Sequence: Synthetic coding sequence
atggagatccccatgggcacccagggctgcttcagcaagagcctgctgctgagcgccagcatcctggtgctgtggatgctgcagggcagccaggccgccctgtacatccagaagatccccgagcagccccagaagaaccaggacctgctgctgagcgtgcagggcgtgcccgacaccttccaggacttcaactggtacctgggcgaggagacctacggcggcaccagactgttcacctacatccccggcatccagagaccccagagagacggcagcgccatgggccagagagacatcgtgggcttccccaacggcagcatgctgctgagaagagcccagcccaccgacagcggcacctaccaggtggccatcaccatcaacagcgagtggaccatgaaggccaagaccgaggtgcaggtggccgagaagaacaaggagctgcccagcacccacctgcccaccaacgccggcatcctggccgccaccatcatcggcagcctggccgccggcgccctgctgatcagctgcatcgcctacctgctggtgaccagaaactggagaggccagagccacagactgcccgcccccagaggccagggcagcctgagcatcctgtgcagcgccgtgagccccgtgcccagcgtgacccccagcacctggatggccaccaccgagaagcccgagctgggccccgcccacgacgccggcgacaacaacatctacgaggtgatgcccagccccgtgctgctggtgagccccatcagcgacaccagaagcatcaaccccgccagacccctgcccacccccccccacctgcaggccgagcccgagaaccaccagtaccagcaggacctgctgaaccccgaccccgccccctactgccagctggtgcccaccagctag

SEQ ID NO: 16822 - DNA, 900 bp, Artificial Sequence
  Description of Artificial Sequence: Synthetic coding sequence
atggagatccccatgggcacccagggctgcttcagcaagagcctgctgctgagcgccagcatcctggtgctgtggatgctgcagggcagccaggccgccctgtacatccagaagatccccgagcagccccagaagaaccaggacctgctgctgagcgtgcagggcgtgcccgacaccttccaggacttcaactggtacctgggcgaggagacctacggcggcaccagactgttcacctacatccccggcatccagagaccccagagagacggcagcgccatgggccagagagacatcgtgggcttccccaacggcagcatgctgctgagaagagcccagcccaccgacagcggcacctaccaggtggccatcaccatcaacagcgagtggaccatgaaggccaagaccgaggtgcaggtggccgagaagaacaaggagctgcccagcacccacctgcccaccaacgccggcatcctggccgccaccatcatcggcagcctggccgccggcgccctgctgatcagctgcatcgcctacctgctggtgaccagaaactggagaggccagagccacagactgcccgcccccagaggccagggcagcctgagcatcctgtgcagcgccgtgagccccgtgcccagcgtgacccccagcacctggatggccaccaccgagaagcccgagctgggccccgcccacgacgccggcgacaacaacatctacgaggtgatgcccagccccgtgctgctggtgagccccatcagcgacaccagaagcatcaaccccgccagacccctgcccacccccccccacctgcaggccgagcccgagaaccaccagtaccaggacctgctgaaccccgaccccgccccctactgccagctggtgcccaccagctag

SEQ ID NO: 16823 - DNA, 879 bp, Artificial Sequence
  Description of Artificial Sequence: Synthetic coding sequence
atgggcccccccagcgcctgcccccacagagagtgcatcccctggcagggcctgctgctgaccgccagcctgctgaccttctggaacgcccccaccaccgcctggctgttcatcgccagcgcccccttcgaggtggccgagggcgagaacgtgcacctgagcgtggtgtacctgcccgagaacctgtacagctacggctggtacaagggcaagaccgtggagcccaaccagctgatcgccgcctacgtgatcgacacccacgtgagaacccccggccccgcctacagcggcagagagaccatcagccccagcggcgacctgcacttccagaacgtgaccctggaggacaccggctactacaccctgcaggtgacctacagaaacagccagatcgagcaggccagccaccacctgagagtgtacgagagcgtggcccagcccagcatccaggccagcagcaccaccgtgaccgagaagggcagcgtggtgctgacctgccacaccaacaacaccggcaccagcttccagtggatcttcaacaaccagagactgcaggtgaccaagagaatgaagctgagctggttcaaccacatgctgaccatcgaccccatcagacaggaggacgccggcgagtaccagtgcgaggtgagcaaccccgtgagcagcaacagaagcgaccccctgaagctgaccgtgaagtacgacaacaccctgggcatcctgatcggcgtgctggtgggcagcctgctggtggccgccctggtgtgcttcctgctgctgagaaagaccggcagagccagcgaccagagcgacttcagagagcagcagccccccgccagcacccccggccacggccccagcgacagcagcatcagctag

SEQ ID NO: 16824 - DNA, 882 bp, Artificial Sequence
  Description of Artificial Sequence: Synthetic coding sequence
atgggcccccccagcgcctgcccccacagagagtgcatcccctggcagggcctgctgctgaccgccagcctgctgaccttctggaacgcccccaccaccgcctggctgttcatcgccagcgcccccttcgaggtggccgagggcgagaacgtgcacctgagcgtggtgtacctgcccgagaacctgtacagctacggctggtacaagggcaagaccgtggagcccaaccagctgatcgccgcctacgtgatcgacacccacgtgagaacccccggccccgcctacagcggcagagagaccatcagccccagcggcgacctgcacttccagaacgtgaccctggaggacaccggctactacaccctgcaggtgacctacagaaacagccagatcgagcaggccagccaccacctgagagtgtacgagagcgtggcccagcccagcatccaggccagcagcaccaccgtgaccgagaagggcagcgtggtgctgacctgccacaccaacaacaccggcaccagcttccagtggatcttcaacaaccagagactgcaggtgaccaagagaatgaagctgagctggttcaaccacatgctgaccatcgaccccatcagacaggaggacgccggcgagtaccagtgcgaggtgagcaaccccgtgagcagcaacagaagcgaccccctgaagctgaccgtgaagagcgacgacaacaccctgggcatcctgatcggcgtgctggtgggcagcctgctggtggccgccctggtgtgcttcctgctgctgagaaagaccggcagagccagcgaccagagcgacttcagagagcagcagccccccgccagcacccccggccacggccccagcgacagcagcatcagctag

SEQ ID NO: 16825 - DNA, 900 bp, Artificial Sequence
  Description of Artificial Sequence: Synthetic coding sequence
atgatggcctacatgaaccccggcccccactacagcgtgaacgccctggccctgagcggccccagcgtggacctgatgcaccaggccgtgccctaccccagcgcccccagaaagcagagaagagagagaaccaccttcaccagaagccagctggaggagctggaggccctgttcgccaagacccagtaccccgacgtgtacgccagagaggaggtggccctgaagatcaacctgcccgagagcagagtgcaggtgtggttcaagaacagaagagccaagtgcagacagcagagacagcagcagaagcagcagcagcagccccccggcggccaggccaaggccagacccgccaagagaaaggccggcaccagccccagacccagcaccgacgtgtgccccgaccccctgggcatcagcgacagctacagcccccccctgcccggccccagcggcagccccaccaccgccgtggccaccgtgagcatctggagccccgccagcgagagccccctgcccgaggcccagagagccggcctggtggccagcggccccagcctgaccagcgccccctacgccatgacctacgcccccgccagcgccttctgcagcagccccagcgcctacggcagccccagcagctacttcagcggcctggacccctacctgagccccatggtgccccagctgggcggccccgccctgagccccctgagcggccccagcgtgggccccagcctggcccagagccccaccagcctgagcggccagagctacggcgcctacagccccgtggacagcctggagttcaaggaccccaccggcacctggaagttcacctacaaccccatggaccccctggactacaaggaccagagcgcctggaagttccagatcctgtag

SEQ ID NO: 16826 - DNA, 639 bp, Artificial Sequence
  Description of Artificial Sequence: Synthetic coding sequence
atgggcccccccagcgccagcccccacagagagtgcatcccctggcagggcctgctgctgaccgccagcctgctgaacttctggaacccccccaccaccgccaagctgaccatcgagagcatgcccctgagcgtggccgagggcaaggaggtgctgctgctggtgcacaacctgccccagcacctgttcggctacagctggtacaagggcgagagagtggacggcaacagcctgatcgtgggctacgtgatcggcacccagcaggccacccccggcgccgcctacagcggcagagagaccatctacaccaacgccagcctgctgatccagaacgtgacccagaacgacatcggcttctacaccctgcaggtgatcaagagcgacctggtgaacgaggaggccaccggccagttccacgtgtaccaggagaacgcccccggcctgcccgtgggcgccgtggccggcatcgtgaccggcgtgctggtgggcgtggccctggtggccgccctggtgtgcttcctgctgctggccaagaccggcagaccctggagcctgccccagctgtgcctgctggacgtgcccagcctgcactgccccggcccccccacccagccccaggacagcagcttccacctgtag

SEQ ID NO: 16827 - DNA, 759 bp, Artificial Sequence
  Description of Artificial Sequence: Synthetic coding sequence
atgggcccccccagcgccagcccccacagagagtgcatcccctggcagggcctgctgctgaccgccagcctgctgaacttctggaacccccccaccaccgccaagctgaccatcgagagcatgcccctgagcgtggccgagggcaaggaggtgctgctgctggtgcacaacctgccccagcacctgttcggctacagctggtacaagggcgagagagtggacggcaacagcctgatcgtgggctacgtgatcggcacccagcaggccacccccggcgccgcctacagcggcagagagaccatctacaccaacgccagcctgctgatccagaacgtgacccagaacgacatcggcttctacaccctgcaggtgatcaagagcgacctggtgaacgaggaggccaccggccagttccacgtgtaccaggagaacgcccccggcctgcccgtgggcgccgtggccggcatcgtgaccggcgtgctggtgggcgtggccctggtggccgccctggtgtgcttcctgctgctggccaagaccggcagaaccagcatccagagagacctgaaggagcagcagccccaggccctggcccccggcagaggccccagccacagcagcgccttcagcatgagccccctgagcaccgcccaggcccccctgcccaaccccagaaccgccgccagcatctacgaggagctgctgaagcacgacaccaacatctactgcagaatggaccacaaggccgaggtggccagctag

SEQ ID NO: 16828 - DNA, 534 bp, Artificial Sequence
  Description of Artificial Sequence: Synthetic coding sequence
atgggcccccccagcgccagcccccacagagagtgcatcccctggcagggcctgctgctgaccgccagcctgctgaacttctggaacccccccaccaccgccaagctgaccatcgagagcatgcccctgagcgtggccgagggcaaggaggtgctgctgctggtgcacaacctgccccagcacctgttcggctacagctggtacaagggcgagagagtggacggcaacagcctgatcgtgggctacgtgatcggcacccagcaggccacccccggcgccgcctacagcggcagagagaccatctacaccaacgccagcctgctgatccagaacgtgacccagaacgacatcggcttctacaccctgcaggtgatcaagagcgacctggtgaacgaggaggccaccggccagttccacgtgtaccccgagctgcccaagcccagcatcagcagcaacaacagcaaccccaaggaggacaaggacgccgtggccttcacctgcgagcccgagatccacagcaccacctgcctgtag

SEQ ID NO: 16829 - DNA, 774 bp, Artificial Sequence
  Description of Artificial Sequence: Synthetic coding sequence
atggccgccccctgggccagcctgagactggtggcccccatgtggaacggcagaatcagaggcatccacagactgggcgccgccgtggcccccgagggcaaccagaagaagaagagaaccatcctgcagttcctgaccaactacttctacgacgtggaggccctgagagactacctgctgcagagagagatgtacaaggtgcacgagaagaacagaagctacacctggctggagaagcagcacggcccctacggcgccggcgccttcttcatcctgaagcagggcggcgccgtgaagttcagagacaaggagtggatcagacccgacaagtacggccacttcagccaggagttctggaacttctgcgaggtgcccgtggaggccgtggacgccggcgactgcgacatcaactacgagggcctggacaacctgctgagactgaaggagctgcagagcctgagcctgcagagatgctgccacgtggacgactggtgcctgagcagactgtaccccctggccgacagcctgcaggagctgagcctggccggctgccccagaatcagcgagagaggcctggcctgcctgcaccacctgcagaacctgagaagactggacatcagcgacctgcccgccgtgagcaaccccggcctgacccagatcctggtggaggagatgctgcccaactgcgaggtggtgggcgtggactgggccgagggcctgaagagcggccccgaggagcagcccagagacaccgccagccccgtgcccgcctag

SEQ ID NO: 16830 - DNA, 798 bp, Artificial Sequence
  Description of Artificial Sequence: Synthetic coding sequence
atgggcagccccagcgcctgcccctacagagtgtgcatcccctggcagggcctgctgctgaccgccagcctgctgaccttctggaacctgcccaacagcgcccagaccaacatcgacgtggtgcccttcaacgtggccgagggcaaggaggtgctgctggtggtgcacaacgagagccagaacctgtacggctacaactggtacaagggcgagagagtgcacgccaactacagaatcatcggctacgtgaagaacatcagccaggagaacgcccccggccccgcccacaacggcagagagaccatctaccccaacggcaccctgctgatccagaacgtgacccacaacgacgccggcttctacaccctgcacgtgatcaaggagaacctggtgaacgaggaggtgaccagacagttctacgtgttcagcgagccccccaagcccagcatcaccagcaacaacttcaaccccgtggagaacaaggacatcgtggtgctgacctgccagcccgagacccagaacaccacctacctgtggtgggtgaacaaccagagcctgctggtgagccccagactgctgctgagcaccgacaacagaaccctggtgctgctgagcgccaccaagaacgacatcggcccctacgagtgcgagatccagaaccccgtgggcgccagcagaagcgaccccgtgaccctgaacgtgagatacgagagcgtgcaggccagcagccccgacctgagcgccggcaccgccgtgagcatcatgatcggcgtgctggccggcatggccctgatctag

SEQ ID NO: 16831 - DNA, 519 bp, Artificial Sequence
  Description of Artificial Sequence: Synthetic coding sequence
atgggcagccccagcgcctgcccctacagagtgtgcatcccctggcagggcctgctgctgaccgccagcctgctgaccttctggaacctgcccaacagcgcccagaccaacatcgacgtggtgcccttcaacgtggccgagggcaaggaggtgctgctggtggtgcacaacgagagccagaacctgtacggctacaactggtacaagggcgagagagtgcacgccaactacagaatcatcggctacgtgaagaacatcagccaggagaacgcccccggccccgcccacaacggcagagagaccatctaccccaacggcaccctgctgatccagaacgtgacccacaacgacgccggcttctacaccctgcacgtgatcaaggagaacctggtgaacgaggaggtgaccagacagttctacgtgttctacgagagcgtgcaggccagcagccccgacctgagcgccggcaccgccgtgagcatcatgatcggcgtgctggccggcatggccctgatctag

SEQ ID NO: 16832 - DNA, 798 bp, Artificial Sequence; identical to SEQ ID NO: 16830
  Description of Artificial Sequence: Synthetic coding sequence

SEQ ID NO: 16833 - DNA, 735 bp, Artificial Sequence
  Description of Artificial Sequence: Synthetic coding sequence
atgggcagccccagcgcctgcccctacagagtgtgcatcccctggcagggcctgctgctgaccgccagcctgctgaccttctggaacctgcccaacagcgcccagaccaacatcgacgtggtgcccttcaacgtggccgagggcaaggaggtgctgctggtggtgcacaacgagagccagaacctgtacggctacaactggtacaagggcgagagagtgcacgccaacggcagagagaccatctaccccaacggcaccctgctgatccagaacgtgacccacaacgacgccggcttctacaccctgcacgtgatcaaggagaacctggtgaacgaggaggtgaccagacagttctacgtgttcagcgagccccccaagcccagcatcaccagcaacaacttcaaccccgtggagaacaaggacatcgtggtgctgacctgccagcccgagacccagaacaccacctacctgtggtgggtgaacaaccagagcctgctggtgagccccagactgctgctgagcaccgacaacagaaccctggtgctgctgagcgccaccaagaacgacatcggcccctacgagtgcgagatccagaaccccgtgggcgccagcagaagcgaccccgtgaccctgaacgtgagatacgagagcgtgcaggccagcagccccgacctgagcgccggcaccgccgtgagcatcatgatcggcgtgctggccggcatggccctgatctag

SEQ ID NO: 16834 - DNA, 2361 bp, Artificial Sequence
  Description of Artificial Sequence: Synthetic coding sequence
atgaagggcaccggcatcatggactgcgcccccaaggccctgctggccagagccctgtacgacaactgccccgactgcagcgacgagctggccttcagcagaggcgacatcctgaccatcctggagcagcacgtgcccgagagcgagggctggtggaagtgcctgctgcacggcagacagggcctggcccccgccaacagactgcagatcctgaccgaggtggccgccgacagaccctgcccccccttcctgagaggcctggaggaggcccccgccagcagcgaggagacctaccaggtgcccaccctgcccagaccccccacccccggccccgtgtacgagcagatgagaagctgggccgagggcccccagccccccaccgcccaggtgtacgagttccccgacccccccaccagcgccagaatcatctgcgagaagaccctgagcttccccaagcaggccatcctgaccctgcccagacccgtgagagccagcctgcccaccctgcccagccaggtgtacgacgtgcccacccagcacagaggccccgtggtgctgaaggagcccgagaagcagcagctgtacgacatccccgccagccccaagaaggccggcctgcacccccccgacagccaggccagcggccagggcgtgcccctgatcagcgtgaccaccctgagaagaggcggctacagcaccctgcccaacccccagaagagcgagtggatctacgacacccccgtgagccccggcaaggccagcgtgagaaacacccccctgaccagcttcgccgaggagagcagaccccacgccctgcccagcagcagcagcaccttctacaacccccccagcggcagaagcagaagcctgaccccccagctgaacaacaacgtgcccatgcagaagaagctgagcctgcccgagatccccagctacggcttcctggtgcccagaggcaccttccccctggacgaggacgtgagctacaaggtgcccagcagcttcctgatccccagagtggagcagcagaacaccaagcccaacatctacgacatccccaaggccaccagcagcgtgagccaggccggcaaggagctggagaaggccaaggaggtgagcgagaacagcgccggccacaacagcagctggttcagcagaagaaccaccagccccagccccgagcccgacagactgagcggcagcagcagcgacagcagagccagcatcgtgagcagctgcagcaccaccagcaccgacgacagcagcagcagcagcagcgaggagagcgccaaggagctgagcctggacctggacgtggccaaggagaccgtgatggccctgcagcacaaggtggtgagcagcgtggccggcctgatgctgttcgtgagcagaaagtggagattcagagactacctggaggccaacatcgacgccatccacagaagcaccgaccacatcgaggagagcgtgagagagttcctggacttcgccagaggcgtgcacggcaccgcctgcaacctgaccgacagcaacctgcagaacagaatcagagaccagatgcagaccatcagcaacagctacagaatcctgctggagaccaaggagagcctggacaacagaaactggcccctggaggtgctggtgaccgacagcgtgcagaacagccccgacgacctggagagattcgtgatggtggccagaatgctgcccgaggacatcaagagattcgccagcatcgtgatcgccaacggcagactgctgttcaagagaaactgcgagaaggaggagaccgtgcagctgacccccaacgccgagttcaagtgcgagaagtacatccagcccccccagagagagaccgagagccaccagaagagcacccccagcaccaagcagagagaggacgagcacagcagcgagctgctgaagaagaacagagccaacatctgcggccagaaccccggccccctgatcccccagcccagcagccagcagacccccgagagaaagcccagactgagcgagcactgcagactgtacttcggcgccctgttcaaggccatcagcgccttccacggcagcctgagcagcagccagcccgccgagatcatcacccagagcaagctggtgatcatggtgggccagaagctggtggacaccctgtgcatggagacccaggagagagacgtgagaaacgagatcctgagaggcagcagccacctgtgcagcctgctgaaggacgtggccctggccaccaagaacgccgtgctgacctaccccagccccgccgccctgggccacctgcaggccgaggccgagaagctggagcagcacaccagacagttcagaggcaccctgggctag

SEQ ID NO: 16835 - DNA, 2361 bp, Artificial Sequence; identical to SEQ ID NO: 16834
  Description of Artificial Sequence: Synthetic coding sequence

SEQ ID NO: 16836 - DNA, 1050 bp, Artificial Sequence
  Description of Artificial Sequence: Synthetic coding sequence
atgaagggcaccggcatcatggactgcgcccccaaggccctgctggccagagccctgtacgacaactgccccgactgcagcgacgagctggccttcagcagaggcgacatcctgaccatcctggagcagcacgtgcccgagagcgagggctggtggaagtgcctgctgcacggcagacagggcctggcccccgccaacagactgcagatcctgaccgaggtggccgccgacagaccctgcccccccttcctgagaggcctggaggaggcccccgccagcagcgaggagacctaccaggtgcccaccctgcccagaccccccacccccggccccgtgtacgagcagatgagaagctgggccgagggcccccagccccccaccgcccaggtgtacgagttccccgacccccccaccagcgccagaatcatctgcgagaagaccctgagcttccccaagcaggccatcctgaccctgcccagacccgtgagagccagcctgcccaccctgcccagccaggtgtacgacgtgcccacccagcacagaggccccgtggtgctgaaggagcccgagaagcagcagctgtacgacatccccgccagccccaagaaggccggcctgcacccccccgacagccaggccagcaaccccggccccctgatcccccagcccagcagccagcagacccccgagagaaagcccagactgagcgagcactgcagactgtacttcggcgccctgttcaaggccatcagcgccttccacggcagcctgagcagcagccagcccgccgagatcatcacccagagcaagctggtgatcatggtgggccagaagctggtggacaccctgtgcatggagacccaggagagagacgtgagaaacgagatcctgagaggcagcagccacctgtgcagcctgctgaaggacgtggccctggccaccaagaacgccgtgctgacctaccccagccccgccgccctgggccacctgcaggccgaggccgagaagctggagcagcacaccagacagttcagaggcaccctgggctag

SEQ ID NO: 16837 - DNA, 687 bp, Artificial Sequence
  Description of Artificial Sequence: Synthetic coding sequence
atgagcagcagcgaggaggtgagctggatcagctggttctgcggcctgagaggcaacgagttcttctgcgaggtggacgaggactacatccaggacaagttcaacctgaccggcctgaacgagcaggtgccccactacagacaggccctggacatgatcctggacctggagcccgacgaggagctggaggacaaccccaaccagagcgacctgatcgagcaggccgccgagatgctgtacggcctgatccacgccagatacatcctgaccaacagaggcatcgcccagatgctggagaagtaccagcagggcgacttcggctactgccccagagtgtactgcgagaaccagcccatgctgcccatcggcctgagcgacatccccggcgaggccatggtgaagctgtactgccccaagtgcatggacgtgtacacccccaagagcagcagacaccaccacaccgacggcgcctacttcggcaccggcttcccccacatgctgttcatggtgcaccccgagtacagacccaagagacccgccaaccagttcgtgcccagcagctgcagcagacaccccgacgtgcccctgctgcccagaagaagacccttctgcagaatgcacttcagactgagagaggtgtaccaccagcagctgatccccgtgcacggcgaccaccacctgctgtag

SEQ ID NO: 16838 - DNA, 1182 bp, Artificial Sequence
  Description of Artificial Sequence: Synthetic coding sequence
atgtacgcctggttcttcctgcccagcttcagccagagcccccccaccttcggcttcctgctggacatcgacggcgtgctggtgagaggccacagagtgatccccgccgccctgaaggccttcagaagactggtgaacagccagggccagctgagagtgcccgtggtgttcgtgaccaacgccggcaacatcctgcagcacagcaaggcccaggagctgagcgccctgctgggctgcgaggtggacgccgaccaggtgatcctgagccacagccccatgaagctgttcagcgagtaccacgagaagagaatgctggtgagcggccagggccccgtgatggagaacgcccagggcctgggcttcagaaacgtggtgaccgtggacgagctgagaatggccttccccctgctggacatggtggacctggagagaagactgaagaccacccccctgcccagaaacgacttccccagaatcgagggcgtgctgctgctgggcgagcccgtgagatgggagaccagcctgcagctgatcatggacgtgctgctgagcaacggcagccccggcgccggcctggccacccccccctacccccacctgcccgtgctggccagcaacatggacctgctgtggatggccgaggccaagatgcccagattcggccacggcaccttcctgctgtgcctggagaccatctaccagaaggtgaccggcaaggagctgagatacgagggcctgatgggcaagcccagcatcctgacctaccagtacgccgaggacctgatcagaagacaggccgagagaagaggctgggccgcccccatcagaaagctgtacgccgtgggcgacaaccccatgagcgacgtgtacggcgccaacctgttccaccagtacctgcagaaggccacccacgacggcgcccccgagctgggcgccggcggcaccagacagcagcagcccagcgccagccagagctgcatcagcatcctggtgtgcaccggcgtgtacaaccccagaaacccccagagcaccgagcccgtgctgggcggcggcgagccccccttccacggccacagagacctgtgcttcagccccggcctgatggaggccagccacgtggtgaacgacgtgaacgaggccgtgcagctggtgttcagaaaggagggctgggccctggagtag

SEQ ID NO: 16839 - DNA, 1272 bp, Artificial Sequence
  Description of Artificial Sequence: Synthetic coding sequence
atggccgcctggggctgcgtggccgccctgggcgccgccagaggcctgtgctggagagccgccagagccgccgccggcctgcagggcagacccgccagaagatgctacgccgtgggccccgcccagagcccccccaccttcggcttcctgctggacatcgacggcgtgctggtgagaggccacagagtgatccccgccgccctgaaggccttcagaagactggtgaacagccagggccagctgagagtgcccgtggtgttcgtgaccaacgccggcaacatcctgcagcacagcaaggcccaggagctgagcgccctgctgggctgcgaggtggacgccgaccaggtgatcctgagccacagccccatgaagctgttcagcgagtaccacgagaagagaatgctggtgagcggccagggccccgtgatggagaacgcccagggcctgggcttcagaaacgtggtgaccgtggacgagctgagaatggccttccccctgctggacatggtggacctggagagaagactgaagaccacccccctgcccagaaacgacttccccagaatcgagggcgtgctgctgctgggcgagcccgtgagatgggagaccagcctgcagctgatcatggacgtgctgctgagcaacggcagccccggcgccggcctggccacccccccctacccccacctgcccgtgctggccagcaacatggacctgctgtggatggccgaggccaagatgcccagattcggccacggcaccttcctgctgtgcctggagaccatctaccagaaggtgaccggcaaggagctgagatacgagggcctgatgggcaagcccagcatcctgacctaccagtacgccgaggacctgatcagaagacaggccgagagaagaggctgggccgcccccatcagaaagctgtacgccgtgggcgacaaccccatgagcgacgtgtacggcgccaacctgttccaccagtacctgcagaaggccacccacgacggcgcccccgagctgggcgccggcggcaccagacagcagcagcccagcgccagccagagctgcatcagcatcctggtgtgcaccggcgtgtacaaccccagaaacccccagagcaccgagcccgtgctgggcggcggcgagccccccttccacggccacagagacctgtgcttcagccccggcctgatggaggccagccacgtggtgaacgacgtgaacgaggccgtgcagctggtgttcagaaaggagggctgggccctggagtag

SEQ ID NO: 16840 - DNA, 789 bp, Artificial Sequence
  Description of Artificial Sequence: Synthetic coding sequence
atgacccagcccgtgcccagactgagcgtgcccgccgccctggccctgggcagcgccgccctgggcgccgccttcgccaccggcctgttcctgggcagaagatgccccccctggagaggcagaagagagcagtgcctgctgccccccgaggacagcagactgtggcagtacctgctgagcagaagcatgagagagcaccccgccctgagaagcctgagactgctgaccctggagcagccccagggcgacagcatgatgacctgcgagcaggcccagctgctggccaacctggccagactgatccaggccaagaaggccctggacctgggcaccttcaccggctacagcgccctggccctggccctggccctgcccgccgacggcagagtggtgacctgcgaggtggacgcccagccccccgagctgggcagacccctgtggagacaggccgaggccgagcacaagatcgacctgagactgaagcccgccctggagaccctggacgagctgctggccgccggcgaggccggcaccttcgacgtggccgtggtggacgccgacaaggagaactgcagcgcctactacgagagatgcctgcagctgctgagacccggcggcatcctggccgtgctgagagtgctgtggagaggcaaggtgctgcagccccccaagggcgacgtggccgccgagtgcgtgagaaacctgaacgagagaatcagaagagacgtgagagtgtacatcagcctgctgcccctgggcgacggcctgaccctggccttcaagatctag

SEQ ID NO: 16841 - DNA, 864 bp, Artificial Sequence
  Description of Artificial Sequence: Synthetic coding sequence
atgacccagcccgtgcccagactgagcgtgcccgccgccctggccctgggcagcgccgccctgggcgccgccttcgccaccggcctgttcctgggcagaagatgccccccctggagaggcagaagagagcagtgcctgctgccccccgaggacagcagactgtggcagtacctgctgagcagaagcatgagagagcaccccgccctgagaagcctgagactgctgaccctggagcagccccagggcgacagcatgatgacctgcgagcaggcccagctgctggccaacctggccagactgatccaggccaagaaggccctggacctgggcaccttcaccggctacagcgccctggccctggccctggccctgcccgccgacggcagagtggtgacctgcgaggtggacgccggcagaggcggcgcccaggacagaccccccgccgaggccagactgggcgaccccggcagagccgccggcggcggcagaggcagacacctgagaagaggcagaggcggctgcggccagggcgagctgctgagactgctgagagccctgcccgccgccgccgccaccagaagacaccccagaagaccccagagccccgtggccagagagggcgccgccaccagcgagagaggcagaggcggcagagtgtgcgccaagcccaagagaacccaccccgccggcagacagggcctgcaccagccccccgcccccggcagatggacccacctgggcctgcaggacctgggcctggcccccagcgagtgggccagaggcagagtggcctgggagccccaggagctgaccctgagcttcaagttcgagaacaaggtgggcctgggccacaccaccagctag

SEQ ID NO: 16842 - DNA, 966 bp, Artificial Sequence
  Description of Artificial Sequence: Synthetic coding sequence
atggacgtgagagccctgccctggctgccctggctgctgtggctgctgtgcagaggcggcggcgacgccgacagcagagcccccttcacccccacctggcccagaagcagagagagagaggccgccgccttcagagagagcctgaacagacacagatacctgaacagcctgttccccagcgagaacagcaccgccttctacggcatcaaccagttcagctacctgttccccgaggagttcaaggccatctacctgagaagcaagcccagcaagttccccagatacagcgccgaggtgcacatgagcatccccaacgtgagcctgcccctgagattcgactggagagacaagcaggtggtgacccaggtgagaaaccagcagatgtgcggcggctgctgggccttcagcgtggtgggcgccgtggagagcgcctacgccatcaagggcaagcccctggaggacctgagcgtgcagcaggtgatcgactgcagctacaacaactacggctgcaacggcggcagcaccctgaacgccctgaactggctgaacaagatgcaggtgaagctggtgaaggacagcgagtaccccttcaaggcccagaacggcctgtgccactacttcagcggcagccacagcggcttcagcatcaagggctacagcgcctacgacttcagcgaccaggaggacgagatggccaaggccctgctgaccttcggccccctggtggtgatcgtggacgccgtgagctggcaggactacctgggcggcatcatccagcaccactgcagcagcggcgaggccaaccacgccgtgctgatcaccggcttcgacaagaccggcagcaccccctactggatcgtgagaaacagctggggcagcagctggggcgtggacggctacgcccacgtgaagatgggcagcaacgtgtgcggcatcgccgacagcgtgagcagcatcttcgtgtag

SEQ ID NO: 16843 - DNA, 1593 bp, Artificial Sequence
  Description of Artificial Sequence: Synthetic coding sequence
atggccgcctaccagcaggaggagcagatgcagctgcccagagccgacgccatcagaagcagactgatcgacaccttcagcctgatcgagcacctgcagggcctgagccaggccgtgcccagacacaccatcagagagctgctggaccccagcagacagaagaagctggtgctgggcgaccagcaccagctggtgagattcagcatcaagccccagagaatcgagcagatcagccacgcccagagactgctgagcagactgcacgtgagatgcagccagagaccccccctgagcctgtgggccggctgggtgctggagtgccccctgttcaagaacttcatcatcttcctggtgttcctgaacaccatcatcctgatggtggagatcgagctgctggagagcaccaacaccaagctgtggcccctgaagctgaccctggaggtggccgcctggttcatcctgctgatcttcatcctggagatcctgctgaagtggctgagcaacttcagcgtgttctggaagagcgcctggaacgtgttcgacttcgtggtgaccatgctgagcctgctgcccgaggtggtggtgctggtgggcgtgaccggccagagcgtgtggctgcagctgctgagaatctgcagagtgctgagaagcctgaagctgctggcccagttcagacagatccagatcatcatcctggtgctggtgagagccctgaagagcatgaccttcctgctgatgctgctgctgatcttcttctacatcttcgccgtgaccggcgtgtacgtgttcagcgagtacaccagaagccccagacaggacctggagtaccacgtgttcttcagcgacctgcccaacagcctggtgaccgtgttcatcctgttcaccctggaccactggtacgccctgctgcaggacgtgtggaaggtgcccgaggtgagcagaatcttcagcagcatctacttcatcctgtggctgctgctgggcagcatcatcttcagaagcatcatcgtggccatgatggtgaccaacttccagaacatcagaaaggagctgaacgaggagatggccagaagagaggtgcagctgaaggccgacatgttcaagagacagatcatccagagaagaaagaacatgagccacgaggccctgaccagcagccacagcaagatcgaggacagcagcagaggcgccagccagcagagagagagcctggacctgagcgaggtgagcgaggtggagagcaactacggcgccaccgaggaggacctgatcaccagcgccagcaagaccgaggagaccctgagcaagaagagagagtaccagagcagcagctgcgtgagcagcaccagcagcagctacagcagcagcagcgagagcagattcagcgagagcatcggcagactggactgggagaccctggtgcacgagaacctgcccggcctgatggagatggaccaggacgacagagtgtggcccagagacagcctgttcagatacttcgagctgctggagaagctgcagtacaacctggaggagagaaagaagctgcaggagttcgccgtgcaggccctgatgaacctggaggacaagtag

SEQ ID NO: 16844 - DNA, 1593 bp, Artificial Sequence; identical to SEQ ID NO: 16843
  Description of Artificial Sequence: Synthetic coding sequence

SEQ ID NO: 16845 - DNA, 1587 bp, Artificial Sequence
  Description of Artificial Sequence: Synthetic coding sequence
atggccgcctaccagcaggaggagcagatgcagctgcccagagccgacgccatcagaagcagactgatcgacaccttcagcctgatcgagcacctgcagggcctgagccaggccgtgcccagacacaccatcagagagctgctggaccccagcagacagaagaagctggtgctgggcgaccagcaccagctggtgagattcagcatcaagccccagagaatcgagcagatcagccacgcccagagactgctgagcagactgcacgtgagatgcagccagagaccccccctgagcctgtgggccggctgggtgctggagtgccccctgttcaagaacttcatcatcttcctggtgttcctgaacaccatcatcctgatggtggagatcgagctgctggagagcaccaacaccaagctgtggcccctgaagctgaccctggaggtggccgcctggttcatcctgctgatcttcatcctggagatcctgctgaagtggctgagcaacttcagcgtgttctggaagagcgcctggaacgtgttcgacttcgtggtgaccatgctgagcctgctgcccgaggtggtggtgctggtgggcgtgaccggccagagcgtgtggctgcagctgctgagaatctgcagagtgctgagaagcctgaagctgctggcccagttcagacagatccagatcatcatcctggtgctggtgagagccctgaagagcatgaccttcctgctgatgctgctgctgatcttcttctacatcttcgccgtgaccggcgtgtacgtgttcagcgagtacaccagaagccccagacaggacctggagtaccacgtgttcttcagcgacctgcccaacagcctggtgaccgtgttcatcctgttcaccctggaccactggtacgccctgctgcaggacgtgtggaaggtgcccgaggtgagcagaatcttcagcagcatctacttcatcctgtggctgctgctgggcagcatcatcttcagaagcatcatcgtggccatgatggtgaccaacttccagaacatcagaaaggagctgaacgaggagatggccagaagagaggtgcagctgaaggccgacatgttcaagagacagatcatccagagaagaaagaacatgagccacgaggccctgaccagcagccacagcaagatcgaggacagaggcgccagccagcagagagagagcctggacctgagcgaggtgagcgaggtggagagcaactacggcgccaccgaggaggacctgatcaccagcgccagcaagaccgaggagaccctgagcaagaagagagagtaccagagcagcagctgcgtgagcagcaccagcagcagctacagcagcagcagcgagagcagattcagcgagagcatcggcagactggactgggagaccctggtgcacgagaacctgcccggcctgatggagatggaccaggacgacagagtgtggcccagagacagcctgttcagatacttcgagctgctggagaagctgcagtacaacctggaggagagaaagaagctgcaggagttcgccgtgcaggccctgatgaacctggaggacaagtag

SEQ ID NO: 16846 - DNA, 1245 bp, Artificial Sequence
  Description of Artificial Sequence: Synthetic coding sequence
atggccgcctaccagcaggaggagcagatgcagctgcccagagccgacgccatcagaagcagactgatcgacaccttcagcctgatcgagcacctgcagggcctgagccaggccgtgcccagacacaccatcagagagctgctggaccccagcagacagaagaagctggtgctgggcgaccagcaccagctggtgagattcagcatcaagccccagagaatcgagcagatcagccacgcccagagactgctgagcagactgcacgtgagatgcagccagagaccccccctgagcctgtgggccggctgggtgctggagtgccccctgttcaagaacttcatcatcttcctggtgttcctgaacaccatcatcctgatggtggagatcgagctgctggagagcaccaacaccaagctgtggcccctgaagctgaccctggaggtggccgcctggttcatcctgctgatcttcatcctggagatcctgctgaagtggctgagcaacttcagcgtgttctggaagagcgcctggaacgtgttcgacttcgtggtgaccatgctgagcctgctgcccgaggtggtggtgctggtgggcgtgaccggccagagcgtgtggctgcagctgctgagaatctgcagagtgctgagaagcctgaagctgctggcccagttcagacagatccagatcatcatcctggtgctggtgagagccctgaagagcatgaccttcctgctgatgctgctgctgatcttcttctacatcttcgccgtgaccggcgtgtacgtgttcagcgagtacaccagaagccccagacaggacctggagtaccacgtgttcttcagcgacctgcccaacagcctggtgaccgtgttcatcctgttcaccctggaccactggtacgccctgctgcaggacgtgtggaaggtgcccgaggtgagcagaatcttcagcagcatctacttcatcctgtggctgctgctgggcagcatcatcttcagaagcatcatcgtggccatgatggtgaccaacttccagaacatcagaaaggagctgaacgaggagatggccagaagagaggtgcagctgaaggccgacatgttcaagagacagatcatccagagaagaaagaacatgagccacgaggccctgaccagcagccacagcaagatcgaggacagaagcttcggcctgggcgacagctgcgccagaaagagcgccagagccaacggcaacggcagcggctag

SEQ ID NO: 16847 - DNA, 1587 bp, Artificial Sequence; identical to SEQ ID NO: 16845
  Description of Artificial Sequence: Synthetic coding sequence

SEQ ID NO: 16848 - DNA, 195 bp, Artificial Sequence
  Description of Artificial Sequence: Synthetic coding sequence
atggccgcctaccagcaggaggagcagatgcagctgcccagagccgacgccatcagaagcagactgatcgacaccttcagcctgatcgagcacctgcagggcctgagccaggccgtgcccagacacaccatcagagagctgctggaccccagcagacagaagaagctggtgctgggcgaccagcaccagctgtag

SEQ ID NO: 16849 - DNA, 147 bp, Artificial Sequence
  Description of Artificial Sequence: Synthetic coding sequence
atggccgcctaccagcaggaggagcagatgcagctgcccagagccgacgccatcagaagcagactgatcgacaccttcagcctgatcgagcacctgcagggcctgagccaggccgtgcccagacacaccatcagagagctgctgtag

SEQ ID NO: 16850 - DNA, 243 bp, Artificial Sequence
  Description of Artificial Sequence: Synthetic coding sequence
atggccgcctaccagcaggaggagcagatgcagctgcccagagccgacgccatcagaagcagactgatcgacaccttcagcctgatcgagcacctgcagggcctgagccaggccgtgcccagacacaccatcagagagctgctggaccccagcagacagaagaagctggtgctgggcgaccagcaccagctggtgagattcagcatcaagccccagagaatcgagcagatcagccacgcctag

SEQ ID NO: 16851 - DNA, 1449 bp, Artificial Sequence
  Description of Artificial Sequence: Synthetic coding sequence
atggccgccgccgccgccggcgccggcagcggcccctgggccgcccaggagaagcagttcccccccgccctgctgagcttcttcatctacaaccccagattcggccccagagagggccaggaggagaacaagatcctgttctaccaccccaacgaggtggagaagaacgagaagatcagaaacgtgggcctgtgcgaggccatcgtgcagttcaccagaaccttcagccccagcaagcccgccaagagcctgcacacccagaagaacagacagttcttcaacgagcccgaggagaacttctggatggtgatggtggtgagaaaccccatcatcgagaagcagagcaaggacggcaagcccgtgatcgagtaccaggaggaggagctgctggacaaggtgtacagcagcgtgctgagacagtgctacagcatgtacaagctgttcaacggcaccttcctgaaggccatggaggacggcggcgtgaagctgctgaaggagagactggagaagttcttccacagatacctgcagaccctgcacctgcagagctgcgacctgctggacatcttcggcggcatcagcttcttccccctggacaagatgacctacctgaagatccagagcttcatcaacagaatggaggagagcctgaacatcgtgaagtacaccgccttcctgtacaacgaccagctgatctggagcggcctggagcaggacgacatgagaatcctgtacaagtacctgaccaccagcctgttccccagacacatcgagcccgagctggccggcagagacagccccatcagagccgagatgcccggcaacctgcagcactacggcagattcctgaccggccccctgaacctgaacgaccccgacgccaagtgcagattccccaagatcttcgtgaacaccgacgacacctacgaggagctgcacctgatcgtgtacaaggccatgagcgccgccgtgtgcttcatgatcgacgccagcgtgcaccccaccctggacttctgcagaagactggacagcatcgtgggcccccagctgaccgtgctggccagcgacatctgcgagcagttcaacatcaacaagagaatgagcggcagcgagaaggagccccagttcaagttcatctacttcaaccacatgaacctggccgagaagagcaccgtgcacatgagaaagacccccagcgtgagcctgaccagcgtgcaccccgacctgatgaagatcctgggcgacatcaacagcgacttcaccagagtggacgaggacgaggagatcatcgtgaaggccatgagcgactactgggtggtgggcaagaagagcgacagaagagagctgtacgtgatcctgaaccagaagaacgccaacctgatcgaggtgaacgaggaggtgaagaagctgtgcgccacccagttcaacaacatcttcttcctggactag

SEQ ID NO: 16852 - DNA, 1020 bp, Artificial Sequence
  Description of Artificial Sequence: Synthetic coding sequence
atgtacaagctgttcaacggcaccttcctgaaggccatggaggacggcggcgtgaagctgctgaaggagagactggagaagttcttccacagatacctgcagaccctgcacctgcagagctgcgacctgctggacatcttcggcggcatcagcttcttccccctggacaagatgacctacctgaagatccagagcttcatcaacagaatggaggagagcctgaacatcgtgaagtacaccgccttcctgtacaacgaccagctgatctggagcggcctggagcaggacgacatgagaatcctgtacaagtacctgaccaccagcctgttccccagacacatcgagcccgagctggccggcagagacagccccatcagagccgagatgcccggcaacctgcagcactacggcagattcctgaccggccccctgaacctgaacgaccccgacgccaagtgcagattccccaagatcttcgtgaacaccgacgacacctacgaggagctgcacctgatcgtgtacaaggccatgagcgccgccgtgtgcttcatgatcgacgccagcgtgcaccccaccctggacttctgcagaagactggacagcatcgtgggcccccagctgaccgtgctggccagcgacatctgcgagcagttcaacatcaacaagagaatgagcggcagcgagaaggagccccagttcaagttcatctacttcaaccacatgaacctggccgagaagagcaccgtgcacatgagaaagacccccagcgtgagcctgaccagcgtgcaccccgacctgatgaagatcctgggcgacatcaacagcgacttcaccagagtggacgaggacgaggagatcatcgtgaaggccatgagcgactactgggtggtgggcaagaagagcgacagaagagagctgtacgtgatcctgaaccagaagaacgccaacctgatcgaggtgaacgaggaggtgaagaagctgtgcgccacccagttcaacaacatcttcttcctggactag

SEQ ID NO: 16853 - DNA, 1449 bp, Artificial Sequence; identical to SEQ ID NO: 16851
  Description of Artificial Sequence: Synthetic coding sequence

SEQ ID NO: 16854 - DNA, 1020 bp, Artificial Sequence; identical to SEQ ID NO: 16852
  Description of Artificial Sequence: Synthetic coding sequence

SEQ ID NO: 16855 - DNA, 3066 bp, Artificial Sequence
  Description of Artificial Sequence: Synthetic coding sequence
atggccggcatcagctacgtggccagcttcttcctgctgctgaccaagctgagcatcggccagagagaggtgaccgtgcagaagggccccctgttcagagccgagggctaccccgtgagcatcggctgcaacgtgaccggccaccagggccccagcgagcagcacttccagtggagcgtgtacctgcccaccaaccccacccaggaggtgcagatcatcagcaccaaggacgccgccttcagctacgccgtgtacacccagagagtgagaagcggcgacgtgtacgtggagagagtgcagggcaacagcgtgctgctgcacatcagcaagctgcagatgaaggacgccggcgagtacgagtgccacacccccaacaccgacgagaagtactacggcagctacagcgccaagaccaacctgatcgtgatccccgacaccctgagcgccaccatgagcagccagaccctgggcaaggaggagggcgagcccctggccctgacctgcgaggccagcaaggccaccgcccagcacacccacctgagcgtgacctggtacctgacccaggacggcggcggcagccaggccaccgagatcatcagcctgagcaaggacttcatcctggtgcccggccccctgtacaccgagagattcgccgccagcgacgtgcagctgaacaagctgggccccaccaccttcagactgagcatcgagagactgcagagcagcgaccagggccagctgttctgcgaggccaccgagtggatccaggaccccgacgagacctggatgttcatcaccaagaagcagaccgaccagaccaccctgagaatccagcccgccgtgaaggacttccaggtgaacatcaccgccgacagcctgttcgccgagggcaagcccctggagctggtgtgcctggtggtgagcagcggcagagacccccagctgcagggcatctggttcttcaacggcaccgagatcgcccacatcgacgccggcggcgtgctgggcctgaagaacgactacaaggagagagccagccagggcgagctgcaggtgagcaagctgggccccaaggccttcagcctgaagatcttcagcctgggccccgaggacgagggcgcctacagatgcgtggtggccgaggtgatgaagaccagaaccggcagctggcaggtgctgcagagaaagcagagccccgacagccacgtgcacctgagaaagcccgccgccagaagcgtggtgatgagcaccaagaacaagcagcaggtggtgtgggagggcgagaccctggccttcctgtgcaaggccggcggcgccgagagccccctgagcgtgagctggtggcacatccccagagaccagacccagcccgagttcgtggccggcatgggccaggacggcatcgtgcagctgggcgccagctacggcgtgcccagctaccacggcaacaccagactggagaagatggactgggccaccttccagctggagatcaccttcaccgccatcaccgacagcggcacctacgagtgcagagtgagcgagaagagcagaaaccaggccagagacctgagctggacccagaagatcagcgtgaccgtgaagagcctggagagcagcctgcaggtgagcctgatgagcagacagccccaggtgatgctgaccaacaccttcgacctgagctgcgtggtgagagccggctacagcgacctgaaggtgcccctgaccgtgacctggcagttccagcccgccagcagccacatcttccaccagctgatcagaatcacccacaacggcaccatcgagtggggcaacttcctgagcagattccagaagaagaccaaggtgagccagagcctgttcagaagccagctgctggtgcacgacgccaccgaggaggagaccggcgtgtaccagtgcgaggtggaggtgtacgacagaaacagcctgtacaacaacagaccccccagagccagcgccatcagccaccccctgagaatcgccgtgaccctgcccgagagcaagctgaaggtgaacagcagaagccaggtgcaggagctgagcatcaacagcaacaccgacatcgagtgcagcatcctgagcagaagcaacggcaacctgcagctggccatcatctggtacttcagccccgtgagcaccaacgccagctggctgaagatcctggagatggaccagaccaacgtgatcaagaccggcgacgagttccacaccccccagagaaagcagaagttccacaccgagaaggtgagccaggacctgttccagctgcacatcctgaacgtggaggacagcgacagaggcaagtaccactgcgccgtggaggagtggctgctgagcaccaacggcacctggcacaagctgggcgagaagaagagcggcctgaccgagctgaagctgaagcccaccggcagcaaggtgagagtgagcaaggtgtactggaccgagaacgtgaccgagcacagagaggtggccatcagatgcagcctggagagcgtgggcagcagcgccaccctgtacagcgtgatgtggtactggaacagagagaacagcggcagcaagctgctggtgcacctgcagcacgacggcctgctggagtacggcgaggagggcctgagaagacacctgcactgctacagaagcagcagcaccgacttcgtgctgaagctgcaccaggtggagatggaggacgccggcatgtactggtgcagagtggccgagtggcagctgcacggccaccccagcaagtggatcaaccaggccagcgacgagagccagagaatggtgctgaccgtgctgcccagcgagcccaccctgcccagcagaatctgcagcagcgcccccctgctgtacttcctgttcatctgccccttcgtgctgctgctgctgctgctgatcagcctgctgtgcctgtactggaaggccagaaagctgagcaccctgagaagcaacaccagaaaggagaaggccctgtgggtggacctgaaggaggccggcggcgtgaccaccaacagaagagaggacgaggaggaggacgagggcaactag

SEQ ID NO: 16856 - DNA, 3066 bp, Artificial Sequence; identical to SEQ ID NO: 16855
  Description of Artificial Sequence: Synthetic coding sequence

SEQ ID NO: 16857 - DNA, 546 bp, Artificial Sequence
  Description of Artificial Sequence: Synthetic coding sequence
atgctgctggagcccggcagaggctgctgcgccctggccatcctgctggccatcgtggacatccagagcggcggctgcatcaacatcaccagcagcgccagccaggagggcaccagactgaacctgatctgcaccgtgtggcacaagaaggaggaggccgagggcttcgtggtgttcctgtgcaaggacagaagcggcgactgcagccccgagaccagcctgaagcagctgagactgaagagagaccccggcatcgacggcgtgggcgagatcagcagccagctgatgttcaccatcagccaggtgacccccctgcacagcggcacctaccagtgctgcgccagaagccagaagagcggcatcagactgcagggccacttcttcagcatcctgttcaccgagaccggcaactacaccgtgaccggcctgaagcagagacagcacctggagttcagccacaacgagggcaccctgagcagcggcttcctgcaggagaaggtgtgggtgatgctggtgaccagcctggtggccctgcaggccctgtag

SEQ ID NO: 16858 - DNA, 546 bp, Artificial Sequence; identical to SEQ ID NO: 16857
  Description of Artificial Sequence: Synthetic coding sequence

SEQ ID NO: 16859 - DNA, 378 bp, Artificial Sequence
  Description of Artificial Sequence: Synthetic coding sequence
atgctgctggagcccggcagaggctgctgcgccctggccatcctgctggccatcgtggacatccagagcggcgagaccggcaactacaccgtgaccggcctgaagcagagacagcacctggagttcagccacaacgagggcaccctgagcagcggcttcctgcaggagaaggtgtgggtgatgctggtgaccagcctggtggccctgcagggcatgagcaagagagccgtgagcacccccagcaacgagggcgccatcatcttcctgcccccctggctgttcagcagaagaagaagactggagagaatgagcagaggcagagagaagtgctacagcagccccggctacccccaggagagcagcaaccagttccactag

SEQ ID NO: 16860 - DNA, 546 bp, Artificial Sequence; identical to SEQ ID NO: 16857
  Description of Artificial Sequence: Synthetic coding sequence

SEQ ID NO: 16861 - DNA, 516 bp, Artificial Sequence
  Description of Artificial Sequence: Synthetic coding sequence
atggaggcccccggccccagagccctgagaaccgccctgtgcggcggctgctgctgcctgctgctgtgcgcccagctggccgtggccggcaagggcgccagaggcttcggcagaggcgccctgatcagactgaacatctggcccgccgtgcagggcgcctgcaagcagctggaggtgtgcgagcactgcgtggagggcgacagagccagaaacctgagcagctgcatgtgggagcagtgcagacccgaggagcccggccactgcgtggcccagagcgaggtggtgaaggagggctgcagcatctacaacagaagcgaggcctgccccggcaagggcgtgctggcccccaagcccagctgcatgggcctgcccagccacagcctgccccccagaagaaagcagcccctgagcggcggcggcttctgcagccccatccccggccccggcatcagcagcgccttcagcagcctgagaagccccctgctgagcctgcccatcagcagcagcgagaactag

SEQ ID NO: 16862 - DNA, 522 bp, Artificial Sequence
  Description of Artificial Sequence: Synthetic coding sequence
atggaggcccccggccccagagccctgagaaccgccctgtgcggcggctgctgctgcctgctgctgtgcgcccagctggccgtggccggcaagggcgccagaggcttcggcagaggcgccctgatcagactgaacatctggcccgccgtgcagggcgcctgcaagcagctggaggtgtgcgagcactgcgtggagggcgacagagccagaaacctgagcagctgcatgtgggagcagtgcagacccgaggagcccggccactgcgtggcccagagcgaggtggtgaaggagggctgcagcatctacaacagaagcgaggcctgccccgccgcccaccaccaccccacctacgagcccaagaccgtgaccaccggcagcccccccgtgcccgaggcccacagccccggcttcgacggcgccagcttcatcggcggcgtggtgctggtgctgagcctgcaggccgtggccttcttcgtgctgcacttcctgaaggccaaggacagcacctaccagaccctgtag

SEQ ID NO: 16863 - DNA, 525 bp, Artificial Sequence
  Description of Artificial Sequence: Synthetic coding sequence
atggaggcccccggccccagagccctgagaaccgccctgtgcggcggctgctgctgcctgctgctgtgcgcccagctggccgtggccggcaagggcgccagaggcttcggcagaggcgccctgatcagactgaacatctggcccgccgtgcagggcgcctgcaagcagctggaggtgtgcgagcactgcgtggagggcgacagagccagaaacctgagcagctgcatgtgggagcagtgcagacccgaggagcccggccactgcgtggcccagagcgaggtggtgaaggagggctgcagcatctacaacagaagcgaggcctgccccgccgcccaccaccaccccacctacgagcccaagaccgtgaccaccggcagcccccccgtgcccgaggcccacagccccggcttcgacggcgccagcttcatcggcggcgtggtgctggtgctgagcctgcaggccgtggccttcttcgtgctgcacttcctgaaggccaaggacagcacctaccagaccctgatctag

SEQ ID NO: 16864 - DNA, 1986 bp, Artificial Sequence
  Description of Artificial Sequence: Synthetic coding sequence
atggccttcgacgtgagctgcttcttctgggtggtgctgttcagcgccggctgcaaggtgatcaccagctgggaccagatgtgcatcgagaaggaggccaacaagacctacaactgcgagaacctgggcctgagcgagatccccgacaccctgcccaacaccaccgagttcctggagttcagcttcaacttcctgcccaccatccacaacagaaccttcagcagactgatgaacctgaccttcctggacctgaccagatgccagatcaactggatccacgaggacaccttccagagccaccaccagctgagcaccctggtgctgaccggcaaccccctgatcttcatggccgagaccagcctgaacggccccaagagcctgaagcacctgttcctgatccagaccggcatcagcaacctggagttcatccccgtgcacaacctggagaacctggagagcctgtacctgggcagcaaccacatcagcagcatcaagttccccaaggacttccccgccagaaacctgaaggtgctggacttccagaacaacgccatccactacatcagcagagaggacatgagaagcctggagcaggccatcaacctgagcctgaacttcaacggcaacaacgtgaagggcatcgagctgggcgccttcgacagcaccatcttccagagcctgaacttcggcggcacccccaacctgagcgtgatcttcaacggcctgcagaacagcaccacccagagcctgtggctgggcaccttcgaggacatcgacgacgaggacatcagcagcgccatgctgaagggcctgtgcgagatgagcgtggagagcctgaacctgcaggagcacagattcagcgacatcagcagcaccaccttccagtgcttcacccagctgcaggagctggacctgaccgccacccacctgaagggcctgcccagcggcatgaagggcctgaacctgctgaagaagctggtgctgagcgtgaaccacttcgaccagctgtgccagatcagcgccgccaacttccccagcctgacccacctgtacatcagaggcaacgtgaagaagctgcacctgggcgtgggctgcctggagaagctgggcaacctgcagaccctggacctgagccacaacgacatcgaggccagcgactgctgcagcctgcagctgaagaacctgagccacctgcagaccctgaacctgagccacaacgagcccctgggcctgcagagccaggccttcaaggagtgcccccagctggagctgctggacctggccttcaccagactgcacatcaacgccccccagagccccttccagaacctgcacttcctgcaggtgctgaacctgacctactgcttcctggacaccagcaaccagcacctgctggccggcctgcccgtgctgagacacctgaacctgaagggcaaccacttccaggacggcaccatcaccaagaccaacctgctgcagaccgtgggcagcctggaggtgctgatcctgagcagctgcggcctgctgagcatcgaccagcaggccttccacagcctgggcaagatgagccacgtggacctgagccacaacagcctgacctgcgacagcatcgacagcctgagccacctgaagggcatctacctgaacctggccgccaacagcatcaacatcatcagccccagactgctgcccatcctgagccagcagagcaccatcaacctgagccacaaccccctggactgcacctgcagcaacatccacttcctgacctggtacaaggagaacctgcacaagctggagggcagcgaggagaccacctgcgccaacccccccagcctgagaggcgtgaagctgagcgacgtgaagctgagctgcggcatcaccgccatcggcatcttcttcctgatcgtgttcctgctgctgctggccatcctgctgttcttcgccgtgaagtacctgctgagatggaagtaccagcacatctag

SEQ ID NO: 16865 - DNA, 816 bp, Artificial Sequence
  Description of Artificial Sequence: Synthetic coding sequence
atgagcgcccccagactgctgatcagcatcatcatcatggtgagcgccagcagcagcagctgcatgggcggcaagcagatgacccagaactacagcaccatcttcgccgagggcaacatcagccagcccgtgctgatggacatcaacgccgtgctgtgctgcccccccatcgccctgagaaacctgatcatcatcacctgggagatcatcctgagaggccagcccagctgcaccaaggcctacaagaaggagaccaacgagaccaaggagaccaactgcaccgtggagagaatcacctgggtgagcagacccgaccagaacagcgacctgcagatcagacccgtggacaccacccacgacggctactacagaggcatcgtggtgacccccgacggcaacttccacagaggctaccacctgcaggtgctggtgacccccgaggtgaacctgttccagagcagaaacatcaccgccgtgtgcaaggccgtgaccggcaagcccgccgcccagatcagctggatccccgagggcagcatcctggccaccaagcaggagtactggggcaacggcaccgtgaccgtgaagagcacctgcccctgggagggccacaagagcaccgtgacctgccacgtgagccacctgaccggcaacaagagcctgagcgtgaagctgaacagcggcctgagaaccagcggcagccccgccctgagcctgctgatcatcctgtacgtgaagctgagcctgttcgtggtgatcctggtgaccaccggcttcgtgttcttccagagaatcaaccacgtgagaaaggtgctgtag

SEQ ID NO: 16866 - DNA, 753 bp, Artificial Sequence
  Description of Artificial Sequence: Synthetic coding sequence
atgggcggcaagcagatgacccagaactacagcaccatcttcgccgagggcaacatcagccagcccgtgctgatggacatcaacgccgtgctgtgctgcccccccatcgccctgagaaacctgatcatcatcacctgggagatcatcctgagaggccagcccagctgcaccaaggcctacaagaaggagaccaacgagaccaaggagaccaactgcaccgtggagagaatcacctgggtgagcagacccgaccagaacagcgacctgcagatcagacccgtggacaccacccacgacggctactacagaggcatcgtggtgacccccgacggcaacttccacagaggctaccacctgcaggtgctggtgacccccgaggtgaacctgttccagagcagaaacatcaccgccgtgtgcaaggccgtgaccggcaagcccgccgcccagatcagctggatccccgagggcagcatcctggccaccaagcaggagtactggggcaacggcaccgtgaccgtgaagagcacctgcccctgggagggccacaagagcaccgtgacctgccacgtgagccacctgaccggcaacaagagcctgagcgtgaagctgaacagcggcctgagaaccagcggcagccccgccctgagcctgctgatcatcctgtacgtgaagctgagcctgttcgtggtgatcctggtgaccaccggcttcgtgttcttccagagaatcaaccacgtgagaaaggtgctgtag

SEQ ID NO: 16867 - DNA, 753 bp, Artificial Sequence; identical to SEQ ID NO: 16866
  Description of Artificial Sequence: Synthetic coding sequence

SEQ ID NO: 16868 - DNA, 531 bp, Artificial Sequence
  Description of Artificial Sequence: Synthetic coding sequence
atgagaatcttcgccgtgttcatcttcatgacctactggcacctgctgaacgccccctacaacaagatcaaccagagaatcctggtggtggaccccgtgaccagcgagcacgagctgacctgccaggccgagggctaccccaaggccgaggtgatctggaccagcagcgaccaccaggtgctgagcggcaagaccaccaccaccaacagcaagagagaggagaagctgttcaacgtgaccagcaccctgagaatcaacaccaccaccaacgagatcttctactgcaccttcagaagactggaccccgaggagaaccacaccgccgagctggtgatccccgagctgcccctggcccacccccccaacgagagaacccacctggtgatcctgggcgccatcctgctgtgcctgggcgtggccctgaccttcatcttcagactgagaaagggcagaatgatggacgtgaagaagtgcggcatccaggacaccaacagcaagaagcagagcgacacccacctggaggagacctag

SEQ ID NO: 16869 - DNA, 873 bp, Artificial Sequence
  Description of Artificial Sequence: Synthetic coding sequence
atgagaatcttcgccgtgttcatcttcatgacctactggcacctgctgaacgccttcaccgtgaccgtgcccaaggacctgtacgtggtggagtacggcagcaacatgaccatcgagtgcaagttccccgtggagaagcagctggacctggccgccctgatcgtgtactgggagatggaggacaagaacatcatccagttcgtgcacggcgaggaggacctgaaggtgcagcacagcagctacagacagagagccagactgctgaaggaccagctgagcctgggcaacgccgccctgcagatcaccgacgtgaagctgcaggacgccggcgtgtacagatgcatgatcagctacggcggcgccgactacaagagaatcaccgtgaaggtgaacgccccctacaacaagatcaaccagagaatcctggtggtggaccccgtgaccagcgagcacgagctgacctgccaggccgagggctaccccaaggccgaggtgatctggaccagcagcgaccaccaggtgctgagcggcaagaccaccaccaccaacagcaagagagaggagaagctgttcaacgtgaccagcaccctgagaatcaacaccaccaccaacgagatcttctactgcaccttcagaagactggaccccgaggagaaccacaccgccgagctggtgatccccgagctgcccctggcccacccccccaacgagagaacccacctggtgatcctgggcgccatcctgctgtgcctgggcgtggccctgaccttcatcttcagactgagaaagggcagaatgatggacgtgaagaagtgcggcatccaggacaccaacagcaagaagcagagcgacacccacctggaggagacctag

SEQ ID NO: 16870 - DNA, 585 bp, Artificial Sequence
  Description of Artificial Sequence: Synthetic coding sequence
atgtggctgagccccagcctgctgctgctgatcctgcccggctacagcatcgccgccaagatcaccggccccaccaccgtgaacggcagcgagcagggcagcctgaccgtgcagtgcgcctacggcagcggctgggagacctacctgaagtggagatgccagggcgccgactggaactactgcaacatcctggtgaagaccaacggcagcgagcaggaggtgaagaagaacagagtgagcatcagagacaaccagaagaaccacgtgttcaccgtgaccatggagaacctgaagagagacgacgccgacagctactggtgcggcaccgagagacccggcatcgacctgggcgtgaaggtgcaggtgaccatcaaccccggcacccagaccgccgtgagcgagtggaccaccaccaccgccagcctggccttcaccgccgccgccacccagaagaccagcagccccctgaccagaagccccctgaagagcacccacttcctgttcctgttcctgctggagctgcccctgctgctgagcatgctgggcaccgtgctgtgggtgaacagaccccagagaagaagctag

SEQ ID NO: 16871 - DNA, 702 bp, Artificial Sequence
  Description of Artificial Sequence: Synthetic coding sequence
atgagactgctggtgctgctgtggggctgcctgctgctgcccggctacgaggccctggagggccccgaggagatcagcggcttcgagggcgacaccgtgagcctgcagtgcacctacagagaggagctgagagaccacagaaagtactggtgcagaaagggcggcatcctgttcagcagatgcagcggcaccatctacgccgaggaggagggccaggagaccatgaagggcagagtgagcatcagagacagcagacaggagctgagcctgatcgtgaccctgtggaacctgaccctgcaggacgccggcgagtactggtgcggcgtggagaagagaggccccgacgagagcctgctgatcagcctgttcgtgttccccggcagcagcagaccccccatgcagctggacagcaccagcgccgaggacaccagccccgccctgagcagcggcagcagcaagcccagagtgagcatccccatggtgagaatcctggcccccgtgctggtgctgctgagcctgctgagcgccgccggcctgatcgccttctgcagccacctgctgctgtggagaaaggaggcccagcaggccaccgagacccagagaaacgagaagttctgcctgagcagactgaaccacagaaccagcgagctggaccccgacgaggccttcgagatcagcagcctgaccttcctgagcgtgtag

SEQ ID NO: 16872 - DNA, 999 bp, Artificial Sequence
  Description of Artificial Sequence: Synthetic coding sequence
atgagactgctggtgctgctgtggggctgcctgctgctgcccggctacgaggccctggagggccccgaggagatcagcggcttcgagggcgacaccgtgagcctgcagtgcacctacagagaggagctgagagaccacagaaagtactggtgcagaaagggcggcatcctgttcagcagatgcagcggcaccatctacgccgaggaggagggccaggagaccatgaagggcagagtgagcatcagagacagcagacaggagctgagcctgatcgtgaccctgtggaacctgaccctgcaggacgccggcgagtactggtgcggcgtggagaagagaggccccgacgagagcctgctgatcagcctgttcgtgttccccggcccctgctgcccccccagccccagccccaccttccagcccctggccaccaccagactgcagcccaaggccaaggcccagcagacccagccccccggcctgaccagccccggcctgtaccccgccgccaccaccgccaagcagggcaagaccggcgccgaggccccccccctgcccggcaccagccagtacggccacgagagaaccagccagtacaccggcaccagcccccaccccgccaccagcccccccgccggcagcagcagaccccccatgcagctggacagcaccagcgccgaggacaccagccccgccctgagcagcggcagcagcaagcccagagtgagcatccccatggtgagaatcctggcccccgtgctggtgctgctgagcctgctgagcgccgccggcctgatcgccttctgcagccacctgctgctgtggagaaaggaggcccagcaggccaccgagacccagagaaacgagaagttctgcctgagcagactgaccgccgaggagaaggaggcccccagccaggcccccgagggcgacgtgatcagcatgccccccctgcacaccagcgaggaggagctgggcttcagcaagttcgtgagcgcctag

SEQ ID NO: 16873 - DNA, 822 bp, Artificial Sequence
  Description of Artificial Sequence: Synthetic coding sequence
atgagactgctggtgctgctgtggggctgcctgctgctgcccggctacgaggccctggagggccccgaggagatcagcggcttcgagggcgacaccgtgagcctgcagtgcacctacagagaggagctgagagaccacagaaagtactggtgcagaaagggcggcatcctgttcagcagatgcagcggcaccatctacgccgaggaggagggccaggagaccatgaagggcagagtgagcatcagagacagcagacaggagctgagcctgatcgtgaccctgtggaacctgaccctgcaggacgccggcgagtactggtgcggcgtggagaagagaggccccgacgagagcctgctgatcagcctgttcgtgttccccgccagccccggcctgtaccccgccgccaccaccgccaagcagggcaagaccggcgccgaggccccccccctgcccggcaccagccagtacggccacgagagaaccagccagtacaccggcaccagcccccaccccgccaccagcccccccgccggcagcagcagaccccccatgcagctggacagcaccagcgccgaggacaccagccccgccctgagcagcggcagcagcaagcccagagtgagcatccccatggtgagaatcctggcccccgtgctggtgctgctgagcctgctgagcgccgccggcctgatcgccttctgcagccacctgctgctgtggagaaaggaggcccagcaggccaccgagacccagagaaacgagaagttctgcctgagcagactgaacagcctgatgttcagcctgagcctgccctggctgtag

SEQ ID NO: 16874 - DNA, 924 bp, Artificial Sequence
  Description of Artificial Sequence: Synthetic coding sequence
atgagactgctggtgctgctgtggggctgcctgctgctgcccggctacgaggccctggagggccccgaggagatcagcggcttcgagggcgacaccgtgagcctgcagtgcacctacagagaggagctgagagaccacagaaagtactggtgcagaaagggcggcatcctgttcagcagatgcagcggcaccatctacgccgaggaggagggccaggagaccatgaagggcagagtgagcatcagagacagcagacaggagctgagcctgatcgtgaccctgtggaacctgaccctgcaggacgccggcgagtactggtgcggcgtggagaagagaggccccgacgagagcctgctgatcagcctgttcgtgttccccggcccctgctgcccccccagccccagccccaccttccagcccctggccaccaccagactgcagcccaaggccaaggcccagcagacccagccccccggcctgaccagccccggcctgtaccccgccgccaccaccgccaagcagggcaagaccggcgccgaggccccccccctgcccggcaccagccagtacggccacgagagaaccagccagtacaccggcaccagcccccaccccgccaccagcccccccgccggcagcagcagaccccccatgcagctggacagcaccagcgccgaggacaccagccccgccctgagcagcggcagcagcaagcccagagtgagcatccccatggtgagaatcctggcccccgtgctggtgctgctgagcctgctgagcgccgccggcctgatcgccttctgcagccacctgctgctgtggagaaaggaggcccagcaggccaccgagacccagagaaacgagaagttctgcctgagcagactgaacagcctgatgttcagcctgagcctgccctggctgtag

SEQ ID NO: 16875 - DNA, 561 bp, Artificial Sequence
  Description of Artificial Sequence: Synthetic coding sequence
atgtggctgccctgggccctgctgctgctgtgggtgcccgccagcaccagcatgacccccgccagcatcaccgccgccaagaccagcaccatcaccaccgccttcccccccgtgagcagcaccaccctgttcgccgtgggcgccacccacagcgccagcatccaggaggagaccgaggaggtggtgaacagccagctgcccctgctgctgagcctgctggccctgctgctgctgctgctggtgggcgccagcctgctggcctggagaatgttccagaagtggatcaaggccggcgaccacagcgagctgagccagaaccccaagcaggccgccacccagagcgagctgcactacgccaacctggagctgctgatgtggcccctgcaggagaagcccgccccccccagagaggtggaggtggagtacagcaccgtggccagccccagagaggagctgcactacgccagcgtggtgttcgacagcaacaccaacagaatcgccgcccagagacccagagaggaggagcccgacagcgactacagcgtgatcagaaagacctag

SEQ ID NO: 16876 - DNA, 900 bp, Artificial Sequence
  Description of Artificial Sequence: Synthetic coding sequence
atgtggctgccctgggccctgctgctgctgtgggtgcccggctgcttcgccctgagcaagtgcagaaccgtggccggccccgtgggcggcagcctgagcgtgcagtgcccctacgagaaggagcacagaaccctgaacaagtactggtgcagacccccccagatcttcctgtgcgacaagatcgtggagaccaagggcagcgccggcaagagaaacggcagagtgagcatcagagacagccccgccaacctgagcttcaccgtgaccctggagaacctgaccgaggaggacgccggcacctactggtgcggcgtggacaccccctggctgagagacttccacgaccccgtggtggaggtggaggtgagcgtgttccccgccagcaccagcatgacccccgccagcatcaccgccgccaagaccagcaccatcaccaccgccttcccccccgtgagcagcaccaccctgttcgccgtgggcgccacccacagcgccagcatccaggaggagaccgaggaggtggtgaacagccagctgcccctgctgctgagcctgctggccctgctgctgctgctgctggtgggcgccagcctgctggcctggagaatgttccagaagtggatcaaggccggcgaccacagcgagctgagccagaaccccaagcaggccgccacccagagcgagctgcactacgccaacctggagctgctgatgtggcccctgcaggagaagcccgccccccccagagaggtggaggtggagtacagcaccgtggccagccccagagaggagctgcactacgccagcgtggtgttcgacagcaacaccaacagaatcgccgcccagagacccagagaggaggagcccgacagcgactacagcgtgatcagaaagacctag

SEQ ID NO: 16877 - DNA, 312 bp, Artificial Sequence
  Description of Artificial Sequence: Synthetic coding sequence
atgtggctgccctgggccctgctgctgctgtgggtgcccgccggcgaccacagcgagctgagccagaaccccaagcaggccgccacccagagcgagctgcactacgccaacctggagctgctgatgtggcccctgcaggagaagcccgccccccccagagaggtggaggtggagtacagcaccgtggccagccccagagaggagctgcactacgccagcgtggtgttcgacagcaacaccaacagaatcgccgcccagagacccagagaggaggagcccgacagcgactacagcgtgatcagaaagacctag

SEQ ID NO: 16878 - DNA, 453 bp, Artificial Sequence
  Description of Artificial Sequence: Synthetic coding sequence
atgtggctgccctgggccctgctgctgctgtgggtgcccgccagcaccagcatgacccccgccagcatcaccgccgccaagaccagcaccatcaccaccgccttcccccccgtgagcagcaccaccctgttcgccgtgggcgccacccacagcgccagcatccaggaggagaccgaggaggtggtgaacagccagctgcccctgctgctgagcctgctggccctgctgctgctgctgctggtgggcgccagcctgctggcctggagaatgttccagaagtggatcaaggccggcgaccacagcgagctgagccagaaccccaagcaggccagccccagagaggagctgcactacgccagcgtggtgttcgacagcaacaccaacagaatcgccgcccagagacccagagaggaggagcccgacagcgactacagcgtgatcagaaagacctag

SEQ ID NO: 16879 - DNA, 675 bp, Artificial Sequence
  Description of Artificial Sequence: Synthetic coding sequence
atgaccgccagagcctgggccagctggagaagcagcgccctgctgctgctgctggtgcccggctacttccccctgagccaccccatgaccgtggccggccccgtgggcggcagcctgagcgtgcagtgcagatacgagaaggagcacagaaccctgaacaagttctggtgcagacccccccagatcctgagatgcgacaagatcgtggagaccaagggcagcgccggcaagagaaacggcagagtgagcatcagagacagccccgccaacctgagcttcaccgtgaccctggagaacctgaccgaggaggacgccggcacctactggtgcggcgtggacaccccctggctgagagacttccacgaccccatcgtggaggtggaggtgagcgtgttccccgccggcaccaccaccgccagcagcccccagagcagcatgggcaccagcggcccccccaccaagctgcccgtgcacacctggcccagcgtgaccagaaaggacagccccgagcccagcccccaccccggcagcctgttcagcaacgtgagattcctgctgctggtgctgctggagctgcccctgctgctgagcatgctgggcgccgtgctgtgggtgaacagaccccagagaagcagcagaagcagacagaactggcccaagggcgagaaccagtag

SEQ ID NO: 16880 - DNA, 618 bp, Artificial Sequence
  Description of Artificial Sequence: Synthetic coding sequence
atgtggctgctgcccgccctgctgctgctgtgcctgagcggctgcctgagcctgaagggccccggcagcgtgaccggcaccgccggcgacagcctgaccgtgtggtgccagtacgagagcatgtacaagggctacaacaagtactggtgcagaggccagtacgacaccagctgcgagagcatcgtggagaccaagggcgaggagaaggtggagagaaacggcagagtgagcatcagagaccaccccgaggccctggccttcaccgtgaccatgcagaacctgaacgaggacgacgccggcagctactggtgcaagatccagaccgtgtgggtgctggacagctggagcagagaccccagcgacctggtgagagtgtacgtgagccccgccatcaccacccccagaagaaccacccaccccgccaccccccccatcttcctggtggtgaaccccggcagaaacctgagcaccggcgaggtgctgacccagaacagcggcttcagactgagcagcccccacttcctgctggtggtgctgctgaagctgcccctgctgctgagcatgctgggcgccgtgttctgggtgaacagaccccagtgggccccccccggcagatag

SEQ ID NO: 16881 - DNA, 699 bp, Artificial Sequence
  Description of Artificial Sequence: Synthetic coding sequence
atgacccaggcccccctgcacatcctgggcttccagctgggccccagattcgccgaggacggcagccagggcgacagaaacatgtggctgctgcccgccctgctgctgctgtgcctgagcggctgcctgagcctgaagggccccggcagcgtgaccggcaccgccggcgacagcctgaccgtgtggtgccagtacgagagcatgtacaagggctacaacaagtactggtgcagaggccagtacgacaccagctgcgagagcatcgtggagaccaagggcgaggagaaggtggagagaaacggcagagtgagcatcagagaccaccccgaggccctggccttcaccgtgaccatgcagaacctgaacgaggacgacgccggcagctactggtgcaagatccagaccgtgtgggtgctggacagctggagcagagaccccagcgacctggtgagagtgtacgtgagccccgccatcaccacccccagaagaaccacccaccccgccaccccccccatcttcctggtggtgaaccccggcagaaacctgagcaccggcgaggtgctgacccagaacagcggcttcagactgagcagcccccacttcctgctggtggtgctgctgaagctgcccctgctgctgagcatgctgggcgccgtgttctgggtgaacagaccccagtgggccccccccggcagatag

SEQ ID NO: 16882 - DNA, 369 bp, Artificial Sequence
  Description of Artificial Sequence: Synthetic coding sequence
atgtgccacctgcaggaggaggccggcggcagatggaagggcggcggctgcctgagcctgaagggccccggcagcgtgaccggcaccgccggcgacagcctgaccgtgtggtgccagtacgagagcatgtacaagggctacaacaagtactggtgcagaggccagtacgacaccagctgcgagagcatcgtggagaccaagggcgaggagaaggtggagagaaacggcagagtgagcatcagagaccaccccgaggccctggccttcaccgtgaccatgcagaacctgaacgaggacgacgccggcagctactggtgcaagatccagaccgtgtgggtgctggacagctggagcagagaccccagctag

SEQ ID NO: 16883 - DNA, 741 bp, Artificial Sequence
  Description of Artificial Sequence: Synthetic coding sequence
atgagcgagaacaccaaggagacctggaccagcagaaagtggatgacccaggcccccctgcacatcctgggcttccagctgggccccagattcgccgaggacggcagccagggcgacagaaacatgtggctgctgcccgccctgctgctgctgtgcctgagcggctgcctgagcctgaagggccccggcagcgtgaccggcaccgccggcgacagcctgaccgtgtggtgccagtacgagagcatgtacaagggctacaacaagtactggtgcagaggccagtacgacaccagctgcgagagcatcgtggagaccaagggcgaggagaaggtggagagaaacggcagagtgagcatcagagaccaccccgaggccctggccttcaccgtgaccatgcagaacctgaacgaggacgacgccggcagctactggtgcaagatccagaccgtgtgggtgctggacagctggagcagagaccccagcgacctggtgagagtgtacgtgagccccgccatcaccacccccagaagaaccacccaccccgccaccccccccatcttcctggtggtgaaccccggcagaaacctgagcaccggcgaggtgctgacccagaacagcggcttcagactgagcagcccccacttcctgctggtggtgctgctgaagctgcccctgctgctgagcatgctgggcgccgtgttctgggtgaacagaccccagtgggccccccccggcagatag

SEQ ID NO: 16884 - DNA, 300 bp, Artificial Sequence
  Description of Artificial Sequence: Synthetic coding sequence
atgggctgcgacagaaactgcggcctgatcgccggcgccgtgatcggcgccgtgctggccgtgttcggcggcatcctgatgcccgtgggcgacctgctgatccagaagaccatcaagaagcaggtggtgctggaggagggcaccatcgccttcaagaactgggtgaagaccggcaccgaggtgtacagacagttctggatcttcgacgtgcagaacccccaggaggtgatgatgaacagcagctgcatcccctacctgagcaagagcatctgcagcaacgacccccagttcacctactag

SEQ ID NO: 16885 - DNA, 186 bp, Artificial Sequence
  Description of Artificial Sequence: Synthetic coding sequence
atgaagagattcctgttcctgctgctgaccatcagcctgctggtgatggtgcagatccagaccggcctgagcggccagaacgacaccagccagaccagcagccccagcgccagcagcaacatcagcggcggcatcttcctgttcttcgtggccaacgccatcatccacctgttctgcttcagctag

SEQ ID NO: 16886 - DNA, 1038 bp, Artificial Sequence
  Description of Artificial Sequence: Synthetic coding sequence
atggcccagcaccacctgtggatcctgctgctgtgcctgcagacctggcccgaggccgccggcaaggacagcgagatcttcaccgtgaacggcatcctgggcgagagcgtgaccttccccgtgaacatccaggagcccagacaggtgaagatcatcgcctggaccagcaagaccagcgtggcctacgtgacccccggcgacagcgagaccgcccccgtggtgaccgtgacccacagaaactactacgagagaatccacgccctgggccccaactacaacctggtgatcagcgacctgagaatggaggacgccggcgactacaaggccgacatcaacacccaggccgacccctacaccaccaccaagagatacaacctgcagatctacagaagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccgacatcgccatgggcttcagaacccaccacaccggcctgctgagcgtgctggccatgttcttcctgctggtgctgatcctgagcagcgtgttcctgttcagactgttcaagagaagacagggcagaatcttccccgagggcagctgcctgaacaccttcaccaagaacccctacgccgccagcaagaagaccatctacacctacatcatggccagcagaaacacccagcccgccgagagcagaatctacgacgagatcctgcagagcaaggtgctgcccagcaaggaggagcccgtgaacaccgtgtacagcgaggtgcagttcgccgacaagatgggcaaggccagcacccaggacagcaagccccccggcaccagcagctacgagatcgtgatctag

SEQ ID NO: 16887 - DNA, 843 bp, Artificial Sequence
  Description of Artificial Sequence: Synthetic coding sequence
atggcccagcaccacctgtggatcctgctgctgtgcctgcagacctggcccgaggccgccggcaaggacagcgagatcttcaccgtgaacggcatcctgggcgagagcgtgaccttccccgtgaacatccaggagcccagacaggtgaagatcatcgcctggaccagcaagaccagcgtggcctacgtgacccccggcgacagcgagaccgcccccgtggtgaccgtgacccacagaaactactacgagagaatccacgccctgggccccaactacaacctggtgatcagcgacctgagaatggaggacgccggcgactacaaggccgacatcaacacccaggccgacccctacaccaccaccaagagatacaacctgcagatctacagaagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccgacatcgccatgggcttcagaacccaccacaccggcctgctgagcgtgctggccatgttcttcctgctggtgctgatcctgagcagcgtgttcctgttcagactgttcaagagaagacagggcagaatcttccccgagggcaagatgtggaagctgaccttcagcccccccggcaccgaggccatctaccccagattcagctag

SEQ ID NO: 16888 - DNA, 726 bp, Artificial Sequence
  Description of Artificial Sequence: Synthetic coding sequence
atggcccagcaccacctgtggatcctgctgctgtgcctgcagacctggcccgaggccgccggcaaggacagcgagatcttcaccgtgaacggcatcctgggcgagagcgtgaccttccccgtgaacatccaggagcccagacaggtgaagatcatcgcctggaccagcaagaccagcgtggcctacgtgacccccggcgacagcgagaccgcccccgtggtgaccgtgacccacagaaactactacgagagaatccacgccctgggccccaactacaacctggtgatcagcgacctgagaatggaggacgccggcgactacaaggccgacatcaacacccaggccgacccctacaccaccaccaagagatacaacctgcagatctacagaagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccggcaaccagctgtgccccagcctgctggtgagcctgagagaccacagcgaggagctgcagggcctgaacgtgggccacatcctgtag

SEQ ID NO: 16889 - DNA, 1020 bp, Artificial Sequence
  Description of Artificial Sequence: Synthetic coding sequence
atggcccagcaccacctgtggatcctgctgctgtgcctgcagacctggcccgaggccgccggcaaggacagcgagatcttcaccgtgaacggcatcctgggcgagagcgtgaccttccccgtgaacatccaggagcccagacaggtgaagatcatcgcctggaccagcaagaccagcgtggcctacgtgacccccggcgacagcgagaccgcccccgtggtgaccgtgacccacagaaactactacgagagaatccacgccctgggccccaactacaacctggtgatcagcgacctgagaatggaggacgccggcgactacaaggccgacatcaacacccaggccgacccctacaccaccaccaagagatacaacctgcagatctacagaagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccgacatcgccatgggcttcagaacccaccacaccggcctgctgagcgtgctggccatgttcttcctgctggtgctgatcctgagcagcgtgttcctgttcagactgttcaagagaagacagggcagctgcctgaacaccttcaccaagaacccctacgccgccagcaagaagaccatctacacctacatcatggccagcagaaacacccagcccgccgagagcagaatctacgacgagatcctgcagagcaaggtgctgcccagcaaggaggagcccgtgaacaccgtgtacagcgaggtgcagttcgccgacaagatgggcaaggccagcacccaggacagcaagccccccggcaccagcagctacgagatcgtgatctag

SEQ ID NO: 16890 - DNA, 819 bp, Artificial Sequence
  Description of Artificial Sequence: Synthetic coding sequence
atggcccagcaccacctgtggatcctgctgctgtgcctgcagacctggcccgaggccgccggcaaggacagcgagatcttcaccgtgaacggcatcctgggcgagagcgtgaccttccccgtgaacatccaggagcccagacaggtgaagatcatcgcctggaccagcaagaccagcgtggcctacgtgacccccggcgacagcgagaccgcccccgtggtgaccgtgacccacagaaactactacgagagaatccacgccctgggccccaactacaacctggtgatcagcgacctgagaatggaggacgccggcgactacaaggccgacatcaacacccaggccgacccctacaccaccaccaagagatacaacctgcagatctacagaagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccgacatcgccatgggcttcagaacccaccacaccggcctgctgagcgtgctggccatgttcttcctgctggtgctgatcctgagcagcgtgttcctgttcagactgttcaagagaagacagggcgccagcctgcagggcagagccagcgagcacagcctgttcagaagcgccgtgtgctag

SEQ ID NO: 16891 - DNA, 987 bp, Artificial Sequence
  Description of Artificial Sequence: Synthetic coding sequence
atggcccagcaccacctgtggatcctgctgctgtgcctgcagacctggcccgaggccgccggcaaggacagcgagatcttcaccgtgaacggcatcctgggcgagagcgtgaccttccccgtgaacatccaggagcccagacaggtgaagatcatcgcctggaccagcaagaccagcgtggcctacgtgacccccggcgacagcgagaccgcccccgtggtgaccgtgacccacagaaactactacgagagaatccacgccctgggccccaactacaacctggtgatcagcgacctgagaatggaggacgccggcgactacaaggccgacatcaacacccaggccgacccctacaccaccaccaagagatacaacctgcagatctacagaagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccgacatcgccatgggcttcagaacccaccacaccggcctgctgagcgtgctggccatgttcttcctgctggtgctgatcctgagcagcgtgttcctgttcagactgttcaagagaagacaggacgccgccagcaagaagaccatctacacctacatcatggccagcagaaacacccagcccgccgagagcagaatctacgacgagatcctgcagagcaaggtgctgcccagcaaggaggagcccgtgaacaccgtgtacagcgaggtgcagttcgccgacaagatgggcaaggccagcacccaggacagcaagccccccggcaccagcagctacgagatcgtgatctag

SEQ ID NO: 16892 - DNA, 645 bp, Artificial Sequence
  Description of Artificial Sequence: Synthetic coding sequence
atggcccagcaccacctgtggatcctgctgctgtgcctgcagacctgcagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccgacatcgccatgggcttcagaacccaccacaccggcctgctgagcgtgctggccatgttcttcctgctggtgctgatcctgagcagcgtgttcctgttcagactgttcaagagaagacaggacgccgccagcaagaagaccatctacacctacatcatggccagcagaaacacccagcccgccgagagcagaatctacgacgagatcctgcagagcaaggtgctgcccagcaaggaggagcccgtgaacaccgtgtacagcgaggtgcagttcgccgacaagatgggcaaggccagcacccaggacagcaagccccccggcaccagcagctacgagatcgtgatctag

SEQ ID NO: 16893 - DNA, 1959 bp, Artificial Sequence
  Description of Artificial Sequence: Synthetic coding sequence
atggccaccagcatgggcctgctgctgctgctgctgctgctgctgacccagcccggcgccggcaccggcgccgacaccgaggccgtggtgtgcgtgggcaccgcctgctacaccgcccacagcggcaagctgagcgccgccgaggcccagaaccactgcaaccagaacggcggcaacctggccaccgtgaagagcaaggaggaggcccagcacgtgcagagagtgctggcccagctgctgagaagagaggccgccctgaccgccagaatgagcaagttctggatcggcctgcagagagagaagggcaagtgcctggaccccagcctgcccctgaagggcttcagctgggtgggcggcggcgaggacaccccctacagcaactggcacaaggagctgagaaacagctgcatcagcaagagatgcgtgagcctgctgctggacctgagccagcccctgctgcccagcagactgcccaagtggagcgagggcccctgcggcagccccggcagccccggcagcaacatcgagggcttcgtgtgcaagttcagcttcaagggcatgtgcagacccctggccctgggcggccccggccaggtgacctacaccacccccttccagaccaccagcagcagcctggaggccgtgcccttcgccagcgccgccaacgtggcctgcggcgagggcgacaaggacgagacccagagccactacttcctgtgcaaggagaaggcccccgacgtgttcgactggggcagcagcggccccctgtgcgtgagccccaagtacggctgcaacttcaacaacggcggctgccaccaggactgcttcgagggcggcgacggcagcttcctgtgcggctgcagacccggcttcagactgctggacgacctggtgacctgcgccagcagaaacccctgcagcagcagcccctgcagaggcggcgccacctgcgtgctgggcccccacggcaagaactacacctgcagatgcccccagggctaccagctggacagcagccagctggactgcgtggacgtggacgagtgccaggacagcccctgcgcccaggagtgcgtgaacacccccggcggcttcagatgcgagtgctgggtgggctacgagcccggcggccccggcgagggcgcctgccaggacgtggacgagtgcgccctgggcagaagcccctgcgcccagggctgcaccaacaccgacggcagcttccactgcagctgcgaggagggctacgtgctggccggcgaggacggcacccagtgccaggacgtggacgagtgcgtgggccccggcggccccctgtgcgacagcctgtgcttcaacacccagggcagcttccactgcggctgcctgcccggctgggtgctggcccccaacggcgtgagctgcaccatgggccccgtgagcctgggcccccccagcggcccccccgacgaggaggacaagggcgagaaggagggcagcaccgtgcccagagccgccaccgccagccccaccagaggccccgagggcacccccaaggccacccccaccaccagcagacccagcctgagcagcgacgcccccatcaccagcgcccccctgaagatgctggcccccagcggcagccccggcgtgtggagagagcccagcatccaccacgccaccgccgccagcggcccccaggagcccgccggcggcgacagcagcgtggccacccagaacaacgacggcaccgacggccagaagctgctgctgttctacatcctgggcaccgtggtggccatcctgctgctgctggccctggccctgggcctgctggtgtacagaaagagaagagccaagagagaggagaagaaggagaagaagccccagaacgccgccgacagctacagctgggtgcccgagagagccgagagcagagccatggagaaccagtacagccccacccccggcaccgactgctag

SEQ ID NO: 16894 - DNA, 1044 bp, Artificial Sequence
  Description of Artificial Sequence: Synthetic coding sequence
atggccaccagcatgggcctgctgctgctgctgctgctgctgctgacccagcccggcgccggcaccggcgccgacaccgaggccgtggtgtgcgtgggcaccgcctgctacaccgcccacagcggcaagctgagcgccgccgaggcccagaaccactgcaaccagaacggcggcaacctggccaccgtgaagagcaaggaggaggcccagcacgtgcagagagtgctggcccagctgctgagaagagaggccgccctgaccgccagaatgagcaagttctggatcggcctgcagagagagaagggcaagtgcctggaccccagcctgcccctgaagggcttcagctgggtgggcggcggcgaggacaccccctacagcaactggcacaaggagctgagaaacagctgcatcagcaagagatgcgtgagcctgctgctggacctgagccagcccctgctgcccagcagactgcccaagtggagcgagggcccctgcggcagccccggcagccccggcagcaacatcgagggcttcgtgtgcaagttcagcttcaagggcatgtgcagacccctggccctgggcggccccggccaggtgacctacaccacccccttccagaccaccagcagcagcctggaggccgtgcccttcgccagcgccgccaacgtggcctgcggcgagggcgacaaggacgagacccagagccactacttcctgtgcaaggagaaggcccccgacgtgttcgactggggcagcagcggccccctgtgcgtgagccccaagtacggctgcaacttcaacaacggcggctgccaccaggactgcttcgagggcggcgacggcagcttcctgtgcggctgcagacccggcttcagactgctggacgacctggtgacctgcgccagcagaaacccctgcagcagcagcccctgcagaggcggcgccaccggcctgagccaggccgagagcgaggagggcggcgaggagggcgaggaggcccccgagtgcggcagacagctgctgctgggcagcagagccagctag

SEQ ID NO: 16895 - DNA, 447 bp, Artificial Sequence
  Description of Artificial Sequence: Synthetic coding sequence
atgcccgtgctgaagcagctgggccccgcccagcccaagaagagacccgacagaggcgccctgagcatcagcgcccccctgggcgacttcagacacaccctgcacgtgggcagaggcggcgacgccttcggcgacaccagcttcctgagcagacacggcggcggccccccccccgagcccagagccccccccgccggcgcccccagaagcccccccccccccgccgtgccccagagcgccgcccccagccccgccgaccccctgctgagcttccacctggacctgggccccagcatgctggacgccgtgctgggcgtgatggacgccgccagacccgaggccgccgccgccaagcccgacgccgagcccagacccggcacccagcccccccaggccagatgcagacccaacgccgacctggagctgaacgacgtgatcggcctgtag

SEQ ID NO: 16896 - DNA, 240 bp, Artificial Sequence
  Description of Artificial Sequence: Synthetic coding sequence
atgagcgagttctggcacaagctgggctgctgcgtggtggagaagccccagcccaagaagaagagaagaagaatcgacagaaccatgatcggcgagcccatgaacttcgtgcacctgacccacatcggcagcggcgagatgggcgccggcgacggcctggccatgaccggcgccgtgcaggagcagatgagaagcaagggcaacagagacagaccctggagcaacagcagaggcctgtag

SEQ ID NO: 16897 - DNA, 240 bp, Artificial Sequence; identical to SEQ ID NO: 16896
  Description of Artificial Sequence: Synthetic coding sequence

SEQ ID NO: 16898 - DNA, 255 bp, Artificial Sequence
  Description of Artificial Sequence: Synthetic coding sequence
atgagcgagttctggctgtgcttcaactgctgcatcgccgagcagccccagcccaagagaagaagaagaatcgacagaagcatgatcggcgagcccaccaacttcgtgcacaccgcccacgtgggcagcggcgacctgttcagcggcatgaacagcgtgagcagcatccagaaccagatgcagagcaagggcggctacggcggcggcatgcccgccaacgtgcagatgcagctggtggacaccaaggccggctag

SEQ ID NO: 16899 - DNA, 255 bp, Artificial Sequence; identical to SEQ ID NO: 16898
  Description of Artificial Sequence: Synthetic coding sequence

SEQ ID NO: 16900 - DNA, 255 bp, Artificial Sequence; identical to SEQ ID NO: 16898
  Description of Artificial Sequence: Synthetic coding sequence

SEQ ID NO: 16901 - DNA, 1482 bp, Artificial Sequence
  Description of Artificial Sequence: Synthetic coding sequence
atgttccccgtgttcccctgcaccctgctggccccccccttccccgtgctgggcctggacagcagaggcgtgggcggcctgatgaacagcttcccccccccccagggccacgcccagaaccccctgcaggtgggcgccgagctgcagagcagattcttcgccagccagggctgcgcccagagccccttccaggccgcccccgcccccccccccaccccccaggcccccgccgccgagcccctgcaggtggacctgctgcccgtgctggccgccgcccaggagagcgccgccgccgccgccgccgccgccgccgccgccgccgccgtggccgccgccccccccgcccccgccgccgccagcaccgtggacaccgccgccctgaagcagccccccgcccccccccccccccccccccccgtgagcgcccccgccgccgaggccgccccccccgccagcgccgccaccatcgccgccgccgccgccaccgccgtggtggcccccaccagcaccgtggccgtggcccccgtggccagcgccctggagaagaagaccaagagcaagggcccctacatctgcgccctgtgcgccaaggagttcaagaacggctacaacctgagaagacacgaggccatccacaccggcgccaaggccggcagagtgcccagcggcgccatgaagatgcccaccatggtgcccctgagcctgctgagcgtgccccagctgagcggcgccggcggcggcggcggcgaggccggcgccggcggcggcgccgccgccgtggccgccggcggcgtggtgaccaccaccgccagcggcaagagaatcagaaagaaccacgcctgcgagatgtgcggcaaggccttcagagacgtgtaccacctgaacagacacaagctgagccacagcgacgagaagccctaccagtgccccgtgtgccagcagagattcaagagaaaggacagaatgagctaccacgtgagaagccacgacggcgccgtgcacaagccctacaactgcagccactgcggcaagagcttcagcagacccgaccacctgaacagccacgtgagacaggtgcacagcaccgagagacccttcaagtgcgagaagtgcgaggccgccttcgccaccaaggacagactgagagcccacaccgtgagacacgaggagaaggtgccctgccacgtgtgcggcaagatgctgagcagcgcctacatcagcgaccacatgaaggtgcacagccagggcccccaccacgtgtgcgagctgtgcaacaagggcttcaccaccgccgcctacctgagaatccacgccgtgaaggaccacggcctgcaggcccccagagccgacagaatcctgtgcaagctgtgcagcgtgcactgcaagacccccgcccagctggccggccacatgcagacccacctgggcggcgccgccccccccgtgcccggcgacgccccccagccccagcccacctgctag

SEQ ID NO: 16902 - DNA, 549 bp, Artificial Sequence
  Description of Artificial Sequence: Synthetic coding sequence
atgctgcccaccgccgccggcttcagcatctggggccagcccggcgccgccagagaggcccccagatgccagaccaagatcagcagctgcagctgccccaccagcagcgtgagcgccgcccacggccccggccccaacgagagagccagaggcctgggcggcctgcccgaccccgccctgagccccagagtgcccttccagggctacgccagaatcgtgttcgccatcatcagcttctacttcatgccctgctgccccctgaccgccagcagcttctacctgctgagcggcctgctggacgccttcgacggccacgccgccagagccctgaaccagggcaccagattcggcgccatgctggacatgctgaccgacagatgcagcaccatgtgcctgctggtgaacctggccctgctgtaccccggcgccaccctgttcttccagatcagcatgagcctggacgtggccagccactggctgcacctgcacagaagcgccgccatcctgggcgcctgggccacctggagacactacagcggcgtgggctag

SEQ ID NO: 16903 - DNA, 1215 bp, Artificial Sequence
  Description of Artificial Sequence: Synthetic coding sequence
atgatctggaagagaagcgccgtgctgagattctacagcgtgtgcggcctgctgctgcaggccgccgccagcaagaacaaggtgaagggcagccagggccagttccccctgacccagaacgtgaccgtggtggagggcggcaccgccatcctgacctgcagagtggaccagaacgacaacaccagcctgcagtggagcaaccccgcccagcagaccctgtacttcgacgacaagaaggccctgagagacaacagaatcgagctggtgagagccagctggcacgagctgagcatcagcgtgagcgacgtgagcctgagcgacgagggccagtacacctgcagcctgttcaccatgcccgtgaagaccagcaaggcctacctgaccgtgctgggcgtgcccgagaagccccagatcagcggcttcagcagccccgtgatggagggcgacctgatgcagctgacctgcaagaccagcggcagcaagcccgccgccgacatcagatggttcaagaacgacaaggagatcaaggacgtgaagtacctgaaggaggaggacgccaacagaaagaccttcaccgtgagcagcaccctggacttcagagtggacagaagcgacgacggcgtggccgtgatctgcagagtggaccacgagagcctgaacgccaccccccaggtggccatgcaggtgctggagatccactacacccccagcgtgaagatcatccccagcacccccttcccccaggagggccagcccctgatcctgacctgcgagagcaagggcaagcccctgcccgagcccgtgctgtggaccaaggacggcggcgagctgcccgaccccgacagaatggtggtgagcggcagagagctgaacatcctgttcctgaacaagaccgacaacggcacctacagatgcgaggccaccaacaccatcggccagagcagcgccgagtacgtgctgatcgtgcacgaccccaacgccctggccggccagaacggccccgaccacgccctgatcggcggcatcgtggccgtggtggtgttcgtgaccctgtgcagcatcttcctgctgggcagatacctggccagacacaagggcacctacctgaccaacgaggccaagggcgccgaggacgcccccgacgccgacaccgccatcatcaacgccgagggcagccaggtgaacgccgaggagaagaaggagtacttcatctag

SEQ ID NO: 16904 - DNA, 1314 bp, Artificial Sequence
  Description of Artificial Sequence: Synthetic coding sequence
atgttcgtgctgttcctgtgcaacctgagcctggtgcccgccgccgccagcaagaacaaggtgaagggcagccagggccagttccccctgacccagaacgtgaccgtggtggagggcggcaccgccatcctgacctgcagagtggaccagaacgacaacaccagcctgcagtggagcaaccccgcccagcagaccctgtacttcgacgacaagaaggccctgagagacaacagaatcgagctggtgagagccagctggcacgagctgagcatcagcgtgagcgacgtgagcctgagcgacgagggccagtacacctgcagcctgttcaccatgcccgtgaagaccagcaaggcctacctgaccgtgctgggcgtgcccgagaagccccagatcagcggcttcagcagccccgtgatggagggcgacctgatgcagctgacctgcaagaccagcggcagcaagcccgccgccgacatcagatggttcaagaacgacaaggagatcaaggacgtgaagtacctgaaggaggaggacgccaacagaaagaccttcaccgtgagcagcaccctggacttcagagtggacagaagcgacgacggcgtggccgtgatctgcagagtggaccacgagagcctgaacgccaccccccaggtggccatgcaggtgctggagatccactacacccccagcgtgaagatcatccccagcacccccttcccccaggagggccagcccctgatcctgacctgcgagagcaagggcaagcccctgcccgagcccgtgctgtggaccaaggacggcggcgagctgcccgaccccgacagaatggtggtgagcggcagagagctgaacatcctgttcctgaacaagaccgacaacggcacctacagatgcgaggccaccaacaccatcggccagagcagcgccgagtacgtgctgatcgtgcacgacgtgcccaacaccctgctgcccaccaccatcatccccagcctgaccaccgccaccgtgaccaccaccgtggccatcaccaccagccccaccaccagcgccaccaccagcagcatcagagaccccaacgccctggccggccagaacggccccgaccacgccctgatcggcggcatcgtggccgtggtggtgttcgtgaccctgtgcagcatcttcctgctgggcagatacctggccagacacaagggcacctacctgaccaacgaggccaagggcgccgaggacgcccccgacgccgacaccgccatcatcaacgccgagggcagccaggtgaacgccgaggagaagaaggagtacttcatctag

SEQ ID NO: 16905 - DNA, 1308 bp, Artificial Sequence
  Description of Artificial Sequence: Synthetic coding sequence
atgatctggaagagaagcgccgtgctgagattctacagcgtgtgcggcctgctgctgcagggcagccagggccagttccccctgacccagaacgtgaccgtggtggagggcggcaccgccatcctgacctgcagagtggaccagaacgacaacaccagcctgcagtggagcaaccccgcccagcagaccctgtacttcgacgacaagaaggccctgagagacaacagaatcgagctggtgagagccagctggcacgagctgagcatcagcgtgagcgacgtgagcctgagcgacgagggccagtacacctgcagcctgttcaccatgcccgtgaagaccagcaaggcctacctgaccgtgctgggcgtgcccgagaagccccagatcagcggcttcagcagccccgtgatggagggcgacctgatgcagctgacctgcaagaccagcggcagcaagcccgccgccgacatcagatggttcaagaacgacaaggagatcaaggacgtgaagtacctgaaggaggaggacgccaacagaaagaccttcaccgtgagcagcaccctggacttcagagtggacagaagcgacgacggcgtggccgtgatctgcagagtggaccacgagagcctgaacgccaccccccaggtggccatgcaggtgctggagatccactacacccccagcgtgaagatcatccccagcacccccttcccccaggagggccagcccctgatcctgacctgcgagagcaagggcaagcccctgcccgagcccgtgctgtggaccaaggacggcggcgagctgcccgaccccgacagaatggtggtgagcggcagagagctgaacatcctgttcctgaacaagaccgacaacggcacctacagatgcgaggccaccaacaccatcggccagagcagcgccgagtacgtgctgatcgtgcacgacgtgcccaacaccctgctgcccaccaccatcatccccagcctgaccaccgccaccgtgaccaccaccgtggccatcaccaccagccccaccaccagcgccaccaccagcagcatcagagaccccaacgccctggccggccagaacggccccgaccacgccctgatcggcggcatcgtggccgtggtggtgttcgtgaccctgtgcagcatcttcctgctgggcagatacctggccagacacaagggcacctacctgaccaacgaggccaagggcgccgaggacgcccccgacgccgacaccgccatcatcaacgccgagggcagccaggtgaacgccgaggagaagaaggagtacttcatctag

SEQ ID NO: 16906 - DNA, 1299 bp, Artificial Sequence
  Description of Artificial Sequence: Synthetic coding sequence
atgggcgcccccgccgccagcctgctgctgctgctgctgctgttcgcctgctgctgggcccccggcggcgccaacctgagccaggacggctactggcaggagcaggacctggagctgggcaccctggcccccctggacgaggccatcagcagcaccgtgtggagcagccccgacatgctggccagccaggacagccagccctggaccagcgacgagaccgtggtggccggcggcaccgtggtgctgaagtgccaggtgaaggaccacgaggacagcagcctgcagtggagcaaccccgcccagcagaccctgtacttcggcgagaagagagccctgagagacaacagaatccagctggtgaccagcaccccccacgagctgagcatcagcatcagcaacgtggccctggccgacgagggcgagtacacctgcagcatcttcaccatgcccgtgagaaccgccaagagcctggtgaccgtgctgggcatcccccagaagcccatcatcaccggctacaagagcagcctgagagagaaggacaccgccaccctgaactgccagagcagcggcagcaagcccgccgccagactgacctggagaaagggcgaccaggagctgcacggcgagcccaccagaatccaggaggaccccaacggcaagaccttcaccgtgagcagcagcgtgaccttccaggtgaccagagaggacgacggcgccagcatcgtgtgcagcgtgaaccacgagagcctgaagggcgccgacagaagcaccagccagagaatcgaggtgctgtacacccccaccgccatgatcagacccgaccccccccaccccagagagggccagaagctgctgctgcactgcgagggcagaggcaaccccgtgccccagcagtacctgtgggagaaggagggcagcgtgccccccctgaagatgacccaggagagcgccctgatcttccccttcctgaacaagagcgacagcggcacctacggctgcaccgccaccagcaacatgggcagctacaaggcctactacaccctgaacgtgaacgaccccagccccgtgcccagcagcagcagcacctaccacgccatcatcggcggcatcgtggccttcatcgtgttcctgctgctgatcatgctgatcttcctgggccactacctgatcagacacaagggcacctacctgacccacgaggccaagggcagcgacgacgcccccgacgccgacaccgccatcatcaacgccgagggcggccagagcggcggcgacgacaagaaggagtacttcatctag

SEQ ID NO: 16907 - DNA, 1197 bp, Artificial Sequence
  Description of Artificial Sequence: Synthetic coding sequence
atgggcgcccccgccgccagcctgctgctgctgctgctgctgttcgcctgctgctgggcccccggcggcgccaacctgagccaggacgacagccagccctggaccagcgacgagaccgtggtggccggcggcaccgtggtgctgaagtgccaggtgaaggaccacgaggacagcagcctgcagtggagcaaccccgcccagcagaccctgtacttcggcgagaagagagccctgagagacaacagaatccagctggtgaccagcaccccccacgagctgagcatcagcatcagcaacgtggccctggccgacgagggcgagtacacctgcagcatcttcaccatgcccgtgagaaccgccaagagcctggtgaccgtgctgggcatcccccagaagcccatcatcaccggctacaagagcagcctgagagagaaggacaccgccaccctgaactgccagagcagcggcagcaagcccgccgccagactgacctggagaaagggcgaccaggagctgcacggcgagcccaccagaatccaggaggaccccaacggcaagaccttcaccgtgagcagcagcgtgaccttccaggtgaccagagaggacgacggcgccagcatcgtgtgcagcgtgaaccacgagagcctgaagggcgccgacagaagcaccagccagagaatcgaggtgctgtacacccccaccgccatgatcagacccgaccccccccaccccagagagggccagaagctgctgctgcactgcgagggcagaggcaaccccgtgccccagcagtacctgtgggagaaggagggcagcgtgccccccctgaagatgacccaggagagcgccctgatcttccccttcctgaacaagagcgacagcggcacctacggctgcaccgccaccagcaacatgggcagctacaaggcctactacaccctgaacgtgaacgaccccagccccgtgcccagcagcagcagcacctaccacgccatcatcggcggcatcgtggccttcatcgtgttcctgctgctgatcatgctgatcttcctgggccactacctgatcagacacaagggcacctacctgacccacgaggccaagggcagcgacgacgcccccgacgccgacaccgccatcatcaacgccgagggcggccagagcggcggcgacgacaagaaggagtacttcatctag

SEQ ID NO: 16908 - DNA, 705 bp, Artificial Sequence
  Description of Artificial Sequence: Synthetic coding sequence
atgggcgcccccgccgccagcctgctgctgctgctgctgctgttcgcctgctgctgggcccccggcggcgccaacctgagccaggacgacagccagccctggaccagcgacgagaccgtggtggccggcggcaccgtggtgctgaagtgccaggtgaaggaccacgaggacagcagcctgcagtggagcaaccccgcccagcagaccctgtacttcggcgagaagagagccctgagagacaacagaatccagctggtgaccagcaccccccacgagctgagcatcagcatcagcaacgtggccctggccgacgagggcgagtacacctgcagcatcttcaccatgcccgtgagaaccgccaagagcctggtgaccgtgctgggcatcccccagaagcccatcatcaccggctacaagagcagcctgagagagaaggacaccgccaccctgaactgccagagcagcggcagcaagcccgccgccagactgacctggagaaagggcgaccaggagctgcacggcgagcccaccagaatccaggaggaccccaacgacacccccaccgccatgatcagacccgaccccccccaccccagagagggccagaagctgctgctgcactgcgagggcagaggcaaccccgtgccccagcagtacctgtgggagaaggagggcagcgtgccccccctgaagatgacccagtag

SEQ ID NO: 16909 - DNA, 2130 bp, Artificial Sequence
  Description of Artificial Sequence: Synthetic coding sequence
atgcccagcgccaccagccacagcggcagcggcagcaagagcagcggcccccccccccccagcggcagcagcggcagcgaggccgccgccggcgccggcgccgccgcccccgccagccagcaccccgccaccggcaccggcgccgtgcagaccgaggccatgaagcagatcctgggcgtgatcgacaagaagctgagaaacctggagaagaagaagggcaagctggacgactaccaggagagaatgaacaagggcgagagactgaaccaggaccagctggacgccgtgagcaagtaccaggaggtgaccaacaacctggagttcgccaaggagctgcagagaagcttcatggccctgagccaggacatccagaagaccatcaagaagaccgccagaagagagcagctgatgagagaggaggccgagcagaagagactgaagaccgtgctggagctgcagtacgtgctggacaagctgggcgacgacgaggtgagaaccgacctgaagcagggcctgaacggcgtgcccatcctgagcgaggaggagctgagcctgctggacgagttctacaagctggtggaccccgagagagacatgagcctgagactgaacgagcagtacgagcacgccagcatccacctgtgggacctgctggagggcaaggagaagcccgtgtgcggcaccacctacaaggtgctgaaggagatcgtggagagagtgttccagagcaactacttcgacagcacccacaaccaccagaacggcctgtgcgaggaggaggaggccgccagcgcccccgccgtggaggaccaggtgcccgaggccgagcccgagcccgccgaggagtacaccgagcagagcgaggtggagagcaccgagtacgtgaacagacagttcatggccgagacccagttcaccagcggcgagaaggagcaggtggacgagtggaccgtggagaccgtggaggtggtgaacagcctgcagcagcagccccaggccgccagccccagcgtgcccgagccccacagcctgacccccgtggcccaggccgaccccctggtgagaagacagagagtgcaggacctgatggcccagatgcagggcccctacaacttcatccaggacagcatgctggacttcgagaaccagaccctggaccccgccatcgtgagcgcccagcccatgaaccccacccagaacatggacatgccccagctggtgtgcccccccgtgcacagcgagagcagactggcccagcccaaccaggtgcccgtgcagcccgaggccacccaggtgcccctggtgagcagcaccagcgagggctacaccgccagccagcccctgtaccagcccagccacgccaccgagcagagaccccagaaggagcccatcgaccagatccaggccaccatcagcctgaacaccgaccagaccaccgccagcagcagcctgcccgccgccagccagccccaggtgttccaggccggcaccagcaagcccctgcacagcagcggcatcaacgtgaacgccgcccccttccagagcatgcagaccgtgttcaacatgaacgcccccgtgccccccgtgaacgagcccgagaccctgaagcagcagaaccagtaccaggccagctacaaccagagcttcagcagccagccccaccaggtggagcagaccgagctgcagcaggagcagctgcagaccgtggtgggcacctaccacggcagccccgaccagagccaccaggtgaccggcaaccaccagcagcccccccagcagaacaccggcttccccagaagcaaccagccctactacaacagcagaggcgtgagcagaggcggcagcagaggcgccagaggcctgatgaacggctacagaggccccgccaacggcttcagaggcggctacgacggctacagacccagcttcagcaacacccccaacagcggctacacccagagccagttcagcgcccccagagactacagcggctaccagagagacggctaccagcagaacttcaagagaggcagcggccagagcggccccagaggcgcccccagaggcagaggcggcccccccagacccaacagaggcatgccccagatgaacacccagcaggtgaactag

SEQ ID NO: 16910 - DNA, 2130 bp, Artificial Sequence; identical to SEQ ID NO: 16909
  Description of Artificial Sequence: Synthetic coding sequence

SEQ ID NO: 16911 - DNA, 2085 bp, Artificial Sequence
  Description of Artificial Sequence: Synthetic coding sequence
atgcccagcgccaccagccacagcggcagcggcagcaagagcagcggcccccccccccccagcggcagcagcggcagcgaggccgccgccggcgccggcgccgccgcccccgccagccagcaccccgccaccggcaccggcgccgtgcagaccgaggccatgaagcagatcctgggcgtgatcgacaagaagctgagaaacctggagaagaagaagggcaagctggacgactaccaggagagaatgaacaagggcgagagactgaaccaggaccagctggacgccgtgagcaagtaccaggaggtgaccaacaacctggagttcgccaaggagctgcagagaagcttcatggccctgagccaggacatccagaagaccatcaagaagaccgccagaagagagcagctgatgagagaggaggccgagcagaagagactgaagaccgtgctggagctgcagtacgtgctggacaagctgggcgacgacgaggtgagaaccgacctgaagcagggcctgaacggcgtgcccatcctgagcgaggaggagctgagcctgctggacgagttctacaagctggtggaccccgagagagacatgagcctgagactgaacgagcagtacgagcacgccagcatccacctgtgggacctgctggagggcaaggagaagcccgtgtgcggcaccacctacaaggtgctgaaggagatcgtggagagagtgttccagagcaactacttcgacagcacccacaaccaccagaacggcctgtgcgaggaggaggaggccgccagcgcccccgccgtggaggaccaggtgcccgaggccgagcccgagcccgccgaggagtacaccgagcagagcgaggtggagagcaccgagtacgtgaacagacagttcatggccgagacccagttcaccagcggcgagaaggagcaggtggacgagtggaccgtggagaccgtggaggtggtgaacagcctgcagcagcagccccaggccgccagccccagcgtgcccgagccccacagcctgacccccgtggcccaggccgaccccctggtgagaagacagagagtgcaggacctgatggcccagatgcagggcccctacaacttcatccaggacagcatgctggacttcgagaaccagaccctggaccccgccatcgtgagcgcccagcccatgaaccccacccagaacatggacatgccccagctggtgtgcccccccgtgcacagcgagagcagactggcccagcccaaccaggtgcccgtgcagcccgaggccacccaggtgcccctggtgagcagcaccagcgagggctacaccgccagccagcccctgtaccagcccagccacgccaccgagcagagaccccagaaggagcccatcgaccagatccaggccaccatcagcctgaacaccgaccagaccaccgccagcagcagcctgcccgccgccagccagccccaggtgttccaggccggcaccagcaagcccctgcacagcagcggcatcaacgtgaacgccgcccccttccagagcatgcagaccgtgttcaacatgaacgcccccgtgccccccgtgaacgagcccgagaccctgaagcagcagaaccagtaccaggccagctacaaccagagcttcagcagccagccccaccaggtggagcagaccgagctgcagcaggagcagctgcagaccgtggtgggcacctaccacggcagccccgaccagagccaccaggtgaccggcaaccaccagcagcccccccagcagaacaccggcttccccagaagcaaccagccctactacaacagcagaggcgtgagcagaggcggcagcagaggcgccagaggcctgatgaacggctacagaggccccgccaacggcttcagaggcggctacgacggctacagacccagcttcagcaacacccccaacagcggctacacccagagccagttcagcgcccccagagactacagcggctaccagagagacggctaccagcagaacttcaagagaggcagcggccagagcggccccagaggcgcccccagaggcaacatcctgtggtggtag

SEQ ID NO: 16912 - DNA, 2274 bp, Artificial Sequence
  Description of Artificial Sequence: Synthetic coding sequence
atgagcgagaacagcagcgacagcgacagcagctgcggctggaccgtgatcagccacgagggcagcgacatcgagatgctgaacagcgtgacccccaccgacagctgcgagcccgcccccgagtgcagcagcctggagcaggaggagctgcaggccctgcagatcgagcagggcgagagcagccagaacggcaccgtgctgatggaggagaccgcctaccccgccctggaggagaccagcagcaccatcgaggccgaggagcagaagatccccgaggacagcatctacatcggcaccgccagcgacgacagcgacatcgtgaccctggagccccccaagctggaggagatcggcaaccaggaggtggtgatcgtggaggaggcccagagcagcgaggacttcaacatgggcagcagcagcagcagccagtacaccttctgccagcccgagaccgtgttcagcagccagcccagcgacgacgagagcagcagcgacgagaccagcaaccagcccagccccgccttcagaagaagaagagccagaaagaagaccgtgagcgccagcgagagcgaggacagactggtggccgagcaggagaccgagcccagcaaggagctgagcaagagacagttcagcagcggcctgaacaagtgcgtgatcctggccctggtgatcgccatcagcatgggcttcggccacttctacggcaccatccagatccagaagagacagcagctggtgagaaagatccacgaggacgagctgaacgacatgaaggactacctgagccagtgccagcaggagcaggagagcttcatcgactacaagagcctgaaggagaacctggccagatgctggaccctgaccgaggccgagaagatgagcttcgagacccagaagaccaacctggccaccgagaaccagtacctgagagtgagcctggagaaggaggagaaggccctgagcagcctgcaggaggagctgaacaagctgagagagcagatcagaatcctggaggacaagggcaccagcaccgagctggtgaaggagaaccagaagctgaagcagcacctggaggaggagaagcagaagaagcacagcttcctgagccagagagagaccctgctgaccgaggccaagatgctgaagagagagctggagagagagagactggtgaccaccgccctgagaggcgagctgcagcagctgagcggcagccagctgcacggcaagagcgacagccccaacgtgtacaccgagaagaaggagatcgccatcctgagagagagactgaccgagctggagagaaagctgaccttcgagcagcagagaagcgacctgtgggagagactgtacgtggaggccaaggaccagaacggcaagcagggcaccgacggcaagaagaagggcggcagaggcagccacagagccaagaacaagagcaaggagaccttcctgggcagcgtgaaggagaccttcgacgccatgaagaacagcaccaaggagttcgtgagacaccacaaggagaagatcaagcaggccaaggaggccgtgaaggagaacctgaagaagttcagcgacagcgtgaagagcaccttcagacacttcaaggacaccaccaagaacatcttcgacgagaagggcaacaagagattcggcgccaccaaggaggccgccgagaagcccagaaccgtgttcagcgactacctgcacccccagtacaaggcccccaccgagaaccaccacaacagaggccccaccatgcagaacgacggcagaaaggagaagcccgtgcacttcaaggagttcagaaagaacaccaacagcaagaagtgcagccccggccacgactgcagagagaacagccacagcttcagaaaggcctgcagcggcgtgttcgactgcgcccagcaggagagcatgagcctgttcaacaccgtggtgaaccccatcagaatggacgagttcagacagatcatccagagatacatgctgaaggagctggacaccttctgccactggaacgagctggaccagttcatcaacaagttcttcctgaacggcgtgttcatccacgaccagaagctgttcaccgacttcgtgaacgacgtgaaggactacctgagaaacatgaaggagtacgaggtggacaacgacggcgtgttcgagaagctggacgagtacatctacagacacttcttcggccacaccttcagccccccctacggccccagaagcgtgtacatcaagccctgccactacagcagcctgtag

SEQ ID NO: 16913 - DNA, 1275 bp, Artificial Sequence
  Description of Artificial Sequence: Synthetic coding sequence
atgagcgagaacagcagcgacagcgacagcagctgcggctggaccgtgatcagccacgagggcagcgacatcgagatgctgaacagcgtgacccccaccgacagctgcgagcccgcccccgagtgcagcagcctggagcaggaggagctgcaggccctgcagatcgagcagggcgagagcagccagaacggcaccgtgctgatggaggagaccgcctaccccgccctggaggagaccagcagcaccatcgaggccgaggagcagaagatccccgaggacagcatctacatcggcaccgccagcgacgacagcgacatcgtgaccctggagccccccaagctggaggagatcggcaaccaggaggtggtgatcgtggaggaggcccagagcagcgaggacttcaacatgggcagcagcagcagcagccagtacaccttctgccagcccgagaccgtgttcagcagccagcccagcgacgacgagagcagcagcgacgagaccagcaaccagcccagccccgccttcagaagaagaagagccagaaagaagaccgtgagcgccagcgagagcgaggacagactggtggccgagcaggagaccgagcccagcaaggagctgagcaagagacagttcagcagcggcctgaacaagtgcgtgatcctggccctggtgatcgccatcagcatgggcttcggccacttctacggcaccatccagatccagaagagacagcagctggtgagaaagatccacgaggacgagctgaacgacatgaaggactacctgagccagtgccagcaggagcaggagagcttcatcgactacaagagcctgaaggagaacctggccagatgctggaccctgaccgaggccgagaagatgagcttcgagacccagaagaccaacctggccaccgagaaccagtacctgagaaagctgttcaccgacttcgtgaacgacgtgaaggactacctgagaaacatgaaggagtacgaggtggacaacgacggcgtgttcgagaagctggacgagtacatctacagacacttcttcggccacaccttcagccccccctacggccccagcagacccgacaagaagcagagaatggtgaacatcgagaacagcagacacagaaagcaggagcagaagcacctgcagccccagccctacaagagagagggcaagtggcacaagtacggcagaaccaacggcagacagatggccaacctggagatcgagctgggccagctgcccttcgacccccagtactag

SEQ ID NO: 16914 - DNA, 2424 bp, Artificial Sequence
  Description of Artificial Sequence: Synthetic coding sequence
atgagcgagaacagcagcgacagcgacagcagctgcggctggaccgtgatcagccacgagggcagcgacatcgagatgctgaacagcgtgacccccaccgacagctgcgagcccgcccccgagtgcagcagcctggagcaggaggagctgcaggccctgcagatcgagcagggcgagagcagccagaacggcaccgtgctgatggaggagaccgcctaccccgccctggaggagaccagcagcaccatcgaggccgaggagcagaagatccccgaggacagcatctacatcggcaccgccagcgacgacagcgacatcgtgaccctggagccccccaagctggaggagatcggcaaccaggaggtggtgatcgtggaggaggcccagagcagcgaggacttcaacatgggcagcagcagcagcagccagtacaccttctgccagcccgagaccgtgttcagcagccagcccagcgacgacgagagcagcagcgacgagaccagcaaccagcccagccccgccttcagaagaagaagagccagaaagaagaccgtgagcgccagcgagagcgaggacagactggtggccgagcaggagaccgagcccagcaaggagctgagcaagagacagttcagcagcggcctgaacaagtgcgtgatcctggccctggtgatcgccatcagcatgggcttcggccacttctacggcaccatccagatccagaagagacagcagctggtgagaaagatccacgaggacgagctgaacgacatgaaggactacctgagccagtgccagcaggagcaggagagcttcatcgactacaagagcctgaaggagaacctggccagatgctggaccctgaccgaggccgagaagatgagcttcgagacccagaagaccaacctggccaccgagaaccagtacctgagagtgagcctggagaaggaggagaaggccctgagcagcctgcaggaggagctgaacaagctgagagagcagatcagaatcctggaggacaagggcaccagcaccgagctggtgaaggagaaccagaagctgaagcagcacctggaggaggagaagcagaagaagcacagcttcctgagccagagagagaccctgctgaccgaggccaagatgctgaagagagagctggagagagagagactggtgaccaccgccctgagaggcgagctgcagcagctgagcggcagccagctgcacggcaagagcgacagccccaacgtgtacaccgagaagaaggagatcgccatcctgagagagagactgaccgagctggagagaaagctgaccttcgagcagcagagaagcgacctgtgggagagactgtacgtggaggccaaggaccagaacggcaagcagggcaccgacggcaagaagaagggcggcagaggcagccacagagccaagaacaagagcaaggagaccttcctgggcagcgtgaaggagaccttcgacgccatgaagaacagcaccaaggagttcgtgagacaccacaaggagaagatcaagcaggccaaggaggccgtgaaggagaacctgaagaagttcagcgacagcgtgaagagcaccttcagacacttcaaggacaccaccaagaacatcttcgacgagaagggcaacaagagattcggcgccaccaaggaggccgccgagaagcccagaaccgtgttcagcgactacctgcacccccagtacaaggcccccaccgagaaccaccacaacagaggccccaccatgcagaacgacggcagaaaggagaagcccgtgcacttcaaggagttcagaaagaacaccaacagcaagaagtgcagccccggccacgactgcagagagaacagccacagcttcagaaaggcctgcagcggcgtgttcgactgcgcccagcaggagagcatgagcctgttcaacaccgtggtgaaccccatcagaatggacgagttcagacagatcatccagagatacatgctgaaggagctggacaccttctgccactggaacgagctggaccagttcatcaacaagttcttcctgaacggcgtgttcatccacgaccagaagctgttcaccgacttcgtgaacgacgtgaaggactacctgagaaacatgaaggagtacgaggtggacaacgacggcgtgttcgagaagctggacgagtacatctacagacacttcttcggccacaccttcagccccccctacggccccagcagacccgacaagaagcagagaatggtgaacatcgagaacagcagacacagaaagcaggagcagaagcacctgcagccccagccctacaagagagagggcaagtggcacaagtacggcagaaccaacggcagacagatggccaacctggagatcgagctgggccagctgcccttcgacccccagtactag

SEQ ID NO: 16915 - DNA, 717 bp, Artificial Sequence
  Description of Artificial Sequence: Synthetic coding sequence
atggagtacgccatgaagagcctgagcctgctgtaccccaagagcctgagcagacacgtgagcgtgagaaccagcgtggtgacccagcagctgctgagcgagcccagccccaaggcccccagagccagaccctgcagagtgagcaccgccgacagaagcgtgagaaagggcatcatggcctacagcctggaggacctgctgctgaaggtgagagacaccctgatgctggccgacaagcccttcttcctggtgctggaggaggacggcaccaccgtggagaccgaggagtacttccaggccctggccggcgacaccgtgttcatggtgctgcagaagggccagaagtggcagccccccagcgagcagggcaccagacaccccctgagcctgagccacaagcccgccaagaagatcgacgtggccagagtgaccttcgacctgtacaagctgaacccccaggacttcatcggctgcctgaacgtgaaggccaccttctacgacacctacagcctgagctacgacctgcactgctgcggcgccaagagaatcatgaaggaggccttcagatgggccctgttcagcatgcaggccaccggccacgtgctgctgggcaccagctgctacctgcagcagctgctggacgccaccgaggagggccagccccccaagggcaaggccagcagcctgatccccacctgcctgaagatcctgcagtag

SEQ ID NO: 16916 - DNA, 402 bp, Artificial Sequence
  Description of Artificial Sequence: Synthetic coding sequence
atggagtacgccatgaagagcctgagcctgctgtaccccaagagcctgagcagacacgtgagcgtgagaaccagcgtggtgacccagcagctgctgagcgagcccagccccaaggcccccagagccagaccctgcagagtgagcaccgccgacagaagcgtgagaaagggcatcatggcctacagcctggaggacctgctgctgaagggcagcttccccctgggccccctgcagcacgccggccacagacccagaaccgcctggcacctgctgctgcccgccgccgcccccagatgctacggcggcagagccgccccccagggccagggcctgatcccctaccccgacctgagcgaggacaccgccgtgaaggcccaggtgctgggcagcttcccccagtag

SEQ ID NO: 16917 - DNA, 495 bp, Artificial Sequence
  Description of Artificial Sequence: Synthetic coding sequence
atgctggccgacaagcccttcttcctggtgctggaggaggacggcaccaccgtggagaccgaggagtacttccaggccctggccggcgacaccgtgttcatggtgctgcagaagggccagaagtggcagccccccagcgagcagggcaccagacaccccctgagcctgagccacaagcccgccaagaagatcgacgtggccagagtgaccttcgacctgtacaagctgaacccccaggacttcatcggctgcctgaacgtgaaggccaccttctacgacacctacagcctgagctacgacctgcactgctgcggcgccaagagaatcatgaaggaggccttcagatgggccctgttcagcatgcaggccaccggccacgtgctgctgggcaccagctgctacctgcagcagctgctggacgccaccgaggagggccagccccccaagggcaaggccagcagcctgatccccacctgcctgaagatcctgcagtag

SEQ ID NO: 16918 - DNA, 495 bp, Artificial Sequence; identical to SEQ ID NO: 16917
  Description of Artificial Sequence: Synthetic coding sequence

SEQ ID NO: 16919 - DNA, 747 bp, Artificial Sequence
  Description of Artificial Sequence: Synthetic coding sequence
atggagtacgccatgaagagcctgagcctgctgtaccccaagagcctgagcagacacgtgagcgtgagaaccagcgtggtgacccagcagctgctgagcgagcccagccccaaggcccccagagccagaccctgcagagtgagcaccgccgacagaagcgtgagaaagggcatcatggcctacagcctggaggacctgctgctgaagaccagaaaccccgaggccagaagccaggaggtgagagacaccctgatgctggccgacaagcccttcttcctggtgctggaggaggacggcaccaccgtggagaccgaggagtacttccaggccctggccggcgacaccgtgttcatggtgctgcagaagggccagaagtggcagccccccagcgagcagggcaccagacaccccctgagcctgagccacaagcccgccaagaagatcgacgtggccagagtgaccttcgacctgtacaagctgaacccccaggacttcatcggctgcctgaacgtgaaggccaccttctacgacacctacagcctgagctacgacctgcactgctgcggcgccaagagaatcatgaaggaggccttcagatgggccctgttcagcatgcaggccaccggccacgtgctgctgggcaccagctgctacctgcagcagctgctggacgccaccgaggagggccagccccccaagggcaaggccagcagcctgatccccacctgcctgaagatcctgcagtag

SEQ ID NO: 16920 - DNA, 987 bp, Artificial Sequence
  Description of Artificial Sequence: Synthetic coding sequence
atggccaacagcgccagccccgagcagaaccagaaccactgcagcgccatcaacaacagcatccccctgatgcagggcaacctgcccaccctgaccctgagcggcaagatcagagtgaccgtgaccttcttcctgttcctgctgagcgccaccttcaacgccagcttcctgctgaagctgcagaagtggacccagaagaaggagaagggcaagaagctgagcagaatgaagctgctgctgaagcacctgaccctggccaacctgctggagaccctgatcgtgatgcccctggacggcatgtggaacatcaccgtgcagtggtacgccggcgagctgctgtgcaaggtgctgagctacctgaagctgttcagcatgtacgcccccgccttcatgatggtggtgatcagcctggacagaagcctggccatcaccagacccctggccctgaagagcaacagcaaggtgggccagagcatggtgggcctggcctggatcctgagcagcgtgttcgccggcccccagctgtacatcttcagaatgatccacctggccgacagcagcggccagaccaaggtgttcagccagtgcgtgacccactgcagcttcagccagtggtggcaccaggccttctacaacttcttcaccttcagctgcctgttcatcatccccctgttcatcatgctgatctgcaacgccaagatcatcttcaccctgaccagagtgctgcaccaggacccccacgagctgcagctgaaccagagcaagaacaacatccccagagccagactgaagaccctgaagatgaccgtggccttcgccaccagcttcaccgtgtgctggaccccctactacgtgctgggcatctggtactggttcgaccccgagatgctgaacagactgagcgaccccgtgaaccacttcttcttcctgttcgccttcctgaacccctgcttcgaccccctgatctacggctacttcagcctgtag

SEQ ID NO: 16921 - DNA, 504 bp, Artificial Sequence
  Description of Artificial Sequence: Synthetic coding sequence
atgagcctggccctgagaagcgagctggtggtggacaagaccaagagaaagaagagaagagagctgagcgaggagcagaagcaggagatcaaggacgccttcgagctgttcgacaccgacaaggacgaggccatcgactaccacgagctgaaggtggccatgagagccctgggcttcgacgtgaagaaggccgacgtgctgaagatcctgaaggactacgacagagaggccaccggcaagatcaccttcgaggacttcaacgaggtggtgaccgactggatcctggagagagacccccacgaggagatcctgaaggccttcaagctgttcgacgacgacgacagcggcaagatcagcctgagaaacctgagaagagtggccagagagctgggcgagaacatgagcgacgaggagctgagagccatgatcgaggagttcgacaaggacggcgacggcgagatcaaccaggaggagttcatcgccatcatgaccggcgacatctag

SEQ ID NO: 16922 - DNA, 789 bp, Artificial Sequence
  Description of Artificial Sequence: Synthetic coding sequence
atggccgtgaccgcccaggccgccagaagaaaggagagagtgctgtgcctgttcgacgtggacggcaccctgacccccgccagacagaagatcgaccccgaggtggccgccttcctgcagaagctgagaagcagagtgcagatcggcgtggtgggcggcagcgactactgcaagatcgccgagcagctgggcgacggcgacgaggtgatcgagaagttcgactacgtgttcgccgagaacggcaccgtgcagtacaagcacggcagactgctgagcaagcagaccatccagaaccacctgggcgaggagctgctgcaggacctgatcaacttctgcctgagctacatggccctgctgagactgcccaagaagagaggcaccttcatcgagttcagaaacggcatgctgaacatcagccccatcggcagaagctgcaccctggaggagagaatcgagttcagcgagctggacaagaaggagaagatcagagagaagttcgtggaggccctgaagaccgagttcgccggcaagggcctgagattcagcagaggcggcatgatcagcttcgacgtgttccccgagggctgggacaagagatactgcctggacagcctggaccaggacagcttcgacaccatccacttcttcggcaacgagaccagccccggcggcaacgacttcgagatcttcgccgaccccagaaccgtgggccacagcgtggtgagcccccaggacaccgtgcagagatgcagagagatcttcttccccgagaccgcccacgaggcctag

SEQ ID NO: 16923 - DNA, 1020 bp, Artificial Sequence
  Description of Artificial Sequence: Synthetic coding sequence
atgttcagcgaggtgctgcacggcctgatcggcagaacccagagaagcgccggcgtggaccagaaccaccccagagccgtgctggtgcccagcagcctgagaatcggcatcatccccgccggcagcaccgactgcgtgtgctacagcaccgtgggcaccagcgacgccgagaccagcgccctgcacatcgtggtgggcgacagcctggccatggacgtgagcagcgtgcaccacaacagcaccctgctgagatacagcgtgagcctgctgggctacggcttctacggcgacatcatcaaggacagcgagaagaagagatggctgggcctggccagatacgacttcagcggcctgaagaccttcctgagccaccactgctacgagggcaccgtgagcttcctgcccgcccagcacaccgtgggcagccccagagacagaaagccctgcagagccggctgcttcgtgtgcagacagagcaagcagcagctggaggaggagcagaagaaggccctgtacggcctggaggccgccgaggacgtggaggagtggcaggtggtgtgcggcaagttcctggccatcaacgccaccaacatgagctgcgcctgcagaagaagccccagaggcctgagccccgccgcccacctgggcgacggcagcagcgacctgatcctgatcagaaagtgcagcagattcaacttcctgagattcctgatcagacacaccaaccagcaggaccagttcgacttcaccttcgtggaggtgtacagagtgaagaagttccagttcaccagcaagcacatggaggacgaggacagcgacctgaaggagggcggcaagaagagattcggccacatctgcagcagccaccccagctgctgctgcaccgtgagcaacagcagctggaactgcgacggcgaggtgctgcacagccccgccatcgaggtgagagtgcactgccagctggtgagactgttcgccagaggcatcgaggagaaccccaagcccgacagccacagctag

SEQ ID NO: 16924 - DNA, 1053 bp, Artificial Sequence
  Description of Artificial Sequence: Synthetic coding sequence
atggccgccgccggccccgccgccggccccaccggccccgagcccatgcccagctacgcccagctggtgcagagaggctggggcagcgccctggccgccgccagaggctgcaccgactgcggctggggcctggccagaagaggcctggccgagcacgcccacctggccccccccgagctgctgctgctggccctgggcgccctgggctggaccgccctgagaagcgccgccaccgccagactgttcagacccctggccaagagatgctgcctgcagcccagagacgccgccaagatgcccgagagcgcctggaagttcctgttctacctgggcagctggagctacagcgcctacctgctgttcggcaccgactaccccttcttccacgacccccccagcgtgttctacgactggacccccggcatggccgtgcccagagacatcgccgccgcctacctgctgcagggcagcttctacggccacagcatctacgccaccctgtacatggacacctggagaaaggacagcgtggtgatgctgctgcaccacgtggtgaccctgatcctgatcgtgagcagctacgccttcagataccacaacgtgggcatcctggtgctgttcctgcacgacatcagcgacgtgcagctggagttcaccaagctgaacatctacttcaagagcagaggcggcagctaccacagactgcacgccctggccgccgacctgggctgcctgagcttcggcttcagctggttctggttcagactgtactggttccccctgaaggtgctgtacgccaccagccactgcagcctgagaaccgtgcccgacatccccttctacttcttcttcaacgccctgctgctgctgctgaccctgatgaacctgtactggttcctgtacatcgtggccttcgccgccaaggtgctgaccggccaggtgcacgagctgaaggacctgagagagtacgacaccgccgaggcccagagcctgaagcccagcaaggccgagaagcccctgagaaacggcctggtgaaggacaagagattctag

SEQ ID NO: 16925 - DNA, 1014 bp, Artificial Sequence
  Description of Artificial Sequence: Synthetic coding sequence
atggccgccgccggccccgccgccggccccaccggccccgagcccatgcccagctacgcccagctggtgcagagaggctggggcagcgccctggccgccgccagaggctgcaccgactgcggctggggcctggccagaagaggcctggccgagcacgcccacctggccccccccgagctgctgctgctggccctgggcgccctgggctggaccgccctgagaagcgccgccaccgccagactgttcagacccctggccaagagatgctgcctgcagcccagagacgccgccaagatgcccgagagcgcctggaagttcctgttctacctgggcagctggagctacagcgcctacctgctgttcggcaccgactaccccttcttccacgacccccccagcgtgttctacgactggacccccggcatggccgtgcccagagacatcgccgccgcctacctgctgcagggcagcttctacggccacagcatctacgccaccctgtacatggacacctggagaaaggacagcgtggtgatgctgctgcaccacgtggtgaccctgatcctgatcgtgagcagctacgccttcagataccacaacgtgggcatcctggtgctgttcctgcacgacatcagcgacgtgcagctggagttcaccaagctgaacatctacttcaagagcagaggcggcagctaccacagactgcacgccctggccgccgacctgggctgcctgagcttcggcttcagctggttctggttcagactgtactggttccccctgaaggtgctgtacgccaccagccactgcagcctgagaaccgtgcccgacatccccttctacttcttcttcaacgccctgctgctgctgctgaccctgatgaacctgtactggttcctgtacatcgtggccttcgccgccaaggtgctgaccggccaggtgcacgagctgaaggacctgagagagtacgacaccgccgaggcccagagcctgaagcccagcaaggccgagtag

SEQ ID NO: 16926 - DNA, 720 bp, Artificial Sequence
  Description of Artificial Sequence: Synthetic coding sequence
atgcccgagagcgcctggaagttcctgttctacctgggcagctggagctacagcgcctacctgctgttcggcaccgactaccccttcttccacgacccccccagcgtgttctacgactggacccccggcatggccgtgcccagagacatcgccgccgcctacctgctgcagggcagcttctacggccacagcatctacgccaccctgtacatggacacctggagaaaggacagcgtggtgatgctgctgcaccacgtggtgaccctgatcctgatcgtgagcagctacgccttcagataccacaacgtgggcatcctggtgctgttcctgcacgacatcagcgacgtgcagctggagttcaccaagctgaacatctacttcaagagcagaggcggcagctaccacagactgcacgccctggccgccgacctgggctgcctgagcttcggcttcagctggttctggttcagactgtactggttccccctgaaggtgctgtacgccaccagccactgcagcctgagaaccgtgcccgacatccccttctacttcttcttcaacgccctgctgctgctgctgaccctgatgaacctgtactggttcctgtacatcgtggccttcgccgccaaggtgctgaccggccaggtgcacgagctgaaggacctgagagagtacgacaccgccgaggcccagagcctgaagcccagcaaggccgagtag

SEQ ID NO: 16927 - DNA, 1143 bp, Artificial Sequence
  Description of Artificial Sequence: Synthetic coding sequence
atgctgcagaccctgtacgactacttctggtgggagagactgtggctgcccgtgaacctgacctgggccgacctggaggacagagacggcagagtgtacgccaaggccagcgacctgtacatcaccctgcccctggccctgctgttcctgatcgtgagatacttcttcgagctgtacgtggccacccccctggccgccctgctgaacatcaaggagaagaccagactgagagccccccccaacgccaccctggagcacttctacctgaccagcggcaagcagcccaagcaggtggaggtggagctgctgagcagacagagcggcctgagcggcagacaggtggagagatggttcagaagaagaagaaaccaggacagacccagcctgctgaagaagttcagagaggccagctggagattcaccttctacctgatcgccttcatcgccggcatggccgtgatcgtggacaagccctggttctacgacatgaagaaggtgtgggagggctaccccatccagagcaccatccccagccagtactggtactacatgatcgagctgagcttctactggagcctgctgttcagcatcgccagcgacgtgaagagaaaggacttcaaggagcagatcatccaccacgtggccaccatcatcctgatcagcttcagctggttcgccaactacatcagagccggcaccctgatcatggccctgcacgacagcagcgactacctgctggagagcgccaagatgttcaactacgccggctggaagaacacctgcaacaacatcttcatcgtgttcgccatcgtgttcatcatcaccagactggtgatcctgcccttctggatcctgcactgcaccctggtgtaccccctggagctgtaccccgccttcttcggctactacttcttcaacagcatgatgggcgtgctgcagctgctgcacatcttctgggcctacctgatcctgagaatggcccacaagttcatcaccggcaagctggtggaggacgagagaagcgacagagaggagaccgagagcagcgagggcgaggaggccgccgccggcggcggcgccaagagcagacccctggccaacggccaccccatcctgaacaacaaccacagaaagaacgactag

SEQ ID NO: 16928 - DNA, 693 bp, Artificial Sequence
  Description of Artificial Sequence: Synthetic coding sequence
atggccgtgatcgtggacaagccctggttctacgacatgaagaaggtgtgggagggctaccccatccagagcaccatccccagccagtactggtactacatgatcgagctgagcttctactggagcctgctgttcagcatcgccagcgacgtgaagagaaaggacttcaaggagcagatcatccaccacgtggccaccatcatcctgatcagcttcagctggttcgccaactacatcagagccggcaccctgatcatggccctgcacgacagcagcgactacctgctggagagcgccaagatgttcaactacgccggctggaagaacacctgcaacaacatcttcatcgtgttcgccatcgtgttcatcatcaccagactggtgatcctgcccttctggatcctgcactgcaccctggtgtaccccctggagctgtaccccgccttcttcggctactacttcttcaacagcatgatgggcgtgctgcagctgctgcacatcttctgggcctacctgatcctgagaatggcccacaagttcatcaccggcaagctggtggaggacgagagaagcgacagagaggagaccgagagcagcgagggcgaggaggccgccgccggcggcggcgccaagagcagacccctggccaacggccaccccatcctgaacaacaaccacagaaagaacgactag

SEQ ID NO: 16929 - DNA, 750 bp, Artificial Sequence
  Description of Artificial Sequence: Synthetic coding sequence
atgctgcagaccctgtacgactacttctggtgggagagactgtggctgcccgtgaacctgacctgggccgacctggaggacagagacggcagagtgtacgccaaggccagcgacctgtacatcaccctgcccctggccctgctgttcctgatcgtgagatacttcttcgagctgtacgtggccacccccctggccgccctgctgaacatcaaggagaagaccagactgagagccccccccaacgccaccctggagcacttctacctgaccagcggcaagcagcccaagcaggtggaggtggagctgctgagcagacagagcggcctgagcggcagacaggtggagagatggttcagaagaagaagaaaccaggacagacccagcctgctgaagaagttcagagaggccagctggagattcaccttctacctgatcgccttcatcgccggcatggccgtgatcgtggacaagccctggttctacgacatgaagaaggtgtgggagggctaccccatccagagcaccatccccagccagtactggtactacatgatcgagctgagcttctactggagcctgctgttcagcatcgccagcgacgtgaagagaaaggacttcaaggagcagatcatccaccacgtggccaccatcatcctgatcagcttcagctggttcgccaactacatcagagccggcaccctgatcatggccctgcacgacagcagcgactacctgctggaggtgagatag

SEQ ID NO: 16930 - DNA, 975 bp, Artificial Sequence
  Description of Artificial Sequence: Synthetic coding sequence
atggtgcccctggccctgcacttccccggcgaggtgggcctgcaggagaccgccgtgagaatgctgcagaccctgtacgactacttctggtgggagagactgtggctgcccgtgaacctgacctgggccgacctggaggacagagacggcagagtgtacgccaaggccagcgacctgtacatcaccctgcccctggccctgctgttcctgatcgtgagatacttcttcgagctgtacgtggccacccccctggccgccctgctgaacatcaaggagaagaccagactgagagccccccccaacgccaccctggagcacttctacctgaccagcggcaagcagcccaagcaggtggaggtggagctgctgagcagacagagcggcctgagcggcagacaggtggagagatggttcagaagaagaagaaaccaggacagacccagcctgctgaagaagttcagagaggccagctggagattcaccttctacctgatcgccttcatcgccggcatggccgtgatcgtggacaagccctggttctacgacatgaagaaggtgtgggagggctaccccatccagagcaccatccccagccagtactggtactacatgatcgagctgagcttctactggagcctgctgttcagcatcgccagcgacgtgaagagaaaggacttcaaggagcagatcatccaccacgtggccaccatcatcctgatcagcttcagctggttcgccaactacatcagagccggcaccctgatcatggccctgcacgacagcagcgactacctgctggagagcgccaagatgttcaactacgccggctggaagaacacctgcaacaacatcttcatcgtgttcgccatcgtgttcatcatcaccagactggtgatcctgcccttctggatcctgcactgcaccctggtgtaccccctggagctgtaccccgccttcttcggctactacttctag

SEQ ID NO: 16931 - DNA, 1143 bp, Artificial Sequence; identical to SEQ ID NO: 16927
  Description of Artificial Sequence: Synthetic coding sequence

SEQ ID NO: 16932 - DNA, 579 bp, Artificial Sequence
  Description of Artificial Sequence: Synthetic coding sequence
atgctgcagaccctgtacgactacttctggtgggagagactgtggctgcccgtgaacctgacctgggccgacctggaggacagagacggcagagtgtacgccaaggccagcgacctgtacatcaccctgcccctggccctgctgttcctgatcgtgagatacttcttcgagctgtacgtggccacccccctggccgccctgctgaacatcaaggagaagaccagactgagagccccccccaacgccaccctggagcacttctacctgaccagcggcaagcagcccaagcaggtggaggtggagctgctgagcagacagagcggcctgagcggcagacaggtggagagatggttcagaagaagaagaaaccaggacagacccagcctgctgaagaagttcagagaggccagctggagattcaccttctacctgatcgccttcatcgccggcatggccgtgatcgtggacaagccctggttctacgacatgaagaaggtgtgggagggctaccccatccagagcaccatccccagccagtactggtactacatgatcgagctgagcttctactggagctag

SEQ ID NO: 16933 - DNA, 390 bp, Artificial Sequence
  Description of Artificial Sequence: Synthetic coding sequence
atgctgcagaccctgtacgactacttctggtgggagagactgtggctgcccgtgaacctgacctgggccgacctggaggacagagacggcagagtgtacgccaaggccagcgacctgtacatcaccctgcccctggccctgctgttcctgatcgtgagatacttcttcgagctgtacgtggccacccccctggccgccctgctgaacatcaaggagaagaccagactgagagccccccccaacgccaccctggagcacttctacctgaccagcggcaagcagcccaagcaggtggaggtggagctgctgagcagacagagcggcctgagcggcagacaggtggagagatggttcagaagaagaagaaaccaggacagacccagcctgtag

SEQ ID NO: 16934 - DNA, 672 bp, Artificial Sequence
  Description of Artificial Sequence: Synthetic coding sequence
atgctgcagaccctgtacgactacttctggtgggagagactgtggctgcccgtgaacctgacctgggccgacctggaggacagagacggcagagtgtacgccaaggccagcgacctgtacatcaccctgcccctggccctgctgttcctgatcgtgagatacttcttcgagctgtacgtggccacccccctggccgccctgctgaacatcaaggagaagaccagactgagagccccccccaacgccaccctggagcacttctacctgaccagcggcaagcagcccaagcaggtggaggtggagctgctgagcagacagagcggcctgagcggcagacaggtggagagatggttcagaagaagaagaaaccaggacagacccagcctgctgaagaagttcagagaggccagctggagattcaccttctacctgatcgccttcatcgccggcatggccgtgatcgtggacaagccctggttctacgacatgaagaaggtgtgggagggctaccccatccagagcaccatccccagccagtactggtactacatgatcgagctgagcttctactggagcctgctgttcagcatcgccagcgacgtgaagagaaaggacttcaaggagcagatcatccaccacgtggccaccatcatcctgatcagcttcagctag

SEQ ID NO: 16935 - DNA, 1152 bp, Artificial Sequence
  Description of Artificial Sequence: Synthetic coding sequence
atgttctggaccttcaaggagtggttctggctggagagattctggctgccccccaccatcaagtggagcgacctggaggaccacgacggcctggtgttcgtgaagcccagccacctgtacgtgaccatcccctacgccttcctgctgctgatcatcagaagagtgttcgagaagttcgtggccagccccctggccaagagcttcggcatcaaggagaccgtgagaaaggtgacccccaacaccgtgctggagaacttcttcaagcacagcaccagacagcccctgcagaccgacatctacggcctggccaagaagtgcaacctgaccgagagacaggtggagagatggttcagaagcagaagaaaccaggagagacccagcagactgaagaagttccaggaggcctgctggagattcgccttctacctgatgatcaccgtggccggcatcgccttcctgtacgacaagccctggctgtacgacctgtgggaggtgtggaacggctaccccaagcagcccctgctgcccagccagtactggtactacatcctggagatgagcttctactggagcctgctgttcagactgggcttcgacgtgaagagaaaggacttcctggcccacatcatccaccacctggccgccatcagcctgatgagcttcagctggtgcgccaactacatcagaagcggcaccctggtgatgatcgtgcacgacgtggccgacatctggctggagagcgccaagatgttcagctacgccggctggacccagacctgcaacaccctgttcttcatcttcagcaccatcttcttcatcagcagactgatcgtgttccccttctggatcctgtactgcaccctgatcctgcccatgtaccacctggagcccttcttcagctacatcttcctgaacctgcagctgatgatcctgcaggtgctgcacctgtactggggctactacatcctgaagatgctgaacagatgcatcttcatgaagagcatccaggacgtgagaagcgacgacgaggactacgaggaggaggaggaggaggaggaggaggaggccaccaagggcaaggagatggactgcctgaagaacggcctgagagccgagagacacctgatccccaacggccagcacggccactag

SEQ ID NO: 16936 - DNA, 1152 bp, Artificial Sequence; identical to SEQ ID NO: 16935
  Description of Artificial Sequence: Synthetic coding sequence

SEQ ID NO: 16937 - DNA, 1152 bp, Artificial Sequence; identical to SEQ ID NO: 16935
  Description of Artificial Sequence: Synthetic coding sequence

SEQ ID NO: 16938 - DNA, 468 bp, Artificial Sequence
  Description of Artificial Sequence: Synthetic coding sequence
atgttctggaccttcaaggagtggttctggctggagagattctggctgccccccaccatcaagtggagcgacctggaggaccacgacggcctggtgttcgtgaagcccagccacctgtacgtgaccatcccctacgccttcctgctgctgatcatcagaagagtgttcgagaagttcgtggccagccccctggccaagagcttcggcatcaaggagaccgtgagaaaggtgacccccaacaccgtgctggagaacttcttcaagcacagcaccagacagcccctgcagaccgacatctacggcctggccaagaagtgcaacctgaccgagagacaggtggagagatggttcagaagcagaagaaaccaggagagacccagcagactgaagaagttccaggaggcctgctggagattcgccttctacctgatgatcaccgtggccggcatcgccttcctgtacgactag

SEQ ID NO: 16939 - DNA, 48 bp, Artificial Sequence
  Description of Artificial Sequence: Synthetic coding sequence
atgttctggaccttcaaggagtggttctggctggagagattctggtag

SEQ ID NO: 16940 - DNA, 174 bp, Artificial Sequence
  Description of Artificial Sequence: Synthetic coding sequence
atgttctggaccttcaaggagtggttctggctggagagattctggctgccccccaccatcaagtggagcgacctggaggaccacgacggcctggtgttcgtgaagcccagccacctgtacgtgaccatcccctacgccttcctgctgctgatcatcagaagagtgttcgagtag

SEQ ID NO: 16941 - DNA, 1185 bp, Artificial Sequence
  Description of Artificial Sequence: Synthetic coding sequence
atgctgagcagcttcaacgagtggttctggcaggacagattctggctgccccccaacgtgacctggaccgagctggaggacagagacggcagagtgtacccccacccccaggacctgctggccgccctgcccctggccctggtgctgctggccatgagactggccttcgagagattcatcggcctgcccctgagcagatggctgggcgtgagagaccagaccagaagacaggtgaagcccaacgccaccctggagaagcacttcctgaccgagggccacagacccaaggagccccagctgagcctgctggccgcccagtgcggcctgaccctgcagcagacccagagatggttcagaagaagaagaaaccaggacagaccccagctgaccaagaagttctgcgaggccagctggagattcctgttctacctgagcagcttcgtgggcggcctgagcgtgctgtaccacgagagctggctgtgggcccccgtgatgtgctgggacagataccccaaccagaccctgaagcccagcctgtactggtggtacctgctggagctgggcttctacctgagcctgctgatcagactgcccttcgacgtgaagagaaaggacttcaaggagcaggtgatccaccacttcgtggccgtgatcctgatgaccttcagctacagcgccaacctgctgagaatcggcagcctggtgctgctgctgcacgacagcagcgactacctgctggaggcctgcaagatggtgaactacatgcagtaccagcaggtgtgcgacgccctgttcctgatcttcagcttcgtgttcttctacaccagactggtgctgttccccacccagatcctgtacaccacctactacgagagcatcagcaacagaggccccttcttcggctactacttcttcaacggcctgctgatgctgctgcagctgctgcacgtgttctggagctgcctgatcctgagaatgctgtacagcttcatgaagaagggccagatggagaaggacatcagaagcgacgtggaggagagcgacagcagcgaggaggccgccgccgcccaggagcccctgcagctgaagaacggcgccgccggcggccccagacccgcccccaccgacggccccagaagcagagtggccggcagactgaccaacagacacaccaccgccacctag

SEQ ID NO: 16942 - DNA, 342 bp, Artificial Sequence
  Description of Artificial Sequence: Synthetic coding sequence
atgctgagcagcttcaacgagtggttctggcaggacagattctggctgccccccaacgtgacctggaccgagctggaggacagagacggcagagtgtacccccacccccaggacctgctggccgccctgcccctggccctggtgctgctggccatgagactggccttcgagagattcatcggcctgcccctgagcagatggctgggcgtgagagaccagaccagaagacaggtgaagcccaacgccaccctggagaagcacttcctgaccgagggccacagacccaaggagccccagctgagcctgctggccgcccagtgcggcctgaccctgcagcagtag

SEQ ID NO: 16943 - DNA, 579 bp, Artificial Sequence
  Description of Artificial Sequence: Synthetic coding sequence
atgctgagcagcttcaacgagtggttctggcaggacagattctggctgccccccaacgtgacctggaccgagctggaggacagagacggcagagtgtacccccacccccaggacctgctggccgccctgcccctggccctggtgctgctggccatgagactggccttcgagagattcatcggcctgcccctgagcagatggctgggcgtgagagaccagaccagaagacaggtgaagcccaacgccaccctggagaagcacttcctgaccgagggccacagacccaaggagccccagctgagcctgctggccgcccagtgcggcctgaccctgcagcagacccagagatggttcagaagaagaagaaaccaggacagaccccagctgaccaagaagttctgcgaggccagctggagattcctgttctacctgagcagcttcgtgggcggcctgagcgtgctgtaccacgagagctggctgtgggcccccgtgatgtgctgggacagataccccaaccagaccctgaagcccagcctgtactggtggtacctgctggagctgggcttctacctgagctag

SEQ ID NO: 16944 - DNA, 1185 bp, Artificial Sequence; identical to SEQ ID NO: 16941
  Description of Artificial Sequence: Synthetic coding sequence

SEQ ID NO: 16945 - DNA, 99 bp, Artificial Sequence
  Description of Artificial Sequence: Synthetic coding sequence
atgctgagcagcttcaacgagtggttctggcaggacagattctggctgccccccaacgtgacctggaccgagctggaggacagagacggcagagtgtag

SEQ ID NO: 16946 - DNA, 279 bp, Artificial Sequence
  Description of Artificial Sequence: Synthetic coding sequence
atgctgagcagcttcaacgagtggttctggcaggacagattctggctgccccccaacgtgacctggaccgagctggaggacagagacggcagagtgtacccccacccccaggacctgctggccgccctgcccctggccctggtgctgctggccatgagactggccttcgagagattcatcggcctgcccctgagcagatggctgggcgtgagagaccagaccagaagacaggtgaagcccaacgccaccctggagaagcacttcctgaccgagggctag

SEQ ID NO: 16947 - DNA, 1179 bp, Artificial Sequence
  Description of Artificial Sequence: Synthetic coding sequence
atggccaccgccgcccagggccccctgagcctgctgtggggctggctgtggagcgagagattctggctgcccgagaacgtgagctgggccgacctggagggccccgccgacggctacggctaccccagaggcagacacatcctgagcgtgttccccctggccgccggcatcttcttcgtgagactgctgttcgagagattcatcgccaagccctgcgccctgtgcatcggcatcgaggacagcggcccctaccaggcccagcccaacgccatcctggagaaggtgttcatcagcatcaccaagtaccccgacaagaagagactggagggcctgagcaagcagctggactggaacgtgagaaagatccagtgctggttcagacacagaagaaaccaggacaagccccccaccctgaccaagttctgcgagagcatgtggagattcaccttctacctgtgcatcttctgctacggcatcagattcctgtggagcagcccctggttctgggacatcagacagtgctggcacaactaccccttccagcccctgagcagcggcctgtaccactactacatcatggagctggccttctactggagcctgatgttcagccagttcaccgacatcaagagaaaggacttcctgatcatgttcgtgcaccacctggtgaccatcggcctgatcagcttcagctacatcaacaacatggtgagagtgggcaccctgatcatgtgcctgcacgacgtgagcgacttcctgctggaggccgccaagctggccaactacgccaagtaccagagactgtgcgacaccctgttcgtgatcttcagcgccgtgttcatggtgaccagactgggcatctaccccttctggatcctgaacaccaccctgttcgagagctgggagatcatcggcccctacgccagctggtggctgctgaacggcctgctgctgaccctgcagctgctgcacgtgatctggagctacctgatcgccagaatcgccctgaaggccctgatcagaggcaaggtgagcaaggacgacagaagcgacgtggagagcagcagcgaggaggaggacgtgaccacctgcaccaagagcccctgcgacagcagcagcagcaacggcgccaacagagtgaacggccacatgggcggcagctactgggccgaggagtag

SEQ ID NO: 16948 - DNA, 588 bp, Artificial Sequence
  Description of Artificial Sequence: Synthetic coding sequence
atggccaccgccgcccagggccccctgagcctgctgtggggctggctgtggagcgagagattctggctgcccgagaacgtgagctgggccgacctggagggccccgccgacggctacggctaccccagaggcagacacatcctgagcgtgttccccctggccgccggcatcttcttcgtgagactgctgttcgagagattcatcgccaagccctgcgccctgtgcatcggcatcgaggacagcggcccctaccaggcccagcccaacgccatcctggagaaggtgttcatcagcatcaccaagtaccccgacaagaagagactggagggcctgagcaagcagctggactggaacgtgagaaagatccagtgctggttcagacacagaagaaaccaggacaagccccccaccctgaccaagttctgcgagagcatccacctgggcagcggcaccagcgacagcgccggcatcaccatccacttcagcctgttccaggtgggcttcatcaccatcatcagctggaactggcccagcatcggccccctgtgcttcctgagcctgcagaccctgaaggagagaaccagctag

SEQ ID NO: 16949 - DNA, 1005 bp, Artificial Sequence
  Description of Artificial Sequence: Synthetic coding sequence
atgatgaagcccagacccaagagattcatcgccaagccctgcgccctgtgcatcggcatcgaggacagcggcccctaccaggcccagcccaacgccatcctggagaaggtgttcatcagcatcaccaagtaccccgacaagaagagactggagggcctgagcaagcagctggactggaacgtgagaaagatccagtgctggttcagacacagaagaaaccaggacaagccccccaccctgaccaagttctgcgagagcatgtggagattcaccttctacctgtgcatcttctgctacggcatcagattcctgtggagcagcccctggttctgggacatcagacagtgctggcacaactaccccttccagcccctgagcagcggcctgtaccactactacatcatggagctggccttctactggagcctgatgttcagccagttcaccgacatcaagagaaaggacttcctgatcatgttcgtgcaccacctggtgaccatcggcctgatcagcttcagctacatcaacaacatggtgagagtgggcaccctgatcatgtgcctgcacgacgtgagcgacttcctgctggaggccgccaagctggccaactacgccaagtaccagagactgtgcgacaccctgttcgtgatcttcagcgccgtgttcatggtgaccagactgggcatctaccccttctggatcctgaacaccaccctgttcgagagctgggagatcatcggcccctacgccagctggtggctgctgaacggcctgctgctgaccctgcagctgctgcacgtgatctggagctacctgatcgccagaatcgccctgaaggccctgatcagaggcaaggtgagcaaggacgacagaagcgacgtggagagcagcagcgaggaggaggacgtgaccacctgcaccaagagcccctgcgacagcagcagcagcaacggcgccaacagagtgaacggccacatgggcggcagctactgggccgaggagtag

SEQ ID NO: 16950 - DNA, 588 bp, Artificial Sequence; identical to SEQ ID NO: 16948
  Description of Artificial Sequence: Synthetic coding sequence

SEQ ID NO: 16951 - DNA, 1155 bp, Artificial Sequence
  Description of Artificial Sequence: Synthetic coding sequence
atggccggcatcctggcctggttctggaacgagagattctggctgccccacaacgtgacctgggccgacctgaagaacaccgaggaggccaccttcccccaggccgaggacctgtacctggccttccccctggccttctgcatcttcatggtgagactgatcttcgagagattcgtggccaagccctgcgccatcgccctgaacatccaggccaacggcccccagatcgccccccccaacgccatcctggagaaggtgttcaccgccatcaccaagcaccccgacgagaagagactggagggcctgagcaagcagctggactgggacgtgagaagcatccagagatggttcagacagagaagaaaccaggagaagcccagcaccctgaccagattctgcgagagcatgtggagattcagcttctacctgtacgtgttcacctacggcgtgagattcctgaagaagaccccctggctgtggaacaccagacactgctggtacaactacccctaccagcccctgaccaccgacctgcactactactacatcctggagctgagcttctactggagcctgatgttcagccagttcaccgacatcaagagaaaggacttcggcatcatgttcctgcaccacctggtgagcatcttcctgatcaccttcagctacgtgaacaacatggccagagtgggcaccctggtgctgtgcctgcacgacagcgccgacgccctgctggaggccgccaagatggccaactacgccaagttccagaagatgtgcgacctgctgttcgtgatgttcgccgtggtgttcatcaccaccagactgggcatcttccccctgtgggtgctgaacaccaccctgttcgagagctgggagatcgtgggcccctaccccagctggtgggtgttcaacctgctgctgctgctggtgcagggcctgaactgcttctggagctacctgatcgtgaagatcgcctgcaaggccgtgagcagaggcaaggtgagcaaggacgacagaagcgacatcgagagcagcagcgacgaggaggacagcgagccccccggcaagaacccccacaccgccaccaccaccaacggcaccagcggcaccaacggctacctgctgaccggcagctgcagcatggacgactag

SEQ ID NO: 16952 - DNA, 1179 bp, Artificial Sequence
  Description of Artificial Sequence: Synthetic coding sequence
atggccggcatcctggcctggttctggaacgagagattctggctgccccacaacgtgacctgggccgacctgaagaacaccgaggaggccaccttcccccaggccgaggacctgtacctggccttccccctggccttctgcatcttcatggtgagactgatcttcgagagattcgtggccaagccctgcgccatcgccctgaacatccaggccaacggcccccagatcgccccccccaacgccatcctggagaaggtgttcaccgccatcaccaagcaccccgacgagaagagactggagggcctgagcaagcagctggactgggacgtgagaagcatccagagatggttcagacagagaagaaaccaggagaagcccagcaccctgaccagattctgcgagagcatgtggagattcagcttctacctgtacgtgttcacctacggcgtgagattcctgaagaagaccccctggctgtggaacaccagacactgctggtacaactacccctaccagcccctgaccaccgacctgcactactactacatcctggagctgagcttctactggagcctgatgttcagccagttcaccgacatcaagagaaaggacttcggcatcatgttcctgcaccacctggtgagcatcttcctgatcaccttcagctacgtgaacaacatggccagagtgggcaccctggtgctgtgcctgcacgacagcgccgacgccctgctggaggccgccaagatggccaactacgccaagttccagaagatgtgcgacctgctgttcgtgatgttcgccgtggtgttcatcaccaccagactgggcatcttccccctgtgggtgctgaacaccaccctgttcgagagctgggagatcgtgggcccctaccccagctggtgggtgttcaacctgctgctgctgctggtgcagggcctgaactgcttctggagctacctgatcgtgaagatcgcctgcaaggccgtgagcagaggcaaggccggcaagtggaaccccctgcacgtgagcaaggacgacagaagcgacatcgagagcagcagcgacgaggaggacagcgagccccccggcaagaacccccacaccgccaccaccaccaacggcaccagcggcaccaacggctacctgctgaccggcagctgcagcatggacgactag

SEQ ID NO: 16953 - DNA, 675 bp, Artificial Sequence
  Description of Artificial Sequence: Synthetic coding sequence
atgcaggcccccggcagaggccccctgggcctgagactgatgatgcccggcagaagaggcgccctgagagagcccggcggctgcggcagctgcctgggcgtggccctggccctgctgctgctgctgctgcccgcctgctgccccgtgagagcccagaacgacaccgagcccatcgtgctggagggcaagtgcctggtggtgtgcgacagcagccccagcgccgacggcgccgtgaccagcagcctgggcatcagcgtgagaagcggcagcgccaaggtggccttcagcgccaccagaagcaccaaccacgagcccagcgagatgagcaacagaaccatgaccatctacttcgaccaggtgctggtgaacatcggcaaccacttcgacctggccagcagcatcttcgtggcccccagaaagggcatctacagcttcagcttccacgtggtgaaggtgtacaacagacagaccatccaggtgagcctgatgcagaacggctaccccgtgatcagcgccttcgccggcgaccaggacgtgaccagagaggccgccagcaacggcgtgctgctgctgatggagagagaggacaaggtgcacctgaagctggagagaggcaacctgatgggcggctggaagtacagcaccttcagcggcttcctggtgttccccctgtag

SEQ ID NO: 16954 - DNA, 1788 bp, Artificial Sequence
  Description of Artificial Sequence: Synthetic coding sequence
atgagagccgccagagccgcccccctgctgcagctgctgctgctgctgggcccctggctggaggccgccggcgtggccgagagccccctgcccgccgtggtgctggccatcctggccagaaacgccgagcacagcctgccccactacctgggcgccctggagagactggactaccccagagccagaatggccctgtggtgcgccaccgaccacaacgtggacaacaccaccgagatgctgcaggagtggctggccgccgtgggcgacgactacgccgccgtggtgtggagacccgagggcgagcccagattctaccccgacgaggagggccccaagcactggaccaaggagagacaccagttcctgatggagctgaagcaggaggccctgaccttcgccagaaactggggcgccgactacatcctgttcgccgacaccgacaacatcctgaccaacaaccagaccctgagactgctgatgggccagggcctgcccgtggtggcccccatgctggacagccagacctactacagcaacttctggtgcggcatcaccccccagggctactacagaagaaccgccgagtacttccccaccaagaacagacagagaagaggctgcttcagagtgcccatggtgcacagcaccttcctggccagcctgagagccgagggcgccgaccagctggccttctaccccccccaccccaactacacctggcccttcgacgacatcatcgtgttcgcctacgcctgccaggccgccggcgtgagcgtgcacgtgtgcaacgagcacagatacggctacatgaacgtgcccgtgaagagccaccagggcctggaggacgagagagtgaacttcatccacctgatcctggaggccctggtggacggccccagaatgcaggccagcgcccacgtgaccagacccagcaagagacccagcaagatcggcttcgacgaggtgttcgtgatcagcctggccagaagacccgacagaagagagagaatgctggccagcctgtgggagatggagatcagcggcagagtggtggacgccgtggacggctggatgctgaacagcagcgccatcagaaacctgggcgtggacctgctgcccggctaccaggacccctacagcggcagaaccctgaccaagggcgaggtgggctgcttcctgagccactacagcatctgggaggaggtggtggccagaggcctggccagagtgctggtgttcgaggacgacgtgagattcgagagcaacttcagaggcagactggagagactgatggaggacgtggaggccgagaagctgagctgggacctgatctacctgggcagaaagcaggtgaaccccgagaaggagaccgccgtggagggcctgcccggcctggtggtggccggctacagctactggaccctggcctacgccctgagactggccggcgccagaaagctgctggccagccagcccctgagaagaatgctgcccgtggacgagttcctgcccatcatgttcgaccagcaccccaacgagcagtacaaggcccacttctggcccagagacctggtggccttcagcgcccagcccctgctggccgcccccacccactacgccggcgacgccgagtggctgagcgacaccgagaccagcagcccctgggacgacgacagcggcagactgatcagctggagcggcagccagaagaccctgagaagccccagactggacctgaccggcagcagcggccacagcctgcagccccagcccagagacgagctgtag

SEQ ID NO: 16955 - DNA, 1554 bp, Artificial Sequence
  Description of Artificial Sequence: Synthetic coding sequence
atgctgcaggagtggctggccgccgtgggcgacgactacgccgccgtggtgtggagacccgagggcgagcccagattctaccccgacgaggagggccccaagcactggaccaaggagagacaccagttcctgatggagctgaagcaggaggccctgaccttcgccagaaactggggcgccgactacatcctgttcgccgacaccgacaacatcctgaccaacaaccagaccctgagactgctgatgggccagggcctgcccgtggtggcccccatgctggacagccagacctactacagcaacttctggtgcggcatcaccccccagggctactacagaagaaccgccgagtacttccccaccaagaacagacagagaagaggctgcttcagagtgcccatggtgcacagcaccttcctggccagcctgagagccgagggcgccgaccagctggccttctaccccccccaccccaactacacctggcccttcgacgacatcatcgtgttcgcctacgcctgccaggccgccggcgtgagcgtgcacgtgtgcaacgagcacagatacggctacatgaacgtgcccgtgaagagccaccagggcctggaggacgagagagtgaacttcatccacctgatcctggaggccctggtggacggccccagaatgcaggccagcgcccacgtgaccagacccagcaagagacccagcaagatcggcttcgacgaggtgttcgtgatcagcctggccagaagacccgacagaagagagagaatgctggccagcctgtgggagatggagatcagcggcagagtggtggacgccgtggacggctggatgctgaacagcagcgccatcagaaacctgggcgtggacctgctgcccggctaccaggacccctacagcggcagaaccctgaccaagggcgaggtgggctgcttcctgagccactacagcatctgggaggaggtggtggccagaggcctggccagagtgctggtgttcgaggacgacgtgagattcgagagcaacttcagaggcagactggagagactgatggaggacgtggaggccgagaagctgagctgggacctgatctacctgggcagaaagcaggtgaaccccgagaaggagaccgccgtggagggcctgcccggcctggtggtggccggctacagctactggaccctggcctacgccctgagactggccggcgccagaaagctgctggccagccagcccctgagaagaatgctgcccgtggacgagttcctgcccatcatgttcgaccagcaccccaacgagcagtacaaggcccacttctggcccagagacctggtggccttcagcgcccagcccctgctggccgcccccacccactacgccggcgacgccgagtggctgagcgacaccgagaccagcagcccctgggacgacgacagcggcagactgatcagctggagcggcagccagaagaccctgagaagccccagactggacctgaccggcagcagcggccacagcctgcagccccagcccagagacgagctgtag

SEQ ID NO: 16956 - DNA, 240 bp, Artificial Sequence
  Description of Artificial Sequence: Synthetic coding sequence
atgctgcaggagtggctggccgccgtgggcgacgactacgccgccgtggtgtggagacccgagggcgagcccagattctaccccgacgaggagggccccaagcactggaccaaggagagacaccagttcctgatggagctgaagcaggaggccctgaccttcgccagaaactggggcgccgactacatcctgttcgccgacaccgacaacatcctgaccaacaaccagaccctgagatag

SEQ ID NO: 16957 - DNA, 1647 bp, Artificial Sequence
  Description of Artificial Sequence: Synthetic coding sequence
atgagagccgccagagccgcccccctgctgcagctgctgctgctgctgggcccctggctggaggccgccggcgtggccgagagccccctgcccgccgtggtgctggccatcctggccagaaacgccgagcacagcctgccccactacctgggcgccctggagagactggactacccccacgaggagggccccaagcactggaccaaggagagacaccagttcctgatggagctgaagcaggaggccctgaccttcgccagaaactggggcgccgactacatcctgttcgccgacaccgacaacatcctgaccaacaaccagaccctgagactgctgatgggccagggcctgcccgtggtggcccccatgctggacagccagacctactacagcaacttctggtgcggcatcaccccccagggctactacagaagaaccgccgagtacttccccaccaagaacagacagagaagaggctgcttcagagtgcccatggtgcacagcaccttcctggccagcctgagagccgagggcgccgaccagctggccttctaccccccccaccccaactacacctggcccttcgacgacatcatcgtgttcgcctacgcctgccaggccgccggcgtgagcgtgcacgtgtgcaacgagcacagatacggctacatgaacgtgcccgtgaagagccaccagggcctggaggacgagagagtgaacttcatccacctgatcctggaggccctggtggacggccccagaatgcaggccagcgcccacgtgaccagacccagcaagagacccagcaagatcggcttcgacgaggtgttcgtgatcagcctggccagaagacccgacagaagagagagaatgctggccagcctgtgggagatggagatcagcggcagagtggtggacgccgtggacggctggatgctgaacagcagcgccatcagaaacctgggcgtggacctgctgcccggctaccaggacccctacagcggcagaaccctgaccaagggcgaggtgggctgcttcctgagccactacagcatctgggaggaggtggtggccagaggcctggccagagtgctggtgttcgaggacgacgtgagattcgagagcaacttcagaggcagactggagagactgatggaggacgtggaggccgagaagctgagctgggacctgatctacctgggcagaaagcaggtgaaccccgagaaggagaccgccgtggagggcctgcccggcctggtggtggccggctacagctactggaccctggcctacgccctgagactggccggcgccagaaagctgctggccagccagcccctgagaagaatgctgcccgtggacgagttcctgcccatcatgttcgaccagcaccccaacgagcagtacaaggcccacttctggcccagagacctggtggccttcagcgcccagcccctgctggccgcccccacccactacgccggcgacgccgagtggctgagcgacaccgagaccagcagcccctgggacgacgacagcggcagactgatcagctggagcggcagccagaagaccctgagaagccccagactggacctgaccggcagcagcggccacagcctgcagccccagcccagagacgagctgtag

SEQ ID NO: 16958 - DNA, 195 bp, Artificial Sequence
  Description of Artificial Sequence: Synthetic coding sequence
atgctgcaggagtggctggccgccgtgggcgacgactacgccgccgtggtgtggagacccgagggcgagcccagattctaccccgacgaggagggccccaagcactggaccaaggagagacaccagttcctgatggagctgaagcaggaggccctgaccttcgccagaaactggggcgccgactacatcctgtag

SEQ ID NO: 16959 - DNA, 657 bp, Artificial Sequence
  Description of Artificial Sequence: Synthetic coding sequence
atgctgcaggagtggctggccgccgtgggcgacgactacgccgccgtggtgtggagacccgagggcgagcccagattctaccccgacgaggagggccccaagcactggaccaaggagagacaccagttcctgatggagctgaagcaggaggccctgaccttcgccagaaactggggcgccgactacatcctgttcgccgacaccgacaacatcctgaccaacaaccagaccctgagactgctgatgggccagggcctgcccgtggtggcccccatgctggacagccagacctactacagcaacttctggtgcggcatcaccccccagggctactacagaagaaccgccgagtacttccccaccaagaacagacagagaagaggctgcttcagagtgcccatggtgcacagcaccttcctggccagcctgagagccgagggcgccgaccagctggccttctaccccccccaccccaactacacctggcccttcgacgacatcatcgtgttcgcctacgcctgccaggccgccggcgtgagcgtgcacgtgtgcaacgagcacagatacggctacatgaacgtgcccgtgaagagccaccagggcctggaggacgagagagtgaacttcatccacctgatcctggaggccctgggctag

SEQ ID NO: 16960 - DNA, 330 bp, Artificial Sequence
  Description of Artificial Sequence: Synthetic coding sequence
atgctgcaggagtggctggccgccgtgggcgacgactacgccgccgtggtgtggagacccgagggcgagcccagattctaccccgacgaggagggccccaagcactggaccaaggagagacaccagttcctgatggagctgaagcaggaggccctgaccttcgccagaaactggggcgccgactacatcctgttcgccgacaccgacaacatcctgaccaacaaccagaccctgagactgctgatgggccagggcctgcccgtggtggcccccatgctggacagccagacctactacagcaacttctggtgcggcatcaccccccagtag

SEQ ID NO: 16961 - DNA, 348 bp, Artificial Sequence
  Description of Artificial Sequence: Synthetic coding sequence
atggaggtgaaggacgccaacagcgccctgctgagcaactacgagaccctgaagtacatcagcaagaccccctgcagacaccagagccccgagatcgtgagagagttcctgaccgccctgaagagccacaagctgaccaaggccgagaagctgcagctgctgaaccacagacccgtgaccgccgtggagatccagctgatggtggaggagagcgaggagagactgaccgaggagcagatcgaggccctgctgcacaccgtgaccagcatcctgcccgccgagcccgaggccgagcagaagaagaacaccaacagcaacgtggccatggacgaggaggaccccgcctag

SEQ ID NO: 16962 - DNA, 447 bp, Artificial Sequence
  Description of Artificial Sequence: Synthetic coding sequence
atggaggtgaaggacgccaacagcgccctgctgagcaactacgaggtgttccagctgctgaccgacctgaaggagcagagaaaggagagcggcaagaacaagcacagcagcggccagcagaacctgaacaccatcacctacgagaccctgaagtacatcagcaagaccccctgcagacaccagagccccgagatcgtgagagagttcctgaccgccctgaagagccacaagctgaccaaggccgagaagctgcagctgctgaaccacagacccgtgaccgccgtggagatccagctgatggtggaggagagcgaggagagactgaccgaggagcagatcgaggccctgctgcacaccgtgaccagcatcctgcccgccgagcccgaggccgagcagaagaagaacaccaacagcaacgtggccatggacgaggaggaccccgcctag

SEQ ID NO: 16963 - DNA, 216 bp, Artificial Sequence
  Description of Artificial Sequence: Synthetic coding sequence
atggaggtggccgagaagctgcagctgctgaaccacagacccgtgaccgccgtggagatccagctgatggtggaggagagcgaggagagactgaccgaggagcagatcgaggccctgctgcacaccgtgaccagcatcctgcccgccgagcccgaggccgagcagaagaagaacaccaacagcaacgtggccatggacgaggaggaccccgcctag

SEQ ID NO: 16964 - DNA, 348 bp, Artificial Sequence
  Description of Artificial Sequence: Synthetic coding sequence
atggagatgaaggacgccaacagcgccctgctgagcaactacgagaccctgaagtacatcagcaagaccccctgcagacaccagagccccgagatcgtgagagagttcctgaccgccctgaagagccacaagctgaccaaggccgagaagctgcagctgctgaaccacagacccgtgaccgccgtggagatccagctgatggtggaggagagcgaggagagactgaccgaggagcagatcgaggccctgctgcacaccgtgaccagcatcctgcccgccgagcccgaggccgagcagaagaagaacaccaacagcaacgtggccatggacgaggaggaccccgcctag

SEQ ID NO: 16965 - DNA, 426 bp, Artificial Sequence
  Description of Artificial Sequence: Synthetic coding sequence
atgcagagaggcgaccccggcgagcacctgggcgccagaagctggcacctgggcgccgtgggcggcggcggcgacagctgcgaggtgaaggacgccaacagcgccctgctgagcaactacgagaccctgaagtacatcagcaagaccccctgcagacaccagagccccgagatcgtgagagagttcctgaccgccctgaagagccacaagctgaccaaggccgagaagctgcagctgctgaaccacagacccgtgaccgccgtggagatccagctgatggtggaggagagcgaggagagactgaccgaggagcagatcgaggccctgctgcacaccgtgaccagcatcctgcccgccgagcccgaggccgagcagaagaagaacaccaacagcaacgtggccatggacgaggaggaccccgcctag

SEQ ID NO: 16966 - DNA, 702 bp, Artificial Sequence
  Description of Artificial Sequence: Synthetic coding sequence
atgagcaagctgggcaagttcttcaagggcggcggcagcagcaagagcagagccgcccccagcccccaggaggccctggtgagactgagagagaccgaggagatgctgggcaagaagcaggagtacctggagaacagaatccagagagagatcgccctggccaagaagcacggcacccagaacaagagagccgccctgcaggccctgaagagaaagaagagattcgagaagcagctgacccagatcgacggcaccctgagcaccatcgagttccagagagaggccctggagaacagccacaccaacaccgaggtgctgagaaacatgggcttcgccgccaaggccatgaagagcgtgcacgagaacatggacctgaacaagatcgacgacctgatgcaggagatcaccgagcagcaggacatcgcccaggagatcagcgaggccttcagccagagagtgggcttcggcgacgacttcgacgaggacgagctgatggccgagctggaggagctggagcaggaggagctgaacaagaagatgaccaacatcagactgcccaacgtgcccagcagcagcctgcccgcccagcccaacagaaagcccggcatgagcagcaccgccagaagaagcagagccgccagcagccagagagccgaggaggaggacgacgacatcaagcagctggccgcctgggccacctag

SEQ ID NO: 16967 - DNA, 1293 bp, Artificial Sequence
  Description of Artificial Sequence: Synthetic coding sequence
atgctgtgcagcctgctgctgtgcgagtgcctgctgctggtggccggctacgcccacgacgacgactggatcgaccccaccgacatgctgaactacgacgccgccagcggcaccatgagaaagagccaggccaagtacggcatcagcggcgagaaggacgtgagccccgacctgagctgcgccgacgagatcagcgagtgctaccacaagctggacagcctgacctacaagatcgacgagtgcgagaagaagaagagagaggactacgagagccagagcaaccccgtgttcagaagatacctgaacaagatcctgatcgaggccggcaagctgggcctgctggccttcgcccagcaccaggccgaggtggccaagatggagcccctgaacaacgtgtgcgccaagaagatggactggaccggcagcatctgggagtggttcagaagcagctggacctacaaggacgacccctgccagaagtactacgagctgctgctggtgaaccccatctggctggtgccccccaccaaggccctggccgtgaccttcaccaccttcgtgaccgagcccctgaagcacatcggcaagggcaccggcgagttcatcaaggccctgatgaaggagatccccgccctgctgcacctgcccgtgctgatcatcatggccctggccatcctgagcttctgctacggcgccggcaagagcgtgcacgtgctgagacacatcggcggccccgagagcgagcccccccaggccctgagacccagagacagaagaagacaggaggagatcgactacagacccgacggcggcgccggcgacgccgacttccactacagaggccagatgggccccaccgagcagggcccctacgccaagacctacgagggcagaagagagatcctgagagagagagacgtggacctgagattccagaccggcaacaagagccccgaggtgctgagagccttcgacgtgcccgacgccgaggccagagagcaccccaccgtggtgcccagccacaagagccccgtgctggacaccaagcccaaggagaccggcggcatcctgggcgagggcacccccaaggagagcagcaccgagagcagccagagcgccaagcccgtgagcggccaggacaccagcggcaacaccgagggcagccccgccgccgagaaggcccagctgaagagcgaggccgccggcagccccgaccagggcagcacctacagccccgccagaggcgtggccggccccagaggccaggaccccgtgagcagcccctgcggctag

SEQ ID NO: 16968 - DNA, 1101 bp, Artificial Sequence
  Description of Artificial Sequence: Synthetic coding sequence
atgctgtgcagcctgctgctgtgcgagtgcctgctgctggtggccggctacgcccacgacgacgactggatcgaccccaccgacatgctgaactacgacgccgccagcggcaccatgagaaagagccaggccaagtacggcatcagcggcgagaaggacgtgagccccgacctgagctgcgccgacgagatcagcgagtgctaccacaagctggacagcctgacctacaagatcgacgagtgcgagaagaagaagagagaggactacgagagccagagcaaccccgtgttcagaagatacctgaacaagatcctgatcgaggccggcaagctgggcctggccctggccgtgaccttcaccaccttcgtgaccgagcccctgaagcacatcggcaagggcaccggcgagttcatcaaggccctgatgaaggagatccccgccctgctgcacctgcccgtgctgatcatcatggccctggccatcctgagcttctgctacggcgccggcaagagcgtgcacgtgctgagacacatcggcggccccgagagcgagcccccccaggccctgagacccagagacagaagaagacaggaggagatcgactacagacccgacggcggcgccggcgacgccgacttccactacagaggccagatgggccccaccgagcagggcccctacgccaagacctacgagggcagaagagagatcctgagagagagagacgtggacctgagattccagaccggcaacaagagccccgaggtgctgagagccttcgacgtgcccgacgccgaggccagagagcaccccaccgtggtgcccagccacaagagccccgtgctggacaccaagcccaaggagaccggcggcatcctgggcgagggcacccccaaggagagcagcaccgagagcagccagagcgccaagcccgtgagcggccaggacaccagcggcaacaccgagggcagccccgccgccgagaaggcccagctgaagagcgaggccgccggcagccccgaccagggcagcacctacagccccgccagaggcgtggccggccccagaggccaggaccccgtgagcagcccctgcggctag

SEQ ID NO: 16969 - DNA, 1656 bp, Artificial Sequence
  Description of Artificial Sequence: Synthetic coding sequence
atgctgtgcagcctgctgctgtgcgagtgcctgctgctggtggccggctacgcccacgacgacgactggatcgaccccaccgacatgctgaactacgacgccgccagcggcaccatgagaaagagccaggccaagtacggcatcagcggcgagaaggacgtgagccccgacctgagctgcgccgacgagatcagcgagtgctaccacaagctggacagcctgacctacaagatcgacgagtgcgagaagaagaagagagaggactacgagagccagagcaaccccgtgttcagaagatacctgaacaagatcctgatcgaggccggcaagctgggcctgcccgacgagaacaagggcgacatgcactacgacgccgagatcatcctgaagagagagaccctgctggagatccagaagttcctgaacggcgaggactggaagcccggcgccctggacgacgccctgagcgacatcctgatcaacttcaagttccacgacttcgagacctggaagtggagattcgaggacagcttcggcgtggacccctacaacgtgctgatggtgctgctgtgcctgctgtgcatcgtggtgctggtggccaccgagctgtggacctacgtgagatggtacacccagctgagaagagtgctgatcatcagcttcctgttcagcctgggctggaactggatgtacctgtacaagctggccttcgcccagcaccaggccgaggtggccaagatggagcccctgaacaacgtgtgcgccaagaagatggactggaccggcagcatctgggagtggttcagaagcagctggacctacaaggacgacccctgccagaagtactacgagctgctgctggtgaaccccatctggctggtgccccccaccaaggccctggccgtgaccttcaccaccttcgtgaccgagcccctgaagcacatcggcaagggcaccggcgagttcatcaaggccctgatgaaggagatccccgccctgctgcacctgcccgtgctgatcatcatggccctggccatcctgagcttctgctacggcgccggcaagagcgtgcacgtgctgagacacatcggcggccccgagagcgagcccccccaggccctgagacccagagacagaagaagacaggaggagatcgactacagacccgacggcggcgccggcgacgccgacttccactacagaggccagatgggccccaccgagcagggcccctacgccaagacctacgagggcagaagagagatcctgagagagagagacgtggacctgagattccagaccggcaacaagagccccgaggtgctgagagccttcgacgtgcccgacgccgaggccagagagcaccccaccgtggtgcccagccacaagagccccgtgctggacaccaagcccaaggagaccggcggcatcctgggcgagggcacccccaaggagagcagcaccgagagcagccagagcgccaagcccgtgagcggccaggacaccagcggcaacaccgagggcagccccgccgccgagaaggcccagctgaagagcgaggccgccggcagccccgaccagggcagcacctacagccccgccagaggcgtggccggccccagaggccaggaccccgtgagcagcccctgcggctag

SEQ ID NO: 16970 - DNA, 1101 bp, Artificial Sequence; identical to SEQ ID NO: 16968
  Description of Artificial Sequence: Synthetic coding sequence

SEQ ID NO: 16971 - DNA, 1293 bp, Artificial Sequence; identical to SEQ ID NO: 16967
  Description of Artificial Sequence: Synthetic coding sequence

SEQ ID NO: 16972 - DNA, 1506 bp, Artificial Sequence
  Description of Artificial Sequence: Synthetic coding sequence
atgctgtgcagcctgctgctgtgcgagtgcctgctgctggtggccggctacgcccacgacgacgactggatcgaccccaccgacatgctgaactacgacgccgccagcggcaccatgagaaagagccaggccaagtacggcatcagcggcgagaaggacgtgagccccgacctgagctgcgccgacgagatcagcgagtgctaccacaagctggacagcctgacctacaagatcgacgagtgcgagaagaagaagagagaggactacgagagccagagcaaccccgtgttcagaagatacctgaacaagatcctgatcgaggccggcaagctgggcctgttccacgacttcgagacctggaagtggagattcgaggacagcttcggcgtggacccctacaacgtgctgatggtgctgctgtgcctgctgtgcatcgtggtgctggtggccaccgagctgtggacctacgtgagatggtacacccagctgagaagagtgctgatcatcagcttcctgttcagcctgggctggaactggatgtacctgtacaagctggccttcgcccagcaccaggccgaggtggccaagatggagcccctgaacaacgtgtgcgccaagaagatggactggaccggcagcatctgggagtggttcagaagcagctggacctacaaggacgacccctgccagaagtactacgagctgctgctggtgaaccccatctggctggtgccccccaccaaggccctggccgtgaccttcaccaccttcgtgaccgagcccctgaagcacatcggcaagggcaccggcgagttcatcaaggccctgatgaaggagatccccgccctgctgcacctgcccgtgctgatcatcatggccctggccatcctgagcttctgctacggcgccggcaagagcgtgcacgtgctgagacacatcggcggccccgagagcgagcccccccaggccctgagacccagagacagaagaagacaggaggagatcgactacagacccgacggcggcgccggcgacgccgacttccactacagaggccagatgggccccaccgagcagggcccctacgccaagacctacgagggcagaagagagatcctgagagagagagacgtggacctgagattccagaccggcaacaagagccccgaggtgctgagagccttcgacgtgcccgacgccgaggccagagagcaccccaccgtggtgcccagccacaagagccccgtgctggacaccaagcccaaggagaccggcggcatcctgggcgagggcacccccaaggagagcagcaccgagagcagccagagcgccaagcccgtgagcggccaggacaccagcggcaacaccgagggcagccccgccgccgagaaggcccagctgaagagcgaggccgccggcagccccgaccagggcagcacctacagccccgccagaggcgtggccggccccagaggccaggaccccgtgagcagcccctgcggctag

SEQ ID NO: 16973 - DNA, 1656 bp, Artificial Sequence; identical to SEQ ID NO: 16969
  Description of Artificial Sequence: Synthetic coding sequence

SEQ ID NO: 16974 - DNA, 789 bp, Artificial Sequence
  Description of Artificial Sequence: Synthetic coding sequence
atgctgtgcagcctgctgctgtgcgagtgcctgctgctggtggccggctacgcccacgacgacgactggatcgaccccaccgacatgctgaactacgacgccgccagcggcaccatgagaaagagccaggccaagtacggcatcagcggcgagaaggacgtgagccccgacctgagctgcgccgacgagatcagcgagtgctaccacaagctggacagcctgacctacaagatcgacgagtgcgagaagaagaagagagaggactacgagagccagagcaaccccgtgttcagaagatacctgaacaagatcctgatcgaggccggcaagctgggcctgcccgacgagaacaagggcgacatgcactacgacgccgagatcatcctgaagagagagaccctgctggagatccagaagttcctgaacggcgaggactggaagcccggcgccctggacgacgccctgagcgacatcctgatcaacttcaagttccacgacttcgagacctggaagtggagattcgaggacagcttcggcgtggacccctacaacgtgctgatggtgctgctgtgcctgctgtgcatcgtggtgctggtggccaccgagctgtggacctacgtgagatggtacacccagctgagaagagtgctgatcatcagctgcgcccagagcgaggccagcagagtgaagcaggtgggcaacctgttccaggcctgggccttcgccgtgtgcgaccccgtgctgctgcaggtgcccgtgtgccccatcctggtgttctgctacagctag

SEQ ID NO: 16975 - DNA, 1506 bp, Artificial Sequence; identical to SEQ ID NO: 16972
  Description of Artificial Sequence: Synthetic coding sequence

SEQ ID NO: 16976 - DNA, 726 bp, Artificial Sequence
  Description of Artificial Sequence: Synthetic coding sequence
atggccgaggagcagccccaggtggagctgttcgtgaaggccggcagcgacggcgccaagatcggcaactgccccttcagccagagactgttcatggtgctgtggctgaagggcgtgaccttcaacgtgaccaccgtggacaccaagagaagaaccgagaccgtgcagaagctgtgccccggcggccagctgcccttcctgctgtacggcaccgaggtgcacaccgacaccaacaagatcgaggagttcctggaggccgtgctgtgcccccccagataccccaagctggccgccctgaaccccgagagcaacaccgccggcctggacatcttcgccaagttcagcgcctacatcaagaacagcaaccccgccctgaacgacaacctggagaagggcctgctgaaggccctgaaggtgctggacaactacctgaccagccccctgcccgaggaggtggacgagaccagcgccgaggacgagggcgtgagccagagaaagttcctggacggcaacgagctgaccctggccgactgcaacctgctgcccaagctgcacatcgtgcaggtggtgtgcaagaagtacagaggcttcaccatccccgaggccttcagaggcgtgcacagatacctgagcaacgcctacgccagagaggagttcgccagcacctgccccgacgacgaggagatcgagctggcctacgagcaggtggccaaggccctgaagtag

SEQ ID NO: 16977 - DNA, 726 bp, Artificial Sequence; identical to SEQ ID NO: 16976
  Description of Artificial Sequence: Synthetic coding sequence

SEQ ID NO: 16978 - DNA, 726 bp, Artificial Sequence; identical to SEQ ID NO: 16976
  Description of Artificial Sequence: Synthetic coding sequence

SEQ ID NO: 16979 - DNA, 726 bp, Artificial Sequence; identical to SEQ ID NO: 16976
  Description of Artificial Sequence: Synthetic coding sequence

SEQ ID NO: 16980 - DNA, 726 bp, Artificial Sequence; identical to SEQ ID NO: 16976
  Description of Artificial Sequence: Synthetic coding sequence

SEQ ID NO: 16981 - DNA, 726 bp, Artificial Sequence; identical to SEQ ID NO: 16976
  Description of Artificial Sequence: Synthetic coding sequence

SEQ ID NO: 16982 - DNA, 726 bp, Artificial Sequence; identical to SEQ ID NO: 16976
  Description of Artificial Sequence: Synthetic coding sequence

SEQ ID NO: 16983 - DNA, 726 bp, Artificial Sequence; identical to SEQ ID NO: 16976
  Description of Artificial Sequence: Synthetic coding sequence

SEQ ID NO: 16984 - DNA, 726 bp, Artificial Sequence; identical to SEQ ID NO: 16976
  Description of Artificial Sequence: Synthetic coding sequence

SEQ ID NO: 16985 - DNA, 726 bp, Artificial Sequence; identical to SEQ ID NO: 16976
  Description of Artificial Sequence: Synthetic coding sequence

SEQ ID NO: 16986 - DNA, 726 bp, Artificial Sequence; identical to SEQ ID NO: 16976
  Description of Artificial Sequence: Synthetic coding sequence

SEQ ID NO: 16987 - DNA, 726 bp, Artificial Sequence; identical to SEQ ID NO: 16976
  Description of Artificial Sequence: Synthetic coding sequence

SEQ ID NO: 16988 - DNA, 726 bp, Artificial Sequence; identical to SEQ ID NO: 16976
  Description of Artificial Sequence: Synthetic coding sequence

SEQ ID NO: 16989 - DNA, 726 bp, Artificial Sequence; identical to SEQ ID NO: 16976
  Description of Artificial Sequence: Synthetic coding sequence

SEQ ID NO: 16990 - DNA, 726 bp, Artificial Sequence; identical to SEQ ID NO: 16976
  Description of Artificial Sequence: Synthetic coding sequence

SEQ ID NO: 16991 - DNA, 726 bp, Artificial Sequence; identical to SEQ ID NO: 16976
  Description of Artificial Sequence: Synthetic coding sequence

SEQ ID NO: 16992 - DNA, 726 bp, Artificial Sequence; identical to SEQ ID NO: 16976
  Description of Artificial Sequence: Synthetic coding sequence

SEQ ID NO: 16993 - DNA, 726 bp, Artificial Sequence; identical to SEQ ID NO: 16976
  Description of Artificial Sequence: Synthetic coding sequence

SEQ ID NO: 16994 - DNA, 726 bp, Artificial Sequence; identical to SEQ ID NO: 16976
  Description of Artificial Sequence: Synthetic coding sequence

SEQ ID NO: 16995 - DNA, 726 bp, Artificial Sequence; identical to SEQ ID NO: 16976
  Description of Artificial Sequence: Synthetic coding sequence

SEQ ID NO: 16996 - DNA, 726 bp, Artificial Sequence; identical to SEQ ID NO: 16976
  Description of Artificial Sequence: Synthetic coding sequence

SEQ ID NO: 16997 - DNA, 726 bp, Artificial Sequence; identical to SEQ ID NO: 16976
  Description of Artificial Sequence: Synthetic coding sequence

SEQ ID NO: 16998 - DNA, 726 bp, Artificial Sequence; identical to SEQ ID NO: 16976
  Description of Artificial Sequence: Synthetic coding sequence

SEQ ID NO: 16999 - DNA, 726 bp, Artificial Sequence; identical to SEQ ID NO: 16976
  Description of Artificial Sequence: Synthetic coding sequence

SEQ ID NO: 17000 - DNA, 726 bp, Artificial Sequence; identical to SEQ ID NO: 16976
  Description of Artificial Sequence: Synthetic coding sequence

SEQ ID NO: 17001 - DNA, 726 bp, Artificial Sequence; identical to SEQ ID NO: 16976
  Description of Artificial Sequence: Synthetic coding sequence

SEQ ID NO: 17002 - DNA, 726 bp, Artificial Sequence; identical to SEQ ID NO: 16976
  Description of Artificial Sequence: Synthetic coding sequence

SEQ ID NO: 17003 - DNA, 744 bp, Artificial Sequence
  Description of Artificial Sequence: Synthetic coding sequence
atgagcggcctgagacccggcacccaggtggaccccgagatcgagctgttcgtgaaggccggcagcgacggcgagagcatcggcaactgccccttctgccagagactgttcatgatcctgtggctgaagggcgtgaagttcaacgtgaccaccgtggacatgaccagaaagcccgaggagctgaaggacctggcccccggcaccaacccccccttcctggtgtacaacaaggagctgaagaccgacttcatcaagatcgaggagttcctggagcagaccctggccccccccagatacccccacctgagccccaagtacaaggagagcttcgacgtgggctgcaacctgttcgccaagttcagcgcctacatcaagaacacccagaaggaggccaacaagaacttcgagaagagcctgctgaaggagttcaagagactggacgactacctgaacacccccctgctggacgagatcgaccccgacagcgccgaggagccccccgtgagcagaagactgttcctggacggcgaccagctgaccctggccgactgcagcctgctgcccaagctgaacatcatcaaggtggccgccaagaagtacagagacttcgacatccccgccgagttcagcggcgtgtggagatacctgcacaacgcctacgccagagaggagttcacccacacctgccccgaggacaaggagatcgagaacacctacgccaacgtggccaagcagaagagctag

SEQ ID NO: 17004 - DNA, 762 bp, Artificial Sequence
  Description of Artificial Sequence: Synthetic coding sequence
atggccctgagcatgcccctgaacggcctgaaggaggaggacaaggagcccctgatcgagctgttcgtgaaggccggcagcgacggcgagagcatcggcaactgccccttcagccagagactgttcatgatcctgtggctgaagggcgtggtgttcagcgtgaccaccgtggacctgaagagaaagcccgccgacctgcagaacctggcccccggcacccacccccccttcatcaccttcaacagcgaggtgaagaccgacgtgaacaagatcgaggagttcctggaggaggtgctgtgcccccccaagtacctgaagctgagccccaagcaccccgagagcaacaccgccggcatggacatcttcgccaagttcagcgcctacatcaagaacagcagacccgaggccaacgaggccctggagagaggcctgctgaagaccctgcagaagctggacgagtacctgaacagccccctgcccgacgagatcgacgagaacagcatggaggacatcaagttcagcaccagaaagttcctggacggcaacgagatgaccctggccgactgcaacctgctgcccaagctgcacatcgtgaaggtggtggccaagaagtacagaaacttcgacatccccaaggagatgaccggcatctggagatacctgaccaacgcctacagcagagacgagttcaccaacacctgccccagcgacaaggaggtggagatcgcctacagcgacgtggccaagagactgaccaagtag

SEQ ID NO: 17005 - DNA, 624 bp, Artificial Sequence
  Description of Artificial Sequence: Synthetic coding sequence
atggccctgagcatgcccctgaacggcctgaaggaggaggacaaggagcccctgatcgagctgttcgtgaaggccggcagcgacggcgagagcatcggcaactgccccttcagccagagactgttcatgatcctgtggctgaagggcgtggtgttcagcgtgaccaccgtggacctgaagagaaagcccgccgacctgcagaacctggcccccggcacccacccccccttcatcaccttcaacagcgaggtgaagaccgacgtgaacaagatcgaggagttcctggaggaggtgctgtgcccccccaagtacctgaagctgagccccaagcaccccgagagcaacaccgccggcatggacatcttcgccaagttcagcgcctacatcaagaacagcagacccgaggccaacgaggccctggagagaggcctgctgaagaccctgcagaagctggacgagtacctgaacagccccctgcccgacgagatcgacgagaacagcatggaggacatcaagttcagcaccagaaagttcctggacggcaacgagatgaccctggccgactgcaacctgctgcccaagctgcacatcgtgaaggtggtggccaagatcagccagctgtag

SEQ ID NO: 17006 - DNA, 762 bp, Artificial Sequence; identical to SEQ ID NO: 17004
  Description of Artificial Sequence: Synthetic coding sequence

SEQ ID NO: 17007 - DNA, 2061 bp, Artificial Sequence
  Description of Artificial Sequence: Synthetic coding sequence
atggccgaggccgccgagcccgagggcgtggcccccggcccccagggcccccccgaggtgcccgcccccctggccgagagacccggcgagcccggcgccgccggcggcgaggccgagggccccgagggcagcgagggcgccgaggaggcccccagaggcgccgccgccgtgaaggaggccggcggcggcggccccgacagaggccccgaggccgaggccagaggcaccagaggcgcccacggcgagaccgaggccgaggagggcgcccccgagggcgccgaggtgccccagggcggcgaggagaccagcggcgcccagcaggtggagggcgccagccccggcagaggcgcccagggcgagcccagaggcgaggcccagagagagcccgaggacagcgccgcccccgagagacaggaggaggccgagcagagacccgaggtgcccgagggcagcgccagcggcgaggccggcgacagcgtggacgccgagggccccctgggcgacaacatcgaggccgagggccccgccggcgacagcgtggaggccgagggcagagtgggcgacagcgtggacgccgagggccccgccggcgacagcgtggacgccgagggccccctgggcgacaacatccaggccgagggccccgccggcgacagcgtggacgccgagggcagagtgggcgacagcgtggacgccgagggccccgccggcgacagcgtggacgccgagggcagagtgggcgacagcgtggaggccggcgaccccgccggcgacggcgtggaggccggcgtgcccgccggcgacagcgtggaggccgagggccccgccggcgacagcatggacgccgagggccccgccggcagagccagaagagtgagcggcgagccccagcagagcggcgacggcagcctgagcccccaggccgaggccatcgaggtggccgccggcgagagcgccggcagaagccccggcgagctggcctgggacgccgccgaggaggccgaggtgcccggcgtgaagggcagcgaggaggccgcccccggcgacgccagagccgacgccggcgaggacagagtgggcgacggcccccagcaggagcccggcgaggacgaggagagaagagagagaagccccgagggccccagagaggaggaggccgccggcggcgaggaggagagccccgacagcagcccccacggcgaggccagcagaggcgccgccgagcccgaggcccagctgagcaaccacctggccgaggagggccccgccgagggcagcggcgaggccgccagagtgaacggcagaagagaggacggcgaggccagcgagcccagagccctgggccaggagcacgacatcaccctgttcgtgaaggccggctacgacggcgagagcatcggcaactgccccttcagccagagactgttcatgatcctgtggctgaagggcgtgatcttcaacgtgaccaccgtggacctgaagagaaagcccgccgacctgcagaacctggcccccggcaccaacccccccttcatgaccttcgacggcgaggtgaagaccgacgtgaacaagatcgaggagttcctggaggagaagctggccccccccagataccccaagctgggcacccagcaccccgagagcaacagcgccggcaacgacgtgttcgccaagttcagcgccttcatcaagaacaccaagaaggacgccaacgagatccacgagaagaacctgctgaaggccctgagaaagctggacaactacctgaacagccccctgcccgacgagatcgacgcctacagcaccgaggacgtgaccgtgagcggcagaaagttcctggacggcgacgagctgaccctggccgactgcaacctgctgcccaagctgcacatcatcaagatcgtggccaagaagtacagagacttcgagttccccagcgagatgaccggcatctggagatacctgaacaacgcctacgccagagacgagttcaccaacacctgccccgccgaccaggagatcgagcacgcctacagcgacgtggccaagagaatgaagtag

SEQ ID NO: 17008 - DNA, 2115 bp, Artificial Sequence
  Description of Artificial Sequence: Synthetic coding sequence
atggccgaggccgccgagcccgagggcgtggcccccggcccccagggcccccccgaggtgcccgcccccctggccgagagacccggcgagcccggcgccgccggcggcgaggccgagggccccgagggcagcgagggcgccgaggaggcccccagaggcgccgccgccgtgaaggaggccggcggcggcggccccgacagaggccccgaggccgaggccagaggcaccagaggcgcccacggcgagaccgaggccgaggagggcgcccccgagggcgccgaggtgccccagggcggcgaggagaccagcggcgcccagcaggtggagggcgccagccccggcagaggcgcccagggcgagcccagaggcgaggcccagagagagcccgaggacagcgccgcccccgagagacaggaggaggccgagcagagacccgaggtgcccgagggcagcgccagcggcgaggccggcgacagcgtggacgccgagggccccctgggcgacaacatcgaggccgagggccccgccggcgacagcgtggaggccgagggcagagtgggcgacagcgtggacgccgagggccccgccggcgacagcgtggacgccgagggccccctgggcgacaacatccaggccgagggccccgccggcgacagcgtggacgccgagggcagagtgggcgacagcgtggacgccgagggccccgccggcgacagcgtggacgccgagggcagagtgggcgacagcgtggaggccggcgaccccgccggcgacggcgtggaggccggcgtgcccgccggcgacagcgtggaggccgagggccccgccggcgacagcatggacgccgagggccccgccggcagagccagaagagtgagcggcgagccccagcagagcggcgacggcagcctgagcccccaggccgaggccatcgaggtggccgccggcgagagcgccggcagaagccccggcgagctggcctgggacgccgccgaggaggccgaggtgcccggcgtgaagggcagcgaggaggccgcccccggcgacgccagagccgacgccggcgaggacagagtgggcgacggcccccagcaggagcccggcgaggacgaggagagaagagagagaagccccgagggccccagagaggaggaggccgccggcggcgaggaggagagccccgacagcagcccccacggcgaggccagcagaggcgccgccgagcccgaggcccagctgagcaaccacctggccgaggagggccccgccgagggcagcggcgaggccgccagagtgaacggcagaagagaggacggcgaggccagcgagcccagagccctgggccaggagcacgacatcaccctgttcgtgaaggtgaagctgaccgccctgggctgcagcagaatcgccatcaagaagtacctgagagccggctacgacggcgagagcatcggcaactgccccttcagccagagactgttcatgatcctgtggctgaagggcgtgatcttcaacgtgaccaccgtggacctgaagagaaagcccgccgacctgcagaacctggcccccggcaccaacccccccttcatgaccttcgacggcgaggtgaagaccgacgtgaacaagatcgaggagttcctggaggagaagctggccccccccagataccccaagctgggcacccagcaccccgagagcaacagcgccggcaacgacgtgttcgccaagttcagcgccttcatcaagaacaccaagaaggacgccaacgagatccacgagaagaacctgctgaaggccctgagaaagctggacaactacctgaacagccccctgcccgacgagatcgacgcctacagcaccgaggacgtgaccgtgagcggcagaaagttcctggacggcgacgagctgaccctggccgactgcaacctgctgcccaagctgcacatcatcaagatcgtggccaagaagtacagagacttcgagttccccagcgagatgaccggcatctggagatacctgaacaacgcctacgccagagacgagttcaccaacacctgccccgccgaccaggagatcgagcacgcctacagcgacgtggccaagagaatgaagtag

SEQ ID NO: 17009 - DNA, 1785 bp, Artificial Sequence
  Description of Artificial Sequence: Synthetic coding sequence
atgtggtgcctgctgagaggcctgggcagacccggcgccctggccagaggcgccctgggccagcagcagagcctgggcgccagagccctggccagcgccggcagcgagagcagagacgagtacagctacgtggtggtgggcgccggcagcgccggctgcgtgctggccggcagactgaccgaggaccccgccgagagagtgctgctgctggaggccggccccaaggacgtgctggccggcagcaagagactgagctggaagatccacatgcccgccgccctggtggccaacctgtgcgacgacagatacaactggtgctaccacaccgaggtgcagagaggcctggacggcagagtgctgtactggcccagaggcagagtgtggggcggcagcagcagcctgaacgccatggtgtacgtgagaggccacgccgaggactacgagagatggcagagacagggcgccagaggctgggactacgcccactgcctgccctacttcagaaaggcccagggccacgagctgggcgccagcagatacagaggcgccgacggccccctgagagtgagcagaggcaagaccaaccaccccctgcactgcgccttcctggaggccacccagcaggccggctaccccctgaccgaggacatgaacggcttccagcaggagggcttcggctggatggacatgaccatccacgagggcaagagatggagcgccgcctgcgcctacctgcaccccgccctgagcagaaccaacctgaaggccgaggccgagaccctggtgagcagagtgctgttcgagggcaccagagccgtgggcgtggagtacgtgaagaacggccagagccacagagcctacgccagcaaggaggtgatcctgagcggcggcgccatcaacagcccccagctgctgatgctgagcggcatcggcaacgccgacgacctgaagaagctgggcatccccgtggtgtgccacctgcccggcgtgggccagaacctgcaggaccacctggagatctacatccagcaggcctgcaccagacccatcaccctgcacagcgcccagaagcccctgagaaaggtgtgcatcggcctggagtggctgtggaagttcaccggcgagggcgccaccgcccacctggagaccggcggcttcatcagaagccagcccggcgtgccccaccccgacatccagttccacttcctgcccagccaggtgatcgaccacggcagagtgcccacccagcaggaggcctaccaggtgcacgtgggccccatgagaggcaccagcgtgggctggctgaagctgagaagcgccaacccccaggaccaccccgtgatccagcccaactacctgagcaccgagaccgacatcgaggacttcagactgtgcgtgaagctgaccagagagatcttcgcccaggaggccctggcccccttcagaggcaaggagctgcagcccggcagccacatccagagcgacaaggagatcgacgccttcgtgagagccaaggccgacagcgcctaccaccccagctgcacctgcaagatgggccagcccagcgaccccaccgccgtggtggacccccagaccagagtgctgggcgtggagaacctgagagtggtggacgccagcatcatgcccagcatggtgagcggcaacctgaacgcccccaccatcatgatcgccgagaaggccgccgacatcatcaagggccagcccgccctgtgggacaaggacgtgcccgtgtacaagcccagaaccctggccacccagagatag

SEQ ID NO: 17010 - DNA, 381 bp, Artificial Sequence
  Description of Artificial Sequence: Synthetic coding sequence
atgtggtgcctgctgagaggcctgggcagacccggcgccctggccagaggcgccctgggccagcagcagagcctgggcgccagagccctggccagcgccggcagcgagagcagagacgagtacagctacgtggtggtgggcgccggcagcgccggctgcgtgctggccggcagactgaccgaggaccccgccgagagagtgctgctgctggaggccggccccaaggacgtgctggccggcagcaagagactgagctggaagatccacatgcccgccgccctggtggccaacctgtgcgacgacagatacaactggtgctaccacaccgaggtgcagagaggcctggacggcagagtgctgtactggcccagaggcagatag

SEQ ID NO: 17011 - DNA, 468 bp, Artificial Sequence
  Description of Artificial Sequence: Synthetic coding sequence
atgtggtgcctgctgagaggcctgggcagacccggcgccctggccagaggcgccctgggccagcagcagagcctgggcgccagagccctggccagcgccggcagcgagagcagagacgagtacagctacgtggtggtgggcgccggcagcgccggctgcgtgctggccggcagactgaccgaggaccccgccgagagagtgctgctgctggaggccggccccaaggacgtgctggccggcagcaagagactgagctggaagatccacatgcccgccgccctggtggccaacctgtgcgacgacagatacaactggtgctaccacaccgaggtgcagagaggcctggacggcagagtgctgtactggcccagaggcagagtgtggggcggcagcagcagcctgaacgccatggtgtacgtgagaggccacgccgaggactacgagagatggcagagacagggcgcctag

SEQ ID NO: 17012 - DNA, 1023 bp, Artificial Sequence
  Description of Artificial Sequence: Synthetic coding sequence
atgggcgagatggagcagctgagacaggaggccgagcagctgaagaagcagatcgccgacgccagaaaggcctgcgccgacgtgaccctggccgagctggtgagcggcctggaggtggtgggcagagtgcagatgagaaccagaagaaccctgagaggccacctggccaagatctacgccatgcactgggccaccgacagcaagctgctggtgagcgccagccaggacggcaagctgatcgtgtgggacagctacaccaccaacaaggtgcacgccatccccctgagaagcagctgggtgatgacctgcgcctacgcccccagcggcaacttcgtggcctgcggcggcctggacaacatgtgcagcatctacaacctgaagagcagagagggcaacgtgaaggtgagcagagagctgagcgcccacaccggctacctgagctgctgcagattcctggacgacaacaacatcgtgaccagcagcggcgacaccacctgcgccctgtgggacatcgagaccggccagcagaagaccgtgttcgtgggccacaccggcgactgcatgagcctggccgtgagccccgacttcaacctgttcatcagcggcgcctgcgacgccagcgccaagctgtgggacgtgagagagggcacctgcagacagaccttcaccggccacgagagcgacatcaacgccatctgcttcttccccaacggcgaggccatctgcaccggcagcgacgacgccagctgcagactgttcgacctgagagccgaccaggagctgatctgcttcagccacgagagcatcatctgcggcatcaccagcgtggccttcagcctgagcggcagactgctgttcgccggctacgacgacttcaactgcaacgtgtgggacagcatgaagagcgagagagtgggcatcctgagcggccacgacaacagagtgagctgcctgggcgtgaccgccgacggcatggccgtggccaccggcagctgggacagcttcctgaagatctggaactag

SEQ ID NO: 17013 - DNA, 696 bp, Artificial Sequence
  Description of Artificial Sequence: Synthetic coding sequence
atgttcgtgttctactgcgcccactggcagacctacgtgagcggcatgctgagattcggcaaggtggacgtgaccgagatccagatcgccctggtgatcgtgttcgtgctgagcgccttcggcggcgccaccatgtgggactacaccatccccatcctggagatcaagctgaagatcctgcccgtgctgggcttcctgggcggcgtgatcttcagctgcagcaactacttccacgtgatcctgcacggcggcgtgggcaagaacggcagcaccatcgccggcaccagcgtgctgagccccggcctgcacatcggcctgatcatcatcctggccatcatgatctacaagaagagcgccaccgacgtgttcgagaagcacccctgcctgtacatcctgatgttcggctgcgtgttcgccaaggtgagccagaagctggtggtggcccacatgaccaagagcgagctgtacctgcaggacaccgtgttcctgggccccggcctgctgttcctggaccagtacttcaacaacttcatcgacgagtacgtggtgctgtggatggccatggtgatcagcagcttcgacatggtgatctacttcagcgccctgtgcctgcagatcagcagacacctgcacctgaacatcttcaagaccgcctgccaccaggcccccgagcaggtgcacaagcacatcgactag

SEQ ID NO: 17014 - DNA, 1251 bp, Artificial Sequence
  Description of Artificial Sequence: Synthetic coding sequence
atgagcggccacagaagcaccagaaagagatgcggcgacagccaccccgagagccccgtgggcttcggccacatgagcaccaccggctgcgtgctgaacaagctgttccagctgcccaccccccccctgagcagacaccagctgaagagactggaggagcacagataccagagcgccggcagaagcctgctggagcccctgatgcagggctactgggagtggctggtgagaagagtgcccagctggatcgcccccaacctgatcaccatcatcggcctgagcatcaacatctgcaccaccatcctgctggtgttctactgccccaccgccaccgagcaggcccccctgtgggcctacatcgcctgcgcctgcggcctgttcatctaccagagcctggacgccatcgacggcaagcaggccagaagaaccaacagcagcagccccctgggcgagctgttcgaccacggctgcgacagcctgagcaccgtgttcgtggtgctgggcacctgcatcgccgtgcagctgggcaccaaccccgactggatgttcttctgctgcttcgccggcaccttcatgttctactgcgcccactggcagacctacgtgagcggcaccctgagattcggcatcatcgacgtgaccgaggtgcagatcttcatcatcatcatgcacctgctggccgtgatcggcggcccccccttctggcagagcatgatccccgtgctgaacatccagatgaagatcttccccgccctgtgcaccgtggccggcaccatcttcagctgcaccaactacttcagagtgatcttcaccggcggcgtgggcaagaacggcagcaccatcgccggcaccagcgtgctgagccccttcctgcacatcggcagcgtgatcaccctggccgccatgatctacaagaagagcgccgtgcagctgttcgagaagcacccctgcctgtacatcctgaccttcggcttcgtgagcgccaagatcaccaacaagctggtggtggcccacatgaccaagagcgagatgcacctgcacgacaccgccttcatcggccccgccctgctgttcctggaccagtacttcaacagcttcatcgacgagtacatcgtgctgtggatcgccctggtgttcagcttcttcgacctgatcagatactgcgtgagcgtgtgcaaccagatcgccagccacctgcacatccacgtgttcagaatcaaggtgagcaccgcccacagcaaccaccactag

SEQ ID NO: 17015 - DNA, 1251 bp, Artificial Sequence; identical to SEQ ID NO: 17014
  Description of Artificial Sequence: Synthetic coding sequence

SEQ ID NO: 17016 - DNA, 1599 bp, Artificial Sequence
  Description of Artificial Sequence: Synthetic coding sequence
atgatgatggtgagaagaggcctgctggcctggatcagcagagtggtggtgctgctggtgctgctgtgctgcgccatcagcgtgctgtacatgctggcctgcacccccaagggcgacgaggagcagctggccctgcccagagccaacagccccaccggcaaggagggctaccaggccgtgctgcaggagtgggaggagcagcacagaaactacgtgagcagcctgaagagacagatcgcccagctgaaggaggagctgcaggagagaagcgagcagctgagaaacggccagtaccaggccagcgacgccgccggcctgggcctggacagaagcccccccgagaagacccaggccgacctgctggccttcctgcacagccaggtggacaaggccgaggtgaacgccggcgtgaagctggccaccgagtacgccgccgtgcccttcgacagcttcaccctgcagaaggtgtaccagctggagaccggcctgaccagacaccccgaggagaagcccgtgagaaaggacaagagagacgagctggtggaggccatcgagagcgccctggagaccctgaacagccccgccgagaacagccccaaccacagaccctacaccgccagcgacttcatcgagggcatctacagaaccgagagagacaagggcaccctgtacgagctgaccttcaagggcgaccacaagcacgagttcaagagactgatcctgttcagacccttcggccccatcatgaaggtgaagaacgagaagctgaacatggccaacaccctgatcaacgtgatcgtgcccctggccaagagagtggacaagttcagacagttcatgcagaacttcagagagatgtgcatcgagcaggacggcagagtgcacctgaccgtggtgtacttcggcaaggaggagatcaacgaggtgaagggcatcctggagaacaccagcaaggccgccaacttcagaaacttcaccttcatccagctgaacggcgagttcagcagaggcaagggcctggacgtgggcgccagattctggaagggcagcaacgtgctgctgttcttctgcgacgtggacatctacttcaccagcgagttcctgaacacctgcagactgaacacccagcccggcaagaaggtgttctaccccgtgctgttcagccagtacaaccccggcatcatctacggccaccacgacgccgtgccccccctggagcagcagctggtgatcaagaaggagaccggcttctggagagacttcggcttcggcatgacctgccagtacagaagcgacttcatcaacatcggcggcttcgacctggacatcaagggctggggcggcgaggacgtgcacctgtacagaaagtacctgcacagcaacctgatcgtggtgagaacccccgtgagaggcctgttccacctgtggcacgagaagagatgcatggacgagctgacccccgagcagtacaagatgtgcatgcagagcaaggccatgaacgaggccagccacggccagctgggcatgctggtgttcagacacgagatcgaggcccacctgagaaagcagaagcagaagaccagcagcaagaagacctag

SEQ ID NO: 17017 - DNA, 1599 bp, Artificial Sequence; identical to SEQ ID NO: 17016
  Description of Artificial Sequence: Synthetic coding sequence

SEQ ID NO: 17018 - DNA, 1599 bp, Artificial Sequence; identical to SEQ ID NO: 17016
  Description of Artificial Sequence: Synthetic coding sequence

SEQ ID NO: 17019 - DNA, 291 bp, Artificial Sequence
  Description of Artificial Sequence: Synthetic coding sequence
atgatgatggtgagaagaggcctgctggcctggatcagcagagtggtggtgctgctggtgctgctgtgctgcgccatcagcgtgctgtacatgctggcctgcacccccaagggcgacgaggagcagctggccctgcccagagccaacagccccaccggcaaggagggctaccaggccgtgctgcaggagtgggaggagcagcacagaaactacgtgagcagcctgaagagacagatcgcccagctgaaggaggagctgcaggagagaagcgagcagctgagaaacggctag

SEQ ID NO: 17020 - DNA, 162 bp, Artificial Sequence
  Description of Artificial Sequence: Synthetic coding sequence
atgatgatggtgagaagaggcctgctggcctggatcagcagagtggtggtgctgctggtgctgctgtgctgcgccatcagcgtgctgtacatgctggcctgcacccccaagggcgacgaggagcagctggccctgcccagagccaacagccccaccggctag

SEQ ID NO: 17021 - DNA, 1599 bp, Artificial Sequence; identical to SEQ ID NO: 17016
  Description of Artificial Sequence: Synthetic coding sequence

SEQ ID NO: 17022 - DNA, 315 bp, Artificial Sequence
  Description of Artificial Sequence: Synthetic coding sequence
atgatgatggtgagaagaggcctgctggcctggatcagcagagtggtggtgctgctggtgctgctgtgctgcgccatcagcgtgctgtacatgctggcctgcacccccaagggcgacgaggagcagctggccctgcccagagccaacagccccaccggcaaggagggctaccaggccgtgctgcaggagtgggaggagcagcacagaaactacgtgagcagcctgaagagacagatcgcccagctgaaggaggagctgcaggagagaagcgagcagctgagaaacggccagtaccaggccagcgacgccgcctag

SEQ ID NO: 17023 - DNA, 45 bp, Artificial Sequence
  Description of Artificial Sequence: Synthetic coding sequence
atgatgatggtgagaagaggcctgctggcctggatcagcagatag

SEQ ID NO: 17024 - DNA, 1599 bp, Artificial Sequence; identical to SEQ ID NO: 17016
  Description of Artificial Sequence: Synthetic coding sequence

SEQ ID NO: 17025 - DNA, 1002 bp, Artificial Sequence
  Description of Artificial Sequence: Synthetic coding sequence
atgcccagaagaggcctgatcctgcacaccagaacccactggctgctgctgggcctggccctgctgtgcagcctggtgctgttcatgtacctgctggagtgcgccccccagaccgacggcaacgccagcctgcccggcgtggtgggcgagaactacggcaaggagtactaccaggccctgctgcaggagcaggaggagcactaccagaccagagccaccagcctgaagagacagatcgcccagctgaagcaggagctgcaggagatgagcgagaagatgagaagcctgcaggagagaagaaacgtgggcgccaacggcatcggctaccagagcaacaaggagcaggcccccagcgacctgctggagttcctgcacagccagatcgacaaggccgaggtgagcatcggcgccaagctgcccagcgagtacggcgtgatccccttcgagagcttcaccctgatgaaggtgttccagctggagatgggcctgaccagacaccccgaggagaagcccgtgagaaaggacaagagagacgagctggtggaggtgatcgaggccggcctggaggtgatcaacaaccccgacgaggacgacgagcaggaggacgaggagggccccctgggcgagaagctgatcttcaacgagaacgacttcgtggagggctactacagaaccgagagagacaagggcacccagtacgagctgttcttcaagaaggccgacctgaccgagtacagacacgtgaccctgttcagacccttcggccccctgatgaaggtgaagagcgagatgatcgacatcaccagaagcatcatcaacatcatcgtgcccctggccgagagaaccgaggccttcgtgcagttcatgcagaacttcagagacgtgtgcatccaccaggacaagaagatccacctgaccgtggtgtacttcggcaaggagggcctgagcaaggtgaagagcatcctggagagcgtgaccagactggccagcagcacctggtag

SEQ ID NO: 17026 - DNA, 1629 bp, Artificial Sequence
  Description of Artificial Sequence: Synthetic coding sequence
atgcccagaagaggcctgatcctgcacaccagaacccactggctgctgctgggcctggccctgctgtgcagcctggtgctgttcatgtacctgctggagtgcgccccccagaccgacggcaacgccagcctgcccggcgtggtgggcgagaactacggcaaggagtactaccaggccctgctgcaggagcaggaggagcactaccagaccagagccaccagcctgaagagacagatcgcccagctgaagcaggagctgcaggagatgagcgagaagatgagaagcctgcaggagagaagaaacgtgggcgccaacggcatcggctaccagagcaacaaggagcaggcccccagcgacctgctggagttcctgcacagccagatcgacaaggccgaggtgagcatcggcgccaagctgcccagcgagtacggcgtgatccccttcgagagcttcaccctgatgaaggtgttccagctggagatgggcctgaccagacaccccgaggagaagcccgtgagaaaggacaagagagacgagctggtggaggtgatcgaggccggcctggaggtgatcaacaaccccgacgaggacgacgagcaggaggacgaggagggccccctgggcgagaagctgatcttcaacgagaacgacttcgtggagggctactacagaaccgagagagacaagggcacccagtacgagctgttcttcaagaaggccgacctgaccgagtacagacacgtgaccctgttcagacccttcggccccctgatgaaggtgaagagcgagatgatcgacatcaccagaagcatcatcaacatcatcgtgcccctggccgagagaaccgaggccttcgtgcagttcatgcagaacttcagagacgtgtgcatccaccaggacaagaagatccacctgaccgtggtgtacttcggcaaggagggcctgagcaaggtgaagagcatcctggagagcgtgaccagcgagagcaacttccacaactacaccctggtgagcctgaacgaggagttcaacagaggcagaggcctgaacgtgggcgccagagcctgggacaagggcgaggtgctgatgttcttctgcgacgtggacatctacttcagcgccgagttcctgaacagctgcagactgaacgccgagcccggcaagaaggtgttctaccccgtggtgttcagcctgtacaaccccgccatcgtgtacgccaaccaggaggtgcccccccccgtggagcagcagctggtgcacaagaaggacagcggcttctggagagacttcggcttcggcatgacctgccagtacagaagcgacttcctgaccatcggcggcttcgacatggaggtgaagggctggggcggcgaggacgtgcacctgtacagaaagtacctgcacggcgacctgatcgtgatcagaacccccgtgcccggcctgttccacctgtggcacgagaagagatgcgccgacgagctgacccccgagcagtacagaatgtgcatccagagcaaggccatgaacgaggccagccacagccacctgggcatgctggtgttcagagaggagatcgagacccacctgcacaagcaggcctacagaaccaacagcgaggccgtgggctag

SEQ ID NO: 17027 - DNA, 1620 bp, Artificial Sequence
  Description of Artificial Sequence: Synthetic coding sequence
atgggcagagccggcggcggcggccccggcagaggccccccccccctgctgctgttcctgggcgccgccctggtgctggccagcggcgccgtgcccgccagagaggccggcagcgccgtggaggccgaggagctggtgaagggcagccccgcctgggagccccccgccaacgacaccagagaggaggccggcccccccgccgccggcgaggacgaggccagctggaccgcccccggcggcgagctggccggccccgaggaggtgctgcaggagagcgccgccgtgaccggcaccgcctggctggaggccgacagccccggcctgggcggcgtgaccgccgaggccggcagcggcgacgcccaggccctgcccgccaccctgcaggccccccacgaggtgctgggccagagcatcatgccccccgccatccccgaggccaccgaggccagcggcccccccagccccacccccggcgacaagctgagccccgccagcgagctgcccaaggagagccccctggaggtgtggctgaacctgggcggcagcacccccgacccccagggccccgagctgacctaccccttccagggcaccctggagccccagcccgccagcgacatcatcgacatcgactacttcgagggcctggacggcgagggcagaggcgccgacctgggcagcttccccggcagccccggcaccagcgagaaccaccccgacaccgagggcgagacccccagctggagcctgctggacctgtacgacgacttcacccccttcgacgagagcgacttctaccccaccaccagcttctacgacgacctggacgaggaggaggaggaggaggaggacgacaaggacgccgtgggcggcggcgacctggaggacgagaacgagctgctggtgcccaccggcaagcccggcctgggccccggcaccggccagcccaccagcagatggcacgccgtgcccccccagcacaccctgggcagcgtgcccggcagcagcatcgccctgagacccagacccggcgagcccggcagagacctggccagcagcgagaacggcaccgagtgcagaagcggcttcgtgagacacaacggcagctgcagaagcgtgtgcgacctgttccccagctactgccacaacggcggccagtgctacctggtggagaacatcggcgccttctgcagatgcaacacccaggactacatctggcacaagggcatgagatgcgagagcatcatcaccgacttccaggtgatgtgcgtggccgtgggcagcgccgccctggtgctgctgctgctgttcatgatgaccgtgttcttcgccaagaagctgtacctgctgaagaccgagaacaccaagctgagaagaaccaacaagttcagaacccccagcgagctgcacaacgacaacttcagcctgagcaccatcgccgagggcagccaccccaacgacgaccccagcgccccccacaagatccaggaggtgctgaagagctgcctgaaggaggaggagagcttcaacatccagaacagcatgagccccaagctggagggcggcaagggcgaccaggccgacctggacgtgaactgcctgcagaacaacctgacctag

SEQ ID NO: 17028 - DNA, 1701 bp, Artificial Sequence
  Description of Artificial Sequence: Synthetic coding sequence
atgggcagagccggcggcggcggccccggcagaggccccccccccctgctgctgttcctgggcgccgccctggtgctggccagcggcgccgtgcccgccagagaggccggcagcgccgtggaggccgaggagctggtgaagggcagccccgcctgggagccccccgccaacgacaccagagaggaggccggcccccccgccgccggcgaggacgaggccagctggaccgcccccggcggcgagctggccggccccgaggaggtgctgcaggagagcgccgccgtgaccggcaccgcctggctggaggccgacagccccggcctgggcggcgtgaccgccgaggccggcagcggcgacgcccaggccctgcccgccaccctgcaggccccccacgaggtgctgggccagagcatcatgccccccgccatccccgaggccaccgaggccagcggcccccccagccccacccccggcgacaagctgagccccgccagcgagctgcccaaggagagccccctggaggtgtggctgaacctgggcggcagcacccccgacccccagggccccgagctgacctaccccttccagggcaccctggagccccagcccgccagcgacatcatcgacatcgactacttcgagggcctggacggcgagggcagaggcgccgacctgggcagcttccccggcagccccggcaccagcgagaaccaccccgacaccgagggcgagacccccagctggagcctgctggacctgtacgacgacttcacccccttcgacgagagcgacttctaccccaccaccagcttctacgacgacctggacgaggaggaggaggaggaggaggacgacaaggacgccgtgggcggcggcgacctggaggacgagaacgagctgctggtgcccaccggcaagcccggcctgggccccggcaccggccagcccaccagcagatggcacgccgtgcccccccagcacaccctgggcagcgtgcccggcagcagcatcgccctgagacccagacccggcgagcccggcagagacctggccagcagcgagaacggcaccgagtgcagaagcggcttcgtgagacacaacggcagctgcagaagcgtgtgcgacctgttccccagctactgccacaacggcggccagtgctacctggtggagaacatcggcgccttctgcagatgcaacacccaggactacatctggcacaagggcatgagatgcgagagcatcatcaccgacttccaggtgatgtgcgtggccgtgggcagcgccgccctggtgctgctgctgctgttcatgatgaccgtgttcttcgccaagaagctgtacctgctgaagaccgagaacaccaagctgagaagaaccaacaagttcagaacccccagcgagctgcacaacgacaacttcagcctgagcaccatcgccgagggcagccaccccaacgtgagaaagctgtgcaacacccccagaaccagcagcccccacgccagagccctggcccactacgacaacgtgatctgccaggacgaccccagcgccccccacaagatccaggaggtgctgaagagctgcctgaaggaggaggagagcttcaacatccagaacagcatgagccccaagctggagggcggcaagggcgaccaggccgacctggacgtgaactgcctgcagaacaacctgacctag

SEQ ID NO: 17029 - DNA, 1206 bp, Artificial Sequence
  Description of Artificial Sequence: Synthetic coding sequence
atgccccccgccatccccgaggccaccgaggccagcggcccccccagccccacccccggcgacaagctgagccccgccagcgagctgcccaaggagagccccctggaggtgtggctgaacctgggcggcagcacccccgacccccagggccccgagctgacctaccccttccagggcaccctggagccccagcccgccagcgacatcatcgacatcgactacttcgagggcctggacggcgagggcagaggcgccgacctgggcagcttccccggcagccccggcaccagcgagaaccaccccgacaccgagggcgagacccccagctggagcctgctggacctgtacgacgacttcacccccttcgacgagagcgacttctaccccaccaccagcttctacgacgacctggacgaggaggaggaggaggaggaggacgacaaggacgccgtgggcggcggcgacctggaggacgagaacgagctgctggtgcccaccggcaagcccggcctgggccccggcaccggccagcccaccagcagatggcacgccgtgcccccccagcacaccctgggcagcgtgcccggcagcagcatcgccctgagacccagacccggcgagcccggcagagacctggccagcagcgagaacggcaccgagtgcagaagcggcttcgtgagacacaacggcagctgcagaagcgtgtgcgacctgttccccagctactgccacaacggcggccagtgctacctggtggagaacatcggcgccttctgcagatgcaacacccaggactacatctggcacaagggcatgagatgcgagagcatcatcaccgacttccaggtgatgtgcgtggccgtgggcagcgccgccctggtgctgctgctgctgttcatgatgaccgtgttcttcgccaagaagctgtacctgctgaagaccgagaacaccaagctgagaagaaccaacaagttcagaacccccagcgagctgcacaacgacaacttcagcctgagcaccatcgccgagggcagccaccccaacgacgaccccagcgccccccacaagatccaggaggtgctgaagagctgcctgaaggaggaggagagcttcaacatccagaacagcatgagccccaagctggagggcggcaagggcgaccaggccgacctggacgtgaactgcctgcagaacaacctgacctag

SEQ ID NO: 17030 - DNA, 822 bp, Artificial Sequence
  Description of Artificial Sequence: Synthetic coding sequence
atgagcagagtggtgagcctgctgctgggcgccgccctgctgtgcggccacggcgccttctgcagaagagtggtgagcggccagaaggtgtgcttcgccgacttcaagcacccctgctacaagatggcctacttccacgagctgagcagcagagtgagcttccaggaggccagactggcctgcgagagcgagggcggcgtgctgctgagcctggagaacgaggccgagcagaagctgatcgagagcatgctgcagaacctgaccaagcccggcaccggcatcagcgacggcgacttctggatcggcctgtggagaaacggcgacggccagaccagcggcgcctgccccgacctgtaccagtggagcgacggcagcaacagccagtacagaaactggtacaccgacgagcccagctgcggcagcgagaagtgcgtggtgatgtaccaccagcccaccgccaaccccggcctgggcggcccctacctgtaccagtggaacgacgacagatgcaacatgaagcacaactacatctgcaagtacgagcccgagatcaaccccaccgcccccgtggagaagccctacctgaccaaccagcccggcgacacccaccagaacgtggtggtgaccgaggccggcatcatccccaacctgatctacgtggtgatccccaccatccccctgctgctgctgatcctggtggccttcggcacctgctgcttccagatgctgcacaagagcaagggcagaaccaagaccagccccaaccagagcaccctgtggatcagcaagagcaccagaaaggagagcggcatggaggtgtag

SEQ ID NO: 17031 - DNA, 711 bp, Artificial Sequence
  Description of Artificial Sequence: Synthetic coding sequence
atggcctacttccacgagctgagcagcagagtgagcttccaggaggccagactggcctgcgagagcgagggcggcgtgctgctgagcctggagaacgaggccgagcagaagctgatcgagagcatgctgcagaacctgaccaagcccggcaccggcatcagcgacggcgacttctggatcggcctgtggagaaacggcgacggccagaccagcggcgcctgccccgacctgtaccagtggagcgacggcagcaacagccagtacagaaactggtacaccgacgagcccagctgcggcagcgagaagtgcgtggtgatgtaccaccagcccaccgccaaccccggcctgggcggcccctacctgtaccagtggaacgacgacagatgcaacatgaagcacaactacatctgcaagtacgagcccgagatcaaccccaccgcccccgtggagaagccctacctgaccaaccagcccggcgacacccaccagaacgtggtggtgaccgaggccgtgaaggaggagcagaagctggtgcagaccagcctgcactgcggcttccagagagtgcccgagaagaaggtggcctggaagtacaacaacagcctgacctggttccagaacttcgtgatcctggacctgtacaaggagtggcaccagaacaacagcctggagtggctggagatcaccaaggacctgcaggacgagctgtag

SEQ ID NO: 17032 - DNA, 699 bp, Artificial Sequence
  Description of Artificial Sequence: Synthetic coding sequence
atggcctacttccacgagctgagcagcagagtgagcttccaggaggccagactggcctgcgagagcgagggcggcgtgctgctgagcctggagaacgaggccgagcagaagctgatcgagagcatgctgcagaacctgaccaagcccggcaccggcatcagcgacggcgacttctggatcggcctgtggagaaacggcgacggccagaccagcggcgcctgccccgacctgtaccagtggagcgacggcagcaacagccagtacagaaactggtacaccgacgagcccagctgcggcagcgagaagtgcgtggtgatgtaccaccagcccaccgccaaccccggcctgggcggcccctacctgtaccagtggaacgacgacagatgcaacatgaagcacaactacatctgcaagtacgagcccgagatcaaccccaccgcccccgtggagaagccctacctgaccaaccagcccggcgacacccaccagaacgtggtggtgaccgaggccggcatcatccccaacctgatctacgtggtgatccccaccatccccctgctgctgctgatcctggtggccttcggcacctgctgcttccagatgctgcacaagagcaagggcagaaccaagaccagccccaaccagagcaccctgtggatcagcaagagcaccagaaaggagagcggcatggaggtgtag

SEQ ID NO: 17033 - DNA, 699 bp, Artificial Sequence; identical to SEQ ID NO: 17032
  Description of Artificial Sequence: Synthetic coding sequence

SEQ ID NO: 17034 - DNA, 711 bp, Artificial Sequence; identical to SEQ ID NO: 17031
  Description of Artificial Sequence: Synthetic coding sequence

SEQ ID NO: 17035 - DNA, 711 bp, Artificial Sequence; identical to SEQ ID NO: 17031
  Description of Artificial Sequence: Synthetic coding sequence

SEQ ID NO: 17036 - DNA, 141 bp, Artificial Sequence
  Description of Artificial Sequence: Synthetic coding sequence
atggcctacttccacgagctgagcagcagagtgagcttccaggaggccagactggcctgcgagagcgagggcggcgtgctgctgagcctggagaacgaggccgagcagaagctgatcgagagcatgctgcagaacctgtag

SEQ ID NO: 17037 - DNA, 141 bp, Artificial Sequence; identical to SEQ ID NO: 17036
  Description of Artificial Sequence: Synthetic coding sequence

SEQ ID NO: 17038 - DNA, 141 bp, Artificial Sequence; identical to SEQ ID NO: 17036
  Description of Artificial Sequence: Synthetic coding sequence

SEQ ID NO: 17039 - DNA, 765 bp, Artificial Sequence
  Description of Artificial Sequence: Synthetic coding sequence
atgaccgccggcagcgcccacagccagaaggtgtgcttcgccgacttcaagcacccctgctacaagatggcctacttccacgagctgagcagcagagtgagcttccaggaggccagactggcctgcgagagcgagggcggcgtgctgctgagcctggagaacgaggccgagcagaagctgatcgagagcatgctgcagaacctgaccaagcccggcaccggcatcagcgacggcgacttctggatcggcctgtggagaaacggcgacggccagaccagcggcgcctgccccgacctgtaccagtggagcgacggcagcaacagccagtacagaaactggtacaccgacgagcccagctgcggcagcgagaagtgcgtggtgatgtaccaccagcccaccgccaaccccggcctgggcggcccctacctgtaccagtggaacgacgacagatgcaacatgaagcacaactacatctgcaagtacgagcccgagatcaaccccaccgcccccgtggagaagccctacctgaccaaccagcccggcgacacccaccagaacgtggtggtgaccgaggccggcatcatccccaacctgatctacgtggtgatccccaccatccccctgctgctgctgatcctggtggccttcggcacctgctgcttccagatgctgcacaagagcaagggcagaaccaagaccagccccaaccagagcaccctgtggatcagcaagagcaccagaaaggagagcggcatggaggtgtag

SEQ ID NO: 17040 - DNA, 1239 bp, Artificial Sequence
  Description of Artificial Sequence: Synthetic coding sequence
atgcagaagtactgcatctaccagcacttccagttccagctgctgatccagcacctgtggatcgccgccaactgcgacatcgccgacgagagattcgacgccaccttccacaccaacgtgctggtgaacagcagcggccactgccagtacctgccccccggcatcttcaagagcagctgctacatcgacgtgagatggttccccttcgacgtgcagcactgcaagctgaagttcggcagctggagctacggcggctggagcctggacctgcagatgcaggaggccgacatcagcggctacatccccaacggcgagtgggacctggtgggcatccccggcaagagaagcgagagattctacgagtgctgcaaggagccctaccccgacgtgaccttcaccgtgaccatgagaagaagaaccctgtactacggcctgaacctgctgatcccctgcgtgctgatcagcgccctggccctgctggtgttcctgctgcccgccgacagcggcgagaagatcagcctgggcatcaccgtgctgctgagcctgaccgtgttcatgctgctggtggccgagatcatgcccgccaccagcgacagcgtgcccctgatcgcccagtacttcgccagcaccatgatcatcgtgggcctgagcgtggtggtgaccgtgatcgtgctgcagtaccaccaccacgaccccgacggcggcaagatgcccaagtggaccagagtgatcctgctgaactggtgcgcctggttcctgagaatgaagagacccggcgaggacaaggtgagacccgcctgccagcacaagcagagaagatgcagcctggccagcgtggagatgagcgccgtggcccccccccccgccagcaacggcaacctgctgtacatcggcttcagaggcctggacggcgtgcactgcgtgcccacccccgacagcggcgtggtgtgcggcagaatggcctgcagccccacccacgacgagcacctgctgcacggcggccagccccccgagggcgaccccgacctggccaagatcctggaggaggtgagatacatcgccaacagattcagatgccaggacgagagcgaggccgtgtgcagcgagtggaagttcgccgcctgcgtggtggacagactgtgcctgatggccttcagcgtgttcaccatcatctgcaccatcggcatcctgatgagcgcccccaacttcgtggaggccgtgagcaaggacttcgcctag

SEQ ID NO: 17041 - DNA, 966 bp, Artificial Sequence
  Description of Artificial Sequence: Synthetic coding sequence
atgcaggaggccgacatcagcggctacatccccaacggcgagtgggacctggtgggcatccccggcaagagaagcgagagattctacgagtgctgcaaggagccctaccccgacgtgaccttcaccgtgaccatgagaagaagaaccctgtactacggcctgaacctgctgatcccctgcgtgctgatcagcgccctggccctgctggtgttcctgctgcccgccgacagcggcgagaagatcagcctgggcatcaccgtgctgctgagcctgaccgtgttcatgctgctggtggccgagatcatgcccgccaccagcgacagcgtgcccctgatcgcccagtacttcgccagcaccatgatcatcgtgggcctgagcgtggtggtgaccgtgatcgtgctgcagtaccaccaccacgaccccgacggcggcaagatgcccaagtggaccagagtgatcctgctgaactggtgcgcctggttcctgagaatgaagagacccggcgaggacaaggtgagacccgcctgccagcacaagcagagaagatgcagcctggccagcgtggagatgagcgccgtggcccccccccccgccagcaacggcaacctgctgtacatcggcttcagaggcctggacggcgtgcactgcgtgcccacccccgacagcggcgtggtgtgcggcagaatggcctgcagccccacccacgacgagcacctgctgcacggcggccagccccccgagggcgaccccgacctggccaagatcctggaggaggtgagatacatcgccaacagattcagatgccaggacgagagcgaggccgtgtgcagcgagtggaagttcgccgcctgcgtggtggacagactgtgcctgatggccttcagcgtgttcaccatcatctgcaccatcggcatcctgatgagcgcccccaacttcgtggaggccgtgagcaaggacttcgcctag

SEQ ID NO: 17042 - DNA, 966 bp, Artificial Sequence; identical to SEQ ID NO: 17041
  Description of Artificial Sequence: Synthetic coding sequence

SEQ ID NO: 17043 - DNA, 1626 bp, Artificial Sequence
  Description of Artificial Sequence: Synthetic coding sequence
atggccagccaggagttcgaggtggaggccatcgtggacaagagacaggacaagaacggcaacacccagtacctggtgagatggaagggctacgacaagcaggacgacacctgggagcccgagcagcacctgatgaactgcgagaagtgcgtgcacgacttcaacagaagacagaccgagaagcagaagaagctgacctggaccaccaccagcagaatcttcagcaacaacgccagaagaagaaccagcagaagcaccaaggccaactacagcaagaacagccccaagacccccgtgaccgacaagcaccacagaagcaagaactgcaagctgttcgccgccagcaagaacgtgagaagaaaggccgccagcaccctgagcgacaccaagaacatggagatcatcaacagcaccatcgagaccctggcccccgacagccccttcgaccacaagaagaccgtgagcggcttccagaagctggagaagctggaccccatcgccgccgaccagcaggacaccgtggtgttcaaggtgaccgagggcaagctgctgagagaccccctgagccaccccggcgccgagcagaccggcatccagaacaagacccagatgcaccccctgatgagccagatgagcggcagcgtgaccgccagcatggccaccggcagcgccaccagaaagggcatcgtggtgctgatcgaccccctggccgccaacggcaccaccgacatgcacaccagcgtgcccagagtgaagggcggccagagaaacatcaccgacgacagcagaggccagcccttcatcaagaagatgcacttcaccatcagactgaccgagagcgccatcacctacagagacatcgtggtgaagaaggaggacggcttcacccagatcgtgctgagcaccagaagcaccgagaagaacgccctgaacaccgaggtgatcaaggagatggtgaacgccctgaacagcgccgccgccgacgacagcaagctggtgctgttcagcgccgccggcagcgtgttctgctgcggcctggacttcggctacttcgtgagacacctgagaaacgacagaaacaccgccagcctggagatggtggacaccatcaagaacttcgtgaacaccttcatccagttcaagaagcccatcgtggtgagcgtgaacggccccgccatcggcctgggcgccagcatcctgcccctgtgcgacctggtgtgggccaacgagaaggcctggttccagaccccctacaccaccttcggccagagccccgacggctgcagcagcatcaccttccccaagatgatgggcaaggccagcgccaacgagatgctgatcgccggcagaaagctgaccgccagagaggcctgcgccaagggcctggtgagccaggtgttcctgaccggcaccttcacccaggaggtgatgatccagatcaaggagctggccagctacaacgccatcgtgctggaggagtgcaaggccctggtgagatgcaacatcaagctggagctggagcaggccaacgagagagagtgcgaggtgctgagaaagatctggagcagcgcccagggcatcgagagcatgctgaagtacgtggagaacaagatcgacgagttctag

SEQ ID NO: 17044 - DNA, 1668 bp, Artificial Sequence
  Description of Artificial Sequence: Synthetic coding sequence
atggccagccaggagttcgaggtggaggccatcgtggacaagagacaggacaagaacggcaacacccagtacctggtgagatggaagggctacgacaagcaggacgacacctgggagcccgagcagcacctgatgaactgcgagaagtgcgtgcacgacttcaacagaagacagaccgagaagcagaagaagctgacctggaccaccaccagcagaatcttcagcaacaacgccagaagaagaaccagcagaagcaccaaggccaactacagcaagaacagccccaagacccccgtgaccgacaagcaccacagaagcaagaactgcaagctgttcgccgccagcaagaacgtgagaagaaaggccgccagcaccctgagcgacaccaagaacatggagatcatcaacagcaccatcgagaccctggcccccgacagccccttcgaccacaagaagaccgtgagcggcttccagaagctggagaagctggaccccatcgccgccgaccagcaggacaccgtggtgttcaaggtgaccgagggcaagctgctgagagaccccctgagccaccccggcgccgagcagaccggcatccagaacaagacccagatgcaccccctgatgagccagatgagcggcagcgtgaccgccagcatggccaccggcagcgccaccagaaagggcatcgtggtgctgatcgaccccctggccgccaacggcaccaccgacatgcacaccagcgtgcccagagtgaagggcggccagagaaacatcaccgacgacagcagaggccagcccttcatcaagaagatgcacttcaccatcagactgaccgagagcgccatcacctacagagacatcgtggtgaagaaggaggacggcttcacccagatcgtgctgagcaccagaagcaccgagaagaacgccctgaacaccgaggtgatcaaggagatggtgaacgccctgaacagcgccgccgccgacgacagcaagctggtgctgttcagcgccgccggcagcgtgttctgctgcggcctggacttcggctacttcgtgagacacctgagaaacgacagaaacaccgccagcctggagatggtggacaccatcaagaacttcgtgaacaccttcatccagttcaagaagcccatcgtggtgagcgtgaacggccccgccatcggcctgggcgccagcatcctgcccctgtgcgacctggtgtgggccaacgagaaggcctggttccagaccccctacaccaccttcggccagagccccgacggctgcagcagcatcaccttccccaagatgatgggcaaggccagcgccaacgagatgctgatcgccggcagaaagctgaccgccagagaggcctgcgccaagggcctggtgagccaggtgttcctgaccggcaccttcacccaggaggtgatgatccagatcaaggagctggccagctacaacgccatcgtgctggaggagtgcaaggccctggtgagatgcaacatcaagctggagctggagcaggccaacgagagagagtgcgaggtgctgagaaagatctggagcagcgcccagggcatcgagagcatgctgaagatccccctgctgggctacaaggccgccttcccccccagaaagacccagaacgaccagagatggtgcccctag

SEQ ID NO: 17045 - DNA, 2403 bp, Artificial Sequence
  Description of Artificial Sequence: Synthetic coding sequence
atggccaccctgggccagaagcccgtgatccacaccgtgctgaagagaaaggtgtacagcagcaacgagaagatgagaagaggcacctggagaatcgtggtgcccatgaccaaggacgacgccctgaaggagatcagaggcaaccaggtgaccttccaggactgcttcatcgccgacttcctgatcctgctgaccttccccctgctgaccatccccgagatccccggctacctgcccatcagcagccccagaggcagccagctgatggccagctgggacgcctgcgtggtggccagcgccgtgctggtgaccgacatggagaccttccacaccaccgacagcttcaagagctggaccagaatcagagtgccccccgacatcctgagcgacgacgagagaagaagcgtggcccacgtgatcctgagcagagacggcatcgtgttcctgatcaacggcgtgctgtacatcaagagcttcagaggcttcatcagactgggcggcatcgtgaacctgcccgacggcggcatcaccggcatcagcagcagaaagtggtgctgggtgaactacctgctgaaggccaagggcagaagaagcaccttcgccgtgtggaccgagaacgagatctacctgggcagcatcctgctgaagttcgccagactggtgaccaccaccgagctgaagaacatcctgagcctgagcgtgaccgccaccctgaccatcgacagagtggagtacaccggccaccccctggagatcgccgtgttcctgaactactgcaccgtgtgcaacgtgaccaagaagatcttcctggtgatctacaacgaggacaccaagcagtgggtgagccaggacttcaccctggacgcccccatcgacagcgtgaccatgccccacttcaccttcagcgccctgcccggcctgctgctgtggaacaagcacagcatctactactgctaccacaacttcaccttcaccggcatcctgcagacccccgccggccacggcaacctgagcatgctgagcaacgacagcatcatccacgaggtgttcatcgactactacggcgacatcctggtgaagatggagaacaacgtgatcttctacagcaagatcaacaccagagacgccgtgaagctgcacctgtggaccaactacaccaccagagccttcatcttcctgagcaccagcggccagacctacttcctgtacgccctggacgacggcaccatccagatccaggactaccccctgcacctggaggcccagagcatcgccttcaccaccaaggacaagtgcccctacatggccttccacaacaacgtggcccacgtgttctacttcctggacaagggcgaggccctgaccgtgtggacccagatcgtgtaccccgagaacaccggcctgtacgtgatcgtggagagctacggccccaagatcctgcaggagagccacgagatcagcttcgaggccgccttcggctactgcaccaagaccctgaccctgaccttctaccagaacgtggactacgagagaatcagcgactacttcgagacccaggacaagcacaccggcctggtgctggtgcagttcagacccagcgagtacagcaaggcctgccccatcgcccagaaggtgttccagatcgccgtgggctgcgacgacaagaagttcatcgccatcaagggcttcagcaagaagggctgccaccaccacgacttcagctacgtgatcgagaagagctacctgagacaccagcccagcaagaacctgagagtgagatacatctggggcgagtacggctgccccctgagactggacttcaccgagaagttccagcccgtggtgcagctgttcgacgacaacggctacgtgaaggacgtggaggccaacttcatcgtgtgggagatccacggcagagacgactacagcttcaacaacaccatggcccagagcggctgcctgcacgaggcccagacctggaagagcatgatcgagctgaacaagcacctgcccctggaggaggtgtggggccccgagaactacaagcactgcttcagctacgccatcggcaagcccggcgacctgaaccagccctacgagatcatcaacagcagcaacggcaaccacatcttctggcccatgggccacagcggcatgtacgtgttcagagtgaagatcctggaccccaactacagcttctgcaacctgaccgccatgttcgccatcgagaccttcggcctgatccccagccccagcgtgtacctggtggccagcttcctgttcgtgctgatgctgctgttcttcaccatcctggtgctgagctacttcagatacatgagaatctacagaagatacatctacgagcccctgcacaagccccagagaaagagaaagaagaactag

SEQ ID NO: 17046 - DNA, 2499 bp, Artificial Sequence
  Description of Artificial Sequence: Synthetic coding sequence
atgagcgccagagaggtggccgtgctgctgctgtggctgagctgctacggcagcgccctgtggagatacagcaccaacagccccaactacagaatcttcagcaccagaagcaccatcaagctggagtacgagggcaccctgttcaccgagtggagcgtgcccgagacctgcttcgtgctgaacaagagcagccccaccaccgagctgagatgcagcagccccggcgtgcacgccatcaagcccatcgtgaccggccccgacgaggaggagagatacctgttcgtggagagcagccacacctgcttcctgtggtactacagagtgagacacttcttcaacaacttcacccagctgatcaccgtgtgggcctacgaccccgagagcgccgaccccgacgagctgctgggcaacgccgaggagcccagcatcaacagcatcgtgctgagcacccagatggccaccctgggccagaagcccgtgatccacaccgtgctgaagagaaaggtgtacagcagcaacgagaagatgagaagaggcacctggagaatcgtggtgcccatgaccaaggacgacgccctgaaggagatcagaggcaaccaggtgaccttccaggactgcttcatcgccgacttcctgatcctgctgaccttccccctgctgaccatccccgagatccccggctacctgcccatcagcagccccagaggcagccagctgatggccagctgggacgcctgcgtggtggccagcgccgtgctggtgaccgacatggagaccttccacaccaccgacagcttcaagagctggaccagaatcagagtgccccccgacatcctgagcgacgacgagagaagaagcgtggcccacgtgatcctgagcagagacggcatcgtgttcctgatcaacggcgtgctgtacatcaagagcttcagaggcttcatcagactgggcggcatcgtgaacctgcccgacggcggcatcaccggcatcagcagcagaaagtggtgctgggtgaactacctgctgaaggccaagggcagaagaagcaccttcgccgtgtggaccgagaacgagatctacctgggcagcatcctgctgaagttcgccagactggtgaccaccaccgagctgaagaacatcctgagcctgagcgtgaccgccaccctgaccatcgacagagtggagtacaccggccaccccctggagatcgccgtgttcctgaactactgcaccgtgtgcaacgtgaccaagaagatcttcctggtgatctacaacgaggacaccaagcagtgggtgagccaggacttcaccctggacgcccccatcgacagcgtgaccatgccccacttcaccttcagcgccctgcccggcctgctgctgtggaacaagcacagcatctactactgctaccacaacttcaccttcaccggcatcctgcagacccccgccggccacggcaacctgagcatgctgagcaacgacagcatcatccacgaggtgttcatcgactactacggcgacatcctggtgaagatggagaacaacgtgatcttctacagcaagatcaacaccagagacgccgtgaagctgcacctgtggaccaactacaccaccagagccttcatcttcctgagcaccagcggccagacctacttcctgtacgccctggacgacggcaccatccagatccaggactaccccctgcacctggaggcccagagcatcgccttcaccaccaaggacaagtgcccctacatggccttccacaacaacgtggcccacgtgttctacttcctggacaagggcgaggccctgaccgtgtggacccagatcgtgtaccccgagaacaccggcctgtacgtgatcgtggagagctacggccccaagatcctgcaggagagccacgagatcagcttcgaggccgccttcggctactgcaccaagaccctgaccctgaccttctaccagaacgtggactacgagagaatcagcgactacttcgagacccaggacaagcacaccggcctggtgctggtgcagttcagacccagcgagtacagcaaggcctgccccatcgcccagaaggtgttccagatcgccgtgggctgcgacgacaagaagttcatcgccatcaagggcttcagcaagaagggctgccaccaccacgacttcagctacgtgatcgagaagagctacctgagacaccagcccagcaagaacctgagagtgagatacatctggggcgagtacggctgccccctgagactggacttcaccgagaagttccagcccgtggtgcagctgttcgacgacaacggctacgtgaaggacgtggaggccaacttcatcgtgtgggagatccacggcagagacgactacagcttcaacaacaccatggcccagagcggctgcctgcacgaggcccagacctggaagagcatgatcgagctgaacaagcacctgcccctggaggaggtgtggggccccgagttcctgtag

SEQ ID NO: 17047 - DNA, 2856 bp, Artificial Sequence
  Description of Artificial Sequence: Synthetic coding sequence
atgagcgccagagaggtggccgtgctgctgctgtggctgagctgctacggcagcgccctgtggagatacagcaccaacagccccaactacagaatcttcagcaccagaagcaccatcaagctggagtacgagggcaccctgttcaccgagtggagcgtgcccgagacctgcttcgtgctgaacaagagcagccccaccaccgagctgagatgcagcagccccggcgtgcacgccatcaagcccatcgtgaccggccccgacgaggaggagagatacctgttcgtggagagcagccacacctgcttcctgtggtactacagagtgagacacttcttcaacaacttcacccagctgatcaccgtgtgggcctacgaccccgagagcgccgaccccgacgagctgctgggcaacgccgaggagcccagcatcaacagcatcgtgctgagcacccagatggccaccctgggccagaagcccgtgatccacaccgtgctgaagagaaaggtgtacagcagcaacgagaagatgagaagaggcacctggagaatcgtggtgcccatgaccaaggacgacgccctgaaggagatcagaggcaaccaggtgaccttccaggactgcttcatcgccgacttcctgatcctgctgaccttccccctgctgaccatccccgagatccccggctacctgcccatcagcagccccagaggcagccagctgatggccagctgggacgcctgcgtggtggccagcgccgtgctggtgaccgacatggagaccttccacaccaccgacagcttcaagagctggaccagaatcagagtgccccccgacatcctgagcgacgacgagagaagaagcgtggcccacgtgatcctgagcagagacggcatcgtgttcctgatcaacggcgtgctgtacatcaagagcttcagaggcttcatcagactgggcggcatcgtgaacctgcccgacggcggcatcaccggcatcagcagcagaaagtggtgctgggtgaactacctgctgaaggccaagggcagaagaagcaccttcgccgtgtggaccgagaacgagatctacctgggcagcatcctgctgaagttcgccagactggtgaccaccaccgagctgaagaacatcctgagcctgagcgtgaccgccaccctgaccatcgacagagtggagtacaccggccaccccctggagatcgccgtgttcctgaactactgcaccgtgtgcaacgtgaccaagaagatcttcctggtgatctacaacgaggacaccaagcagtgggtgagccaggacttcaccctggacgcccccatcgacagcgtgaccatgccccacttcaccttcagcgccctgcccggcctgctgctgtggaacaagcacagcatctactactgctaccacaacttcaccttcaccggcatcctgcagacccccgccggccacggcaacctgagcatgctgagcaacgacagcatcatccacgaggtgttcatcgactactacggcgacatcctggtgaagatggagaacaacgtgatcttctacagcaagatcaacaccagagacgccgtgaagctgcacctgtggaccaactacaccaccagagccttcatcttcctgagcaccagcggccagacctacttcctgtacgccctggacgacggcaccatccagatccaggactaccccctgcacctggaggcccagagcatcgccttcaccaccaaggacaagtgcccctacatggccttccacaacaacgtggcccacgtgttctacttcctggacaagggcgaggccctgaccgtgtggacccagatcgtgtaccccgagaacaccggcctgtacgtgatcgtggagagctacggccccaagatcctgcaggagagccacgagatcagcttcgaggccgccttcggctactgcaccaagaccctgaccctgaccttctaccagaacgtggactacgagagaatcagcgactacttcgagacccaggacaagcacaccggcctggtgctggtgcagttcagacccagcgagtacagcaaggcctgccccatcgcccagaaggtgttccagatcgccgtgggctgcgacgacaagaagttcatcgccatcaagggcttcagcaagaagggctgccaccaccacgacttcagctacgtgatcgagaagagctacctgagacaccagcccagcaagaacctgagagtgagatacatctggggcgagtacggctgccccctgagactggacttcaccgagaagttccagcccgtggtgcagctgttcgacgacaacggctacgtgaaggacgtggaggccaacttcatcgtgtgggagatccacggcagagacgactacagcttcaacaacaccatggcccagagcggctgcctgcacgaggcccagacctggaagagcatgatcgagctgaacaagcacctgcccctggaggaggtgtggggccccgagaactacaagcactgcttcagctacgccatcggcaagcccggcgacctgaaccagccctacgagatcatcaacagcagcaacggcaaccacatcttctggcccatgggccacagcggcatgtacgtgttcagagtgaagatcctggaccccaactacagcttctgcaacctgaccgccatgttcgccatcgagaccttcggcctgatccccagccccagcgtgtacctggtggccagcttcctgttcgtgctgatgctgctgttcttcaccatcctggtgctgagctacttcagatacatgagaatctacagaagatacatctacgagcccctgcacaagccccagagaaagagaaagaagaactag

SEQ ID NO: 17048 - DNA, 2499 bp, Artificial Sequence; identical to SEQ ID NO: 17046
  Description of Artificial Sequence: Synthetic coding sequence

SEQ ID NO: 17049 - DNA, 2616 bp, Artificial Sequence
  Description of Artificial Sequence: Synthetic coding sequence
agaagaagaagcagaagacacgtgagccccggcagcggcagagccgccgccgtggccgagctgctgtggctgagacccctggagatcaagctggagtacgagggcaccctgttcaccgagtggagcgtgcccgagacctgcttcgtgctgaacaagagcagccccaccaccgagctgagatgcagcagccccggcgtgcacgccatcaagcccatcgtgaccggccccgacgaggaggagagatacctgttcgtggagagcagccacacctgcttcctgtggtactacagagtgagaacctggagaatcgtggtgcccatgaccaaggacgacgccctgaaggagatcagaggcaaccaggtgaccttccaggactgcttcatcgccgacttcctgatcctgctgaccttccccctgctgaccatccccgagatccccggctacctgcccatcagcagccccagaggcagccagctgatggccagctgggacgcctgcgtggtggccagcgccgtgctggtgaccgacatggagaccttccacaccaccgacagcttcaagagctggaccagaatcagagtgccccccgacatcctgagcgacgacgagagaagaagcgtggcccacgtgatcctgagcagagacggcatcgtgttcctgatcaacggcgtgctgtacatcaagagcttcagaggcttcatcagactgggcggcatcgtgaacctgcccgacggcggcatcaccggcatcagcagcagaaagtggtgctgggtgaactacctgctgaaggccaagggcagaagaagcaccttcgccgtgtggaccgagaacgagatctacctgggcagcatcctgctgaagttcgccagactggtgaccaccaccgagctgaagaacatcctgagcctgagcgtgaccgccaccctgaccatcgacagagtggagtacaccggccaccccctggagatcgccgtgttcctgaactactgcaccgtgtgcaacgtgaccaagaagatcttcctggtgatctacaacgaggacaccaagcagtgggtgagccaggacttcaccctggacgcccccatcgacagcgtgaccatgccccacttcaccttcagcgccctgcccggcctgctgctgtggaacaagcacagcatctactactgctaccacaacttcaccttcaccggcatcctgcagacccccgccggccacggcaacctgagcatgctgagcaacgacagcatcatccacgaggtgttcatcgactactacggcgacatcctggtgaagatggagaacaacgtgatcttctacagcaagatcaacaccagagacgccgtgaagctgcacctgtggaccaactacaccaccagagccttcatcttcctgagcaccagcggccagacctacttcctgtacgccctggacgacggcaccatccagatccaggactaccccctgcacctggaggcccagagcatcgccttcaccaccaaggacaagtgcccctacatggccttccacaacaacgtggcccacgtgttctacttcctggacaagggcgaggccctgaccgtgtggacccagatcgtgtaccccgagaacaccggcctgtacgtgatcgtggagagctacggccccaagatcctgcaggagagccacgagatcagcttcgaggccgccttcggctactgcaccaagaccctgaccctgaccttctaccagaacgtggactacgagagaatcagcgactacttcgagacccaggacaagcacaccggcctggtgctggtgcagttcagacccagcgagtacagcaaggcctgccccatcgcccagaaggtgttccagatcgccgtgggctgcgacgacaagaagttcatcgccatcaagggcttcagcaagaagggctgccaccaccacgacttcagctacgtgatcgagaagagctacctgagacaccagcccagcaagaacctgagagtgagatacatctggggcgagtacggctgccccctgagactggacttcaccgagaagttccagcccgtggtgcagctgttcgacgacaacggctacgtgaaggacgtggaggccaacttcatcgtgtgggagatccacggcagagacgactacagcttcaacaacaccatggcccagagcggctgcctgcacgaggcccagacctggaagagcatgatcgagctgaacaagcacctgcccctggaggaggtgtggggccccgagaactacaagcactgcttcagctacgccatcggcaagcccggcgacctgaaccagccctacgagatcatcaacagcagcaacggcaaccacatcttctggcccatgggccacagcggcatgtacgtgttcagagtgaagatcctggaccccaactacagcttctgcaacctgaccgccatgttcgccatcgagaccttcggcctgatccccagccccagcgtgtacctggtggccagcttcctgttcgtgctgatgctgctgttcttcaccatcctggtgctgagctacttcagatacatgagaatctacagaagatacatctacgagcccctgcacaagccccagagaaagagaaagaagaactag

SEQ ID NO: 17050 - DNA, 309 bp, Artificial Sequence
  Description of Artificial Sequence: Synthetic coding sequence
atgaccaccgccacccccctgggcgacaccaccttcttcagcctgaacatgaccaccagaggcgaggacttcctgtacaagagcagcggcgccatcgtggccgccgtggtggtggtggtgatcatcatcttcaccgtggtgctgatcctgctgaagatgtacaacagaaagatgagaaccagaagagagctggagcccaagggccccaagcccaccgcccccagcgccgtgggccccaacagcaacggcagccagcaccccgccaccgtgaccttcagccccgtggacgtgcaggtggagaccagatag

SEQ ID NO: 17051 - DNA, 1035 bp, Artificial Sequence
  Description of Artificial Sequence: Synthetic coding sequence
atggccctgagacacctggccctgctggccggcctgctggtgggcgtggccagcaagagcatggagaacaccgcccagctgcccgagtgctgcgtggacgtggtgggcgtgaacgccagctgccccggcgccagcctgtgcggccccggctgctacagaagatggaacgccgacggcagcgccagctgcgtgagatgcggcaacggcaccctgcccgcctacaacggcagcgagtgcagaagcttcgccggccccggcgcccccttccccatgaacagaagcagcggcacccccggcagaccccaccccggcgcccccagagtggccgccagcctgttcctgggcaccttcttcatcagcagcggcctgatcctgagcgtggccggcttcttctacctgaagagaagcagcaagctgcccagagcctgctacagaagaaacaaggcccccgccctgcagcccggcgaggccgccgccatgatcccccccccccagagcagcggcaacagcagctgcagaatccccctgtggggcttccccagcctgggccagagccagggcgccctgtgggtgtgcccccagaccggcctgcccggcagcggcagcagaccccccctgcccggcagccccggcgacccccccaccagacagggccagggcagaatctggctggtgccccccgccctggacctgagctggatctggcccgccccccccgccagaccccccctgatccccgtgaccagcatgctgttccccgtgcccgagacctggggcctgcaggagagaagaacccaccacgacagagccgacccccagtacctgctgctgctggaggtgcagctgcaccccagaaccgacgccgccggcctgagacaggccctgctgagcagccacagattcagcggcgccggcagcggcggccccaagagccagcccgtgagaaagcccagatacgtgagaagagagagacccctggacagagccaccgaccccgccgccttccccggcgaggccagaatcagcaacgtgtag

SEQ ID NO: 17052 - DNA, 597 bp, Artificial Sequence
  Description of Artificial Sequence: Synthetic coding sequence
atggccctgagacacctggccctgctggccggcctgctggtgggcgtggccagcaagagcatggagaacaccgcccagctgcccgagtgctgcgtggacgtggtgggcgtgaacgccagctgccccggcgccagcctgtgcggccccggctgctacagaagatggaacgccgacggcagcgccagctgcgtgagatgcggcaacggcaccctgcccgcctacaacggcagcgagtgcagaagcttcgccggccccggcgcccccttccccatgaacagaagcagcggcacccccggcagaccccaccccggcgcccccagagtggccgccagcctgttcctgggcaccttcttcatcagcagcggcctgatcctgagcgtggccggcttcttctacctgaagagaagcagcaagctgcccagagcctgctacagaagaaacaaggcccccgccctgcagcccggcgaggccgccgccatgatcccccccccccagagcagcgtgagaaagcccagatacgtgagaagagagagacccctggacagagccaccgaccccgccgccttccccggcgaggccagaatcagcaacgtgtag

SEQ ID NO: 17053 - DNA, 1143 bp, Artificial Sequence
  Description of Artificial Sequence: Synthetic coding sequence
atggccctgagacacctggccctgctggccggcctgctggtgggcgtggccagcaagagcatggagaacaccgtgaccagaaacagcaccgccgtgatcaacacccaggccgagggcaccctgagcccccccggcctgagcagcctgcccgtggtgagagagtgggccctgacccacaccgcccagctgcccgagtgctgcgtggacgtggtgggcgtgaacgccagctgccccggcgccagcctgtgcggccccggctgctacagaagatggaacgccgacggcagcgccagctgcgtgagatgcggcaacggcaccctgcccgcctacaacggcagcgagtgcagaagcttcgccggccccggcgcccccttccccatgaacagaagcagcggcacccccggcagaccccaccccggcgcccccagagtggccgccagcctgttcctgggcaccttcttcatcagcagcggcctgatcctgagcgtggccggcttcttctacctgaagagaagcagcaagctgcccagagcctgctacagaagaaacaaggcccccgccctgcagcccggcgaggccgccgccatgatcccccccccccagagcagcggcaacagcagctgcagaatccccctgtggggcttccccagcctgggccagagccagggcgccctgtgggtgtgcccccagaccggcctgcccggcagcggcagcagaccccccctgcccggcagccccggcgacccccccaccagacagggccagggcagaatctggctggtgccccccgccctggacctgagctggatctggcccgccccccccgccagaccccccctgatccccgtgaccagcatgctgttccccgtgcccgagacctggggcctgcaggagagaagaacccaccacgacagagccgacccccagtacctgctgctgctggaggtgcagctgcaccccagaaccgacgccgccggcctgagacaggccctgctgagcagccacagattcagcggcgccggcagcggcggccccaagagccagcccgtgagaaagcccagatacgtgagaagagagagacccctggacagagccaccgaccccgccgccttccccggcgaggccagaatcagcaacgtgtag

SEQ ID NO: 17054 - DNA, 597 bp, Artificial Sequence; identical to SEQ ID NO: 17052
  Description of Artificial Sequence: Synthetic coding sequence

SEQ ID NO: 17055 - DNA, 558 bp, Artificial Sequence
  Description of Artificial Sequence: Synthetic coding sequence
atggccctgagacacctggccctgctggccggcctgctggtgggcgtggccagcaagagcatggagaacaccgcccagctgcccgagtgctgcgtggacgtggtgggcgtgaacgccagctgccccggcgccagcctgtgcggccccggctgctacagaagatggaacgccgacggcagcgccagctgcgtgagatgcggcaacggcaccctgcccgcctacaacggcagcgagtgcagaagcttcgccggccccggcgcccccttccccatgaacagaagcagcggcacccccggcagaccccaccccggcgcccccagagtggccgccagcctgttcctgggcaccttcttcatcagcagcggcctgatcctgagcgtggccggcttcttctacctgaagagaagcagcaagctgcccagagcctgctacagaagaaacaagggccccgcccccgccggcagcctgcccggcagatggagcagccagcagttcggcccccaggcccccgccctgcagcccggcgaggccgtgagcaacccccaccaccccggctag

SEQ ID NO: 17056 - DNA, 174 bp, Artificial Sequence
  Description of Artificial Sequence: Synthetic coding sequence
atggccctgagacacctggccctgctggccggcctgctggtgggcgtggccagcaagagcatggagaacaccgcccagctgcccgagtgctgcgtggacgtggtgggcgtgaacgccagctgccccggcgccagcctgtgcggccccggctgctacagaagatggaacgcctag

SEQ ID NO: 17057 - DNA, 1143 bp, Artificial Sequence; identical to SEQ ID NO: 17053
  Description of Artificial Sequence: Synthetic coding sequence

SEQ ID NO: 17058 - DNA, 603 bp, Artificial Sequence
  Description of Artificial Sequence: Synthetic coding sequence
atgagcgtggtgcccatcctggagggccaggccctgagaatctgcagctgcagctggctggccttcagctgggagagccccgccagcccctggagaaccagacccagctgccccagcgccgtgtggatgtggtgggccagcacccccgccgcccaggcccaggtgtgcgtggtgcaggccgtgaccggcgccggcaccagaaccggcgcccccgccgccagcgccgtgggcaccgagcccagccagcccaccaccgcccccagcgtggaggccgtggtggccggccccggcgcccccttccccatgaacagaagcagcggcacccccggcagaccccaccccggcgcccccagagtggccgccagcctgttcctgggcaccttcttcatcagcagcggcctgatcctgagcgtggccggcttcttctacctgaagagaagcagcaagctgcccagagcctgctacagaagaaacaaggcccccgccctgcagcccggcgaggccgccgccatgatcccccccccccagagcagcgacgtgggcagcgccggcaaggaggacccccccagacagggcagaccccccatccccgcccccccctag

SEQ ID NO: 17059 - DNA, 468 bp, Artificial Sequence
  Description of Artificial Sequence: Synthetic coding sequence
atgggcggcaacggcagcacctgcaagcccgacaccgagagacagggcaccctgagcaccgccgcccccaccaccagccccgccccctgcctgagcaaccaccacaacaagaagcacctgatcctggccttctgcgccggcgtgctgctgaccctgctgctgatcgccttcatcttcctgatcatcaagagctacagaaagtacagaagagagagactgcccatcagccccggccccctgctgagatgggtgcccctgctgagcggcaccatggccgaccacagcaagccccaggcccccgacccccacagcgacccccccgccaagctgagcagcatccccggcgagagcctgacctacgccagcaccaccttcaagctgagcgaggagaagagcaaccacctggccgagaaccacagcgccgacttcgaccccatcgtgtacgcccagatcaaggtgaccaactag

SEQ ID NO: 17060 - DNA, 393 bp, Artificial Sequence
  Description of Artificial Sequence: Synthetic coding sequence
atgggcggcaacggcagcacctgcaagcccgacaccgagagacagggcaccctgagcaccgccgcccccaccaccagccccgccccctgcctgagcaaccaccacaacaagaagcacctgatcctggccttctgcgccggcgtgctgctgaccctgctgctgatcgccttcatcttcctgatcatcaagagctacagaaagtaccacagcaagccccaggcccccgacccccacagcgacccccccgccaagctgagcagcatccccggcgagagcctgacctacgccagcaccaccttcaagctgagcgaggagaagagcaaccacctggccgagaaccacagcgccgacttcgaccccatcgtgtacgcccagatcaaggtgaccaactag

SEQ ID NO: 17061 - DNA, 600 bp, Artificial Sequence
  Description of Artificial Sequence: Synthetic coding sequence
atggccagccccaagggcttcttcaactacctgacctacttcctggccgccggcgccgtgaccctgggcatcggcttcttcgccctggccagcgccctgtggttcctgatctgcaagagaagagagatcttccagaacagcaagttcaaggccatcgacgagagatgcagacagagacccagcatggccaagatcaagagccacagccagtgcgtgttcatcagcagaaacttccacaccggcagattccagctgcaggaggagcagagaaagaaggaggccgcccacatcaaggccatcaaggaccacagcaaggacgagccccagctggccaccaagaacatcatctgcgaccccagcgagaccagcagcaccaccaacagaagcagcgtgaccctgagcctgagcaccctgcccagcgacagctactacagccagagcatcgaggccgccgacgactggttcagcgacgacagcctggtgaagagaaacagccccatgcccagcctgggcgagcccctgatggagaaggtgttcagctacctgagcaccatcagcctggaggagggcaccgagagcgtgctgaacgacaccctgtag

SEQ ID NO: 17062 - DNA, 519 bp, Artificial Sequence
  Description of Artificial Sequence: Synthetic coding sequence
atgctgaccgaggtgatggaggtgtggcacggcctggtgatcgccgtggtgagcctgttcctgcaggcctgcttcctgaccgccatcaactacctgctgagcagacacatggcccacaagagcgagcagatcctgaaggccgccagcctgcaggtgcccagacccagccccggccaccaccacccccccgccgtgaaggagatgaaggagacccagaccgagagagacatccccatgagcgacagcctgtacagacacgacagcgacacccccagcgacagcctggacagcagctgcagcagcccccccgcctgccaggccaccgaggacgtggactacacccaggtggtgttcagcgaccccggcgagctgaagaacgacagccccctggactacgagaacatcaaggagatcaccgactacgtgaacgtgaaccccgagagacacaagcccagcttctggtacttcgtgaaccccgccctgagcgagcccgccgagtacgaccaggtggccatgtag

SEQ ID NO: 17063 - DNA, 342 bp, Artificial Sequence
  Description of Artificial Sequence: Synthetic coding sequence
atgaacgagaccaacaagaccctggtgggccccagcgagctgcccaccgccagcgccgtggcccccggccccggcaccggcgccagagcctggcccgtgctggtgggcttcgtgctgggcgccgtggtgctgagcctgctgatcgccctggccgccaagtgccacctgtgcagaagataccacgccagctacagacacagacccctgcccgagaccggcagaggcggcagaccccaggtggccgaggacgaggacgacgacggcttcatcgaggacaactacatccagcccggcaccggcgagctgggcaccgagggcagcagagaccacttcagcctgtag

SEQ ID NO: 17064 - DNA, 342 bp, Artificial Sequence; identical to SEQ ID NO: 17063
  Description of Artificial Sequence: Synthetic coding sequence

SEQ ID NO: 17065 - DNA, 1365 bp, Artificial Sequence
  Description of Artificial Sequence: Synthetic coding sequence
atgggcagaacctacatcgtggaggagaccgtgggccagtacctgagcaacatcaacctgcagggcaaggccttcgtgagcggcctgctgatcggccagtgcagcagccagaaggactacgtgatcctggccaccagaaccccccccaaggaggagcagagcgagaacctgaagcaccccaaggccaagctggacaacctggacgaggagtgggccaccgagcacgcctgccaggtgagcagaatgctgcccggcggcctgctggtgctgggcgtgttcatcatcaccaccctggagctggccaacgacttccagaacgccctgagaagactgatgttcgccgtggagaagagcatcaacagaaagagactgtggaacttcaccgaggaggaggtgagcgagagagtgaccctgcacatctgcgccagcaccaagaagatcttctgcagaacctacgacatccacgaccccaagagcagcgccagacccgccgactggaagtaccagagcggcctgagcagcagctggctgagcctggagtgcaccgtgcacatcaacatccacatccccctgagcgccaccagcgtgagctacaccctggagaagaacaccaagaacggcctgaccagatgggccaaggagatcgagaacggcgtgtacctgatcaacggccaggtgaaggacgaggactgcgacctgctggagggccagaagaagagcagcagaggcaacacccaggccaccagccacagcttcgacgtgagagtgctgacccagctgctgctgaacagcgaccacagaagcaccgccaccgtgcagatctgcagcggcagcgtgaacctgaagggcgccgtgaagtgcagagcctacatccacagcagcaagcccaaggtgaaggacgccgtgcaggccgtgaagagagacatcctgaacaccgtggccgacagatgcgagatgctgttcgaggacctgctgctgaacgagatccccgagaagaaggacagcgagaaggagttccacgtgctgccctacagagtgttcgtgcccctgcccggcagcaccgtgatgctgtgcgactacaagttcgacgacgagagcgccgaggagatcagagaccacttcatggagatgctggaccacaccatccagatcgaggacctggagatcgccgaggagaccaacaccgcctgcatgagcagcagcatgaacagccaggccagcctggacaacaccgacgacgagcagcccaagcagcccatcaagaccaccatgctgctgaagatccagcagaacatcggcgtgatcgccgccttcaccgtggccgtgctggccgccggcatcagcttccactacttcagcgactag

SEQ ID NO: 17066 - DNA, 1296 bp, Artificial Sequence
  Description of Artificial Sequence: Synthetic coding sequence
atgggcagaacctacatcgtggaggagaccgtgggccagtacctgagcaacatcaacctgcagggcaaggccttcgtgagcggcctgctgatcggccagtgcagcagccagaaggactacgtgatcctggccaccagaaccccccccaaggaggagcagagcgagaacctgaagcaccccaaggccaagctggacaacctggacgaggagtgggccaccgagcacgcctgccaggtgagcagaatgctgcccggcggcctgctggtgctgggcgtgttcatcatcaccaccctggagctggccaacgacttccagaacgccctgagaagactgatgttcgccgtggagaagagcatcaacagaaagagactgtggaacttcaccgaggaggaggtgagcgagagagtgaccctgcacatctgcgccagcaccaagaagatcttctgcagaacctacgacatccacgaccccaagagcagcgccagacccgccgactggaagtaccagagcggcctgagcagcagctggctgagcctggagtgcaccgtgcacatcaacatccacatccccctgagcgccaccagcgtgagctacaccctggagaagaacaccaagaacggcctgaccagatgggccaaggagatcgagaacggcgtgtacctgatcaacggccaggtgaaggacgaggactgcgacctgctggagggccagctgctgaacagcgaccacagaagcaccgccaccgtgcagatctgcagcggcagcgtgaacctgaagggcgccgtgaagtgcagagcctacatccacagcagcaagcccaaggtgaaggacgccgtgcaggccgtgaagagagacatcctgaacaccgtggccgacagatgcgagatgctgttcgaggacctgctgctgaacgagatccccgagaagaaggacagcgagaaggagttccacgtgctgccctacagagtgttcgtgcccctgcccggcagcaccgtgatgctgtgcgactacaagttcgacgacgagagcgccgaggagatcagagaccacttcatggagatgctggaccacaccatccagatcgaggacctggagatcgccgaggagaccaacaccgcctgcatgagcagcagcatgaacagccaggccagcctggacaacaccgacgacgagcagcccaagcagcccatcaagaccaccatgctgctgaagatccagcagaacatcggcgtgatcgccgccttcaccgtggccgtgctggccgccggcatcagcttccactacttcagcgactag

SEQ ID NO: 17067 - DNA, 1269 bp, Artificial Sequence
  Description of Artificial Sequence: Synthetic coding sequence
atgggcagaacctacatcgtggaggagaccgtgggccagtacctgagcaacatcaacctgcagggcaaggccttcgtgagcggcctgctgatcggccagtgcagcagccagaaggactacgtgatcctggccaccagaaccccccccaaggaggagcagagcgagaacctgaagcaccccaaggccaagctggacaacctggacgaggagtgggccaccgagcacgcctgccagctgatgttcgccgtggagaagagcatcaacagaaagagactgtggaacttcaccgaggaggaggtgagcgagagagtgaccctgcacatctgcgccagcaccaagaagatcttctgcagaacctacgacatccacgaccccaagagcagcgccagacccgccgactggaagtaccagagcggcctgagcagcagctggctgagcctggagtgcaccgtgcacatcaacatccacatccccctgagcgccaccagcgtgagctacaccctggagaagaacaccaagaacggcctgaccagatgggccaaggagatcgagaacggcgtgtacctgatcaacggccaggtgaaggacgaggactgcgacctgctggagggccagaagaagagcagcagaggcaacacccaggccaccagccacagcttcgacgtgagagtgctgacccagctgctgctgaacagcgaccacagaagcaccgccaccgtgcagatctgcagcggcagcgtgaacctgaagggcgccgtgaagtgcagagcctacatccacagcagcaagcccaaggtgaaggacgccgtgcaggccgtgaagagagacatcctgaacaccgtggccgacagatgcgagatgctgttcgaggacctgctgctgaacgagatccccgagaagaaggacagcgagaaggagttccacgtgctgccctacagagtgttcgtgcccctgcccggcagcaccgtgatgctgtgcgactacaagttcgacgacgagagcgccgaggagatcagagaccacttcatggagatgctggaccacaccatccagatcgaggacctggagatcgccgaggagaccaacaccgcctgcatgagcagcagcatgaacagccaggccagcctggacaacaccgacgacgagcagcccaagcagcccatcaagaccaccatgctgctgaagatccagcagaacatcggcgtgatcgccgccttcaccgtggccgtgctggccgccggcatcagcttccactacttcagcgactag

SEQ ID NO: 17068 - DNA, 1008 bp, Artificial Sequence
  Description of Artificial Sequence: Synthetic coding sequence
atgggcagaacctacatcgtggaggagaccgtgggccagtacctgagcaacatcaacctgcagggcaaggccttcgtgagcggcctgctgatcggccagtgcagcagccagaaggactacgtgatcctggccaccagaaccccccccaaggaggagcagagcgagaacctgaagcaccccaaggccaagctggacaacctggacgaggagtgggccaccgagcacgcctgccaggtgagcagaatgctgcccggcggcctgctggtgctgggcgtgttcatcatcaccaccctggagctggccaacgacttccagaacgccctgagaagactgatgttcgccgtggagaagagcatcaacagaaagagactgtggaacttcaccgaggaggaggtgagcgagagagtgaccctgcacatctgcgccagcaccaagaagatcttctgcagaacctacgacatccacgaccccaagagcagcgccagacccgccgactggaagtaccagagcggcctgagcagcagctggctgagcctggagtgcaccgtgcacatcaacatccacatccccctgagcgccaccagcgtgagctacaccctggagaagaacaccaagaacggcctgaccagatgggccaaggagatcgagaacggcgtgtacctgatcaacggccaggtgaaggacgaggactgcgacctgctggagggccagaagaagagcagcagaggcaacacccaggccaccagccacagcttcgacgtgagagtgctgacccagctgctgctgaacagcgaccacagaagcaccgccaccgtgcagatctgcagcggcagcgtgaacctgaagggcgccgtgaagtgcagagcctacatccacagcagcaagcccaaggtgaaggacgccgtgcaggccgtgaagagagacatcctgaacaccgtggccgacagatgcgagatgctgttcgaggacctgctgctgaacgagatccccgagaagaaggacttctag

SEQ ID NO: 17069 - DNA, 240 bp, Artificial Sequence
  Description of Artificial Sequence: Synthetic coding sequence
atggccgcccccagcatgaaggagagacaggtgtgctggggcgccagagacgagtactggaagtgcctggacgagaacctggaggacgccagccagtgcaagaagctgagaagcagcttcgagagcagctgcccccagcagtggatcaagtacttcgacaagagaagagactacctgaagttcaaggagaagttcgaggccggccagttcgagcccagcgagaccaccgccaagagctag

SEQ ID NO: 17070 - DNA, 378 bp, Artificial Sequence
  Description of Artificial Sequence: Synthetic coding sequence
atgggccccggcggccccctgctgagccccagcagaggcttcctgctgtgcaagaccggctggcacagcaacagactgctgggcgactgcggcccccacacccccgtgagcaccgccctgagcttcatcgccgtgggcatggccgcccccagcatgaaggagagacaggtgtgctggggcgccagagacgagtactggaagtgcctggacgagaacctggaggacgccagccagtgcaagaagctgagaagcagcttcgagagcagctgcccccagcagtggatcaagtacttcgacaagagaagagactacctgaagttcaaggagaagttcgaggccggccagttcgagcccagcgagaccaccgccaagagctag

SEQ ID NO: 17071 - DNA, 468 bp, Artificial Sequence
  Description of Artificial Sequence: Synthetic coding sequence
atggtggccagaaagggccagaagagccccagattcagaagagtgagctgcttcctgagactgggcagaagcaccctgctggagctggagcccgccggcagaccctgcagcggcagaaccagacacagagccctgcacagaagactggtggcctgcgtgaccgtgagcagcagaagacacagaaaggaggccggcagaggcagagccgagagcttcatcgccgtgggcatggccgcccccagcatgaaggagagacaggtgtgctggggcgccagagacgagtactggaagtgcctggacgagaacctggaggacgccagccagtgcaagaagctgagaagcagcttcgagagcagctgcccccagcagtggatcaagtacttcgacaagagaagagactacctgaagttcaaggagaagttcgaggccggccagttcgagcccagcgagaccaccgccaagagctag

SEQ ID NO: 17072 - DNA, 471 bp, Artificial Sequence
  Description of Artificial Sequence: Synthetic coding sequence
atggtggccagaaagggccagaagagccccagattcagaagagtgagctgcttcctgagactgggcagaagcaccctgctggagctggagcccgccggcagaccctgcagcggcagaaccagacacagagccctgcacagaagactggtggcctgcgtgaccgtgagcagcagaagacacagaaaggaggccggcagaggcagagccgagagcagcttcatcgccgtgggcatggccgcccccagcatgaaggagagacaggtgtgctggggcgccagagacgagtactggaagtgcctggacgagaacctggaggacgccagccagtgcaagaagctgagaagcagcttcgagagcagctgcccccagcagtggatcaagtacttcgacaagagaagagactacctgaagttcaaggagaagttcgaggccggccagttcgagcccagcgagaccaccgccaagagctag

SEQ ID NO: 17073 - DNA, 660 bp, Artificial Sequence
  Description of Artificial Sequence: Synthetic coding sequence
atggccagcggcagcaactggctgagcggcgtgaacgtggtgctggtgatggcctacggcagcctggacctgaaggaggagatcgacatcagactgagcagagtgcaggacatcaagtacgagccccagctgctggccgacgacgacgccagactgctgcagctggagacccagggcaaccagagctgctacaactacctgtacagaatgaaggccctggacgccatcagaaccagcgagatccccttccacagcgagggcagacaccccagaagcctgatgggcaagaacttcagaagctacctgctggacctgagaaacaccagcacccccttcaagggcgtgagaaaggccctgatcgacaccctgctggacggctacgagaccgccagatacggcaccggcgtgttcggccagaacgagtacctgagataccaggaggccctgagcgagctggccaccgccgtgaaggccagaatcggcagcagccagagacaccaccagagcgccgccaaggacctgacccagagccccgaggtgagccccaccaccatccaggtgacctacctgcccagcagccagaagagcaagagagccaagcacttcctggagctgaagagcttcaaggacaactacaacaccctggagagcaccctgtag

SEQ ID NO: 17074 - DNA, 606 bp, Artificial Sequence
  Description of Artificial Sequence: Synthetic coding sequence
atggccagcggcagcaactggctgagcggcgtgaacgtggtgctggtgatggcctacggcagcctggacctgaaggaggagatcgacatcagactgagcagagtgcaggacatcaagtacgagccccagctgctggccgacgacgacgccagactgctgcagctggagacccagggcaaccagaagatccccttccacagcgagggcagacaccccagaagcctgatgggcaagaacttcagaagctacctgctggacctgagaaacaccagcacccccttcaagggcgtgagaaaggccctgatcgacaccctgctggacggctacgagaccgccagatacggcaccggcgtgttcggccagaacgagtacctgagataccaggaggccctgagcgagctggccaccgccgtgaaggccagaatcggcagcagccagagacaccaccagagcgccgccaaggacctgacccagagccccgaggtgagccccaccaccatccaggtgacctacctgcccagcagccagaagagcaagagagccaagcacttcctggagctgaagagcttcaaggacaactacaacaccctggagagcaccctgtag

SEQ ID NO: 17075 - DNA, 468 bp, Artificial Sequence
  Description of Artificial Sequence: Synthetic coding sequence
atggccagcggcagcaactggctgagcggcgtgaacgtggtgctggtgatggcctacggcagcctggacctgaaggaggagatcgacatcagactgagcagagtgcaggacatcaagtacgagccccagctgctggccgacgacgacgccagactgctgcagctggagacccagggcaaccagagctgctacaactacctgtacagaatgaaggccctggacgccatcagaaccagcgagatccccttccacagcgagggcagacaccccagaagcctgatgggcaagaacttcagaagctacctgctggacctgagaaacaccagcacccccttcaagggcgtgagaaaggccctgatcgacaccctgctggacggctacgagaccgccagatacggcaccggcgtgttcggccagaacgagtacctgagataccaggaggccctgagcgagctggccaccgcctag

SEQ ID NO: 17076 - DNA, 570 bp, Artificial Sequence
  Description of Artificial Sequence: Synthetic coding sequence
atggccagcggcagcaactggctgagcggcgtgaacgtggtgctggtgatggcctacggcagcctggtgttcgtgctgctgttcatcttcgtgaagagacagatcatgagattcgccatgaagagcagaagaggcccccacgtgcccgtgggccacaacgcccccaaggacctgaaggaggagatcgacatcagactgagcagagtgcaggacatcaagtacgagccccagctgctggccgacgacgacgccagactgctgcagctggagacccagggcaaccagagctgctacaactacctgtacagaatgaaggccctggacgccatcagaaccagcgagatccccttccacagcgagggcagacaccccagaagcctgatgggcaagaacttcagaagctacctgctggacctgagaaacaccagcacccccttcaagggcgtgagaaaggccctgatcgacaccctgctggacggctacgagaccgccagatacggcaccggcgtgttcggccagaacgagtacctgagataccaggaggccctgagcgagctggccaccgcctag

SEQ ID NO: 17077 - DNA, 708 bp, Artificial Sequence
  Description of Artificial Sequence: Synthetic coding sequence
atggccagcggcagcaactggctgagcggcgtgaacgtggtgctggtgatggcctacggcagcctggtgttcgtgctgctgttcatcttcgtgaagagacagatcatgagattcgccatgaagagcagaagaggcccccacgtgcccgtgggccacaacgcccccaaggacctgaaggaggagatcgacatcagactgagcagagtgcaggacatcaagtacgagccccagctgctggccgacgacgacgccagactgctgcagctggagacccagggcaaccagaagatccccttccacagcgagggcagacaccccagaagcctgatgggcaagaacttcagaagctacctgctggacctgagaaacaccagcacccccttcaagggcgtgagaaaggccctgatcgacaccctgctggacggctacgagaccgccagatacggcaccggcgtgttcggccagaacgagtacctgagataccaggaggccctgagcgagctggccaccgccgtgaaggccagaatcggcagcagccagagacaccaccagagcgccgccaaggacctgacccagagccccgaggtgagccccaccaccatccaggtgacctacctgcccagcagccagaagagcaagagagccaagcacttcctggagctgaagagcttcaaggacaactacaacaccctggagagcaccctgtag

SEQ ID NO: 17078 - DNA, 762 bp, Artificial Sequence
  Description of Artificial Sequence: Synthetic coding sequence
atggccagcggcagcaactggctgagcggcgtgaacgtggtgctggtgatggcctacggcagcctggtgttcgtgctgctgttcatcttcgtgaagagacagatcatgagattcgccatgaagagcagaagaggcccccacgtgcccgtgggccacaacgcccccaaggacctgaaggaggagatcgacatcagactgagcagagtgcaggacatcaagtacgagccccagctgctggccgacgacgacgccagactgctgcagctggagacccagggcaaccagagctgctacaactacctgtacagaatgaaggccctggacgccatcagaaccagcgagatccccttccacagcgagggcagacaccccagaagcctgatgggcaagaacttcagaagctacctgctggacctgagaaacaccagcacccccttcaagggcgtgagaaaggccctgatcgacaccctgctggacggctacgagaccgccagatacggcaccggcgtgttcggccagaacgagtacctgagataccaggaggccctgagcgagctggccaccgccgtgaaggccagaatcggcagcagccagagacaccaccagagcgccgccaaggacctgacccagagccccgaggtgagccccaccaccatccaggtgacctacctgcccagcagccagaagagcaagagagccaagcacttcctggagctgaagagcttcaaggacaactacaacaccctggagagcaccctgtag

SEQ ID NO: 17079 - DNA, 1221 bp, Artificial Sequence
  Description of Artificial Sequence: Synthetic coding sequence
atgagaggcagcgtggagtgcacctggggctggggccactgcgcccccagccccctgctgctgtggaccctgctgctgttcgccgcccccttcggcctgctgggcgagaagaccagacaggtgagcctggaggtgatccccaactggctgggccccctgcagaacctgctgcacatcagagccgtgggcaccaacagcaccctgcactacgtgtggagcagcctgggccccctggccgtggtgatggtggccaccaacaccccccacagcaccctgagcgtgaactggagcctgctgctgagccccgagcccgacggcggcctgatggtgctgcccaaggacagcatccagttcagcagcgccctggtgttcaccagactgctggagttcgacagcaccaacgtgagcgacaccgccgccaagcccctgggcagaccctaccccccctacagcctggccgacttcagctggaacaacatcaccgacagcctggaccccgccaccctgagcgccaccttccagggccaccccatgaacgaccccaccagaaccttcgccaacggcagcctggccttcagagtgcaggccttcagcagaagcagcagacccgcccagccccccagactgctgcacaccgccgacacctgccagctggaggtggccctgatcggcgccagccccagaggcaacagaagcctgttcggcctggaggtggccaccctgggccagggccccgactgccccagcatgcaggagcagcacagcatcgacgacgagtacgcccccgccgtgttccagctggaccagctgctgtggggcagcctgcccagcggcttcgcccagtggagacccgtggcctacagccagaagcccggcggcagagagagcgccctgccctgccaggccagccccctgcaccccgccctggcctacagcctgccccagagccccatcgtgagagccttcttcggcagccagaacaacttctgcgccttcaacctgaccttcggcgccagcaccggccccggctactgggaccagcactacctgagctggagcatgctgctgggcgtgggcttcccccccgtggacggcctgagccccctggtgctgggcatcatggccgtggccctgggcgcccccggcctgatgctgctgggcggcggcctggtgctgctgctgcaccacaagaagtacagcgagtaccagagcatcaactag

SEQ ID NO: 17080 - DNA, 3765 bp, Artificial Sequence
  Description of Artificial Sequence: Synthetic coding sequence
atgaagaagcacagaagagccctggccctggtgagctgcctgttcctgtgcagcctggtgtggctgcccagctggagagtgtgctgcaaggagagcagcagcgccagcgccagcagctactacagccaggacgacaactgcgccctggagaacgaggacgtgcagttccagaagaaggacgagagagagggccccatcaacgccgagagcctgggcaagagcggcagcaacctgcccatcagccccaaggagcacaagctgaaggacgacagcatcgtggacgtgcagaacaccgagagcaagaagctgagcccccccgtggtggagaccctgcccaccgtggacctgcacgaggagagcagcaacgccgtggtggacagcgagaccgtggagaacatcagcagcagcagcaccagcgagatcacccccatcagcaagctggacgagatcgagaagagcggcaccatccccatcgccaagcccagcgagaccgagcagagcgagaccgactgcgacgtgggcgaggccctggacgccagcgcccccatcgagcagcccagcttcgtgagcccccccgacagcctggtgggccagcacatcgagaacgtgagcagcagccacggcaagggcaagatcaccaagagcgagttcgagagcaaggtgagcgccagcgagcagggcggcggcgaccccaagagcgccctgaacgccagcgacaacctgaagaacgagagcagcgactacaccaagcccggcgacatcgaccccaccagcgtggccagccccaaggaccccgaggacatccccaccttcgacgagtggaagaagaaggtgatggaggtggagaaggagaagagccagagcatgcacgccagcagcaacggcggcagccacgccaccaagaaggtgcagaagaacagaaacaactacgccagcgtggagtgcggcgccaagatcctggccgccaaccccgaggccaagagcaccagcgccatcctgatcgagaacatggacctgtacatgctgaacccctgcagcaccaagatctggttcgtgatcgagctgtgcgagcccatccaggtgaagcagctggacatcgccaactacgagctgttcagcagcacccccaaggacttcctggtgagcatcagcgacagataccccaccaacaagtggatcaagctgggcaccttccacggcagagacgagagaaacgtgcagagcttccccctggacgagcagatgtacgccaagtacgtgaagatgttcatcaagtacatcaaggtggagctgctgagccacttcggcagcgagcacttctgccccctgagcctgatcagagtgttcggcaccagcatggtggaggagtacgaggagatcgccgacagccagtaccacagcgagagacaggagctgttcgacgaggactacgactaccccctggactacaacaccggcgaggacaagagcagcaagaacctgctgggcagcgccaccaacgccatcctgaacatggtgaacatcgccgccaacatcctgggcgccaagaccgaggacctgaccgagggcaacaagagcatcagcgagaacgccaccgccaccgccgcccccaagatgcccgagagcacccccgtgagcacccccgtgcccagccccgagtacgtgaccaccgaggtgcacacccacgacatggagcccagcacccccgacacccccaaggagagccccatcgtgcagctggtgcaggaggaggaggaggaggccagccccagcaccgtgaccctgctgggcagcggcgagcaggaggacgagagcagcccctggttcgagagcgagacccagatcttctgcagcgagctgaccaccatctgctgcatcagcagcttcagcgagtacatctacaagtggtgcagcgtgagagtggccctgtacagacagagaagcagaaccgccctgagcaagggcaaggactacctggtgctggcccagccccccctgctgctgcccgccgagagcgtggacgtgagcgtgctgcagcccctgagcggcgagctggagaacaccaacatcgagagagaggccgagaccgtggtgctgggcgacctgagcagcagcatgcaccaggacgacctggtgaaccacaccgtggacgccgtggagctggagcccagccacagccagaccctgagccagagcctgctgctggacatcacccccgagatcaaccccctgcccaagatcgaggtgagcgagagcgtggagtacgaggccggccacatccccagccccgtgatcccccaggagagcagcgtggagatcgacaacgagaccgagcagaagagcgagagcttcagcagcatcgagaagcccagcatcacctacgagaccaacaaggtgaacgagctgatggacaacatcatcaaggaggacgtgaacagcatgcagatcttcaccaagctgagcgagaccatcgtgccccccatcaacaccgccaccgtgcccgacaacgaggacggcgaggccaagatgaacatcgccgacaccgccaagcagaccctgatcagcgtggtggacagcagcagcctgcccgaggtgaaggaggaggagcagagccccgaggacgccctgctgagaggcctgcagagaaccgccaccgacttctacgccgagctgcagaacagcaccgacctgggctacgccaacggcaacctggtgcacggcagcaaccagaaggagagcgtgttcatgagactgaacaacagaatcaaggccctggaggtgaacatgagcctgagcggcagatacctggaggagctgagccagagatacagaaagcagatggaggagatgcagaaggccttcaacaagaccatcgtgaagctgcagaacaccagcagaatcgccgaggagcaggaccagagacagaccgaggccatccagctgctgcaggcccagctgaccaacatgacccagctggtgagcaacctgagcgccaccgtggccgagctgaagagagaggtgagcgacagacagagctacctggtgatcagcctggtgctgtgcgtggtgctgggcctgatgctgtgcatgcagagatgcagaaacaccagccagttcgacggcgactacatcagcaagctgcccaagagcaaccagtaccccagccccaagagatgcttcagcagctacgacgacatgaacctgaagagaagaaccagcttccccctgatgagaagcaagagcctgcagctgaccggcaaggaggtggaccccaacgacctgtacatcgtggagcccctgaagttcagccccgagaagaagaagaagagatgcaagtacaagatcgagaagatcgagaccatcaagcccgaggagcccctgcaccccatcgccaacggcgacatcaagggcagaaagcccttcaccaaccagagagacttcagcaacatgggcgaggtgtaccacagcagctacaagggcccccccagcgagggcagcagcgagaccagcagccagagcgaggagagctacttctgcggcatcagcgcctgcaccagcctgtgcaacggccagagccagaagaccaagaccgagaagagagccctgaagagaagaagaagcaaggtgcaggaccagggcaagctgatcaagaccctgatccagaccaagagcggcagcctgcccagcctgcacgacatcatcaagggcaacaaggagatcaccgtgggcaccttcggcgtgaccgccgtgagcggccacatctag

SEQ ID NO: 17081 - DNA, 4221 bp, Artificial Sequence
  Description of Artificial Sequence: Synthetic coding sequence
atgagaggcttcctggccagacccttcctgagcaccaaccagcacctggcccagtggggcagccccctgccccagggcaagggcctggtgcagctgcccagccagcacaccagacacagcagacccttccacgagctgtgcagcaaggaggagaacagcgccaccgtgcccaagctgatcagcctggtggtgagcagcgagaccatcgacttcagcaacaagaccatggacagcagaagagactgggagagagagaagagaatcctggagggcaagctgcagctgcccaaggccctggccagaacccagagagccagagacgagggcagaagagcctggaccagcagatggctgcagagaagaagaagccccgagagctgcgaggcccccctgagcgcccccctgtggggcccccagagaggcctgcccggcagagagcccctgagaagcagaagcgccagcgccatcgccctgagaaccatcggccacatcctggccctgctgctgagactgctgcacctgggcctgggcagcggcggctgcagagaggacgtgccccccagcggcagaggcaagaaggaggagaagatgaagaagcacagaagagccctggccctggtgagctgcctgttcctgtgcagcctggtgtggctgcccagctggagagtgtgctgcaaggagagcagcagcgccagcgccagcagctactacagccaggacgacaactgcgccctggagaacgaggacgtgcagttccagaagaagaacaccgagagcaagaagctgagcccccccgtggtggagaccctgcccaccgtggacctgcacgaggagagcagcaacgccgtggtggacagcgagaccgtggagaacatcagcagcagcagcaccagcgagatcacccccatcagcaagctggacgagatcgagaagagcggcaccatccccatcgccaagcccagcgagaccgagcagagcgagaccgactgcgacgtgggcgaggccctggacgccagcgcccccatcgagcagcccagcttcgtgagcccccccgacagcctggtgggccagcacatcgagaacgtgagcagcagccacggcaagggcaagatcaccaagagcgagttcgagagcaaggtgagcgccagcgagcagggcggcggcgaccccaagagcgccctgaacgccagcgacaacctgaagaacgagagcagcgactacaccaagcccggcgacatcgaccccaccagcgtggccagccccaaggaccccgaggacatccccaccttcgacgagtggaagaagaaggtgatggaggtggagaaggagaagagccagagcatgcacgccagcagcaacggcggcagccacgccaccaagaaggtgcagaagaacagaaacaactacgccagcgtggagtgcggcgccaagatcctggccgccaaccccgaggccaagagcaccagcgccatcctgatcgagaacatggacctgtacatgctgaacccctgcagcaccaagatctggttcgtgatcgagctgtgcgagcccatccaggtgaagcagctggacatcgccaactacgagctgttcagcagcacccccaaggacttcctggtgagcatcagcgacagataccccaccaacaagtggatcaagctgggcaccttccacggcagagacgagagaaacgtgcagagcttccccctggacgagcagatgtacgccaagtacgtgaaggtggagctgctgagccacttcggcagcgagcacttctgccccctgagcctgatcagagtgttcggcaccagcatggtggaggagtacgaggagatcgccgacagccagtaccacagcgagagacaggagctgttcgacgaggactacgactaccccctggactacaacaccggcgaggacaagagcagcaagaacctgctgggcagcgccaccaacgccatcctgaacatggtgaacatcgccgccaacatcctgggcgccaagaccgaggacctgaccgagggcaacaagagcatcagcgagaacgccaccgccaccgccgcccccaagatgcccgagagcacccccgtgagcacccccgtgcccagccccgagtacgtgaccaccgaggtgcacacccacgacatggagcccagcacccccgacacccccaaggagagccccatcgtgcagctggtgcaggaggaggaggaggaggccagccccagcaccgtgaccctgctgggcagcggcgagcaggaggacgagagcagcccctggttcgagagcgagacccagatcttctgcagcgagctgaccaccatctgctgcatcagcagcttcagcgagtacatctacaagtggtgcagcgtgagagtggccctgtacagacagagaagcagaaccgccctgagcaagggcaaggactacctggtgctggcccagccccccctgctgctgcccgccgagagcgtggacgtgagcgtgctgcagcccctgagcggcgagctggagaacaccaacatcgagagagaggccgagaccgtggtgctgggcgacctgagcagcagcatgcaccaggacgacctggtgaaccacaccgtggacgccgtggagctggagcccagccacagccagaccctgagccagagcctgctgctggacatcacccccgagatcaaccccctgcccaagatcgaggtgagcgagagcgtggagtacgaggccggccacatccccagccccgtgatcccccaggagagcagcgtggagatcgacaacgagaccgagcagaagagcgagagcttcagcagcatcgagaagcccagcatcacctacgagaccaacaaggtgaacgagctgatggacaacatcatcaaggaggacgtgaacagcatgcagatcttcaccaagctgagcgagaccatcgtgccccccatcaacaccgccaccgtgcccgacaacgaggacggcgaggccaagatgaacatcgccgacaccgccaagcagaccctgatcagcgtggtggacagcagcagcctgcccgaggtgaaggaggaggagcagagccccgaggacgccctgctgagaggcctgcagagaaccgccaccgacttctacgccgagctgcagaacagcaccgacctgggctacgccaacggcaacctggtgcacggcagcaaccagaaggagagcgtgttcatgagactgaacaacagaatcaaggccctggaggtgaacatgagcctgagcggcagatacctggaggagctgagccagagatacagaaagcagatggaggagatgcagaaggccttcaacaagaccatcgtgaagctgcagaacaccagcagaatcgccgaggagcaggaccagagacagaccgaggccatccagctgctgcaggcccagctgaccaacatgacccagctggtgagcaacctgagcgccaccgtggccgagctgaagagagaggtgagcgacagacagagctacctggtgatcagcctggtgctgtgcgtggtgctgggcctgatgctgtgcatgcagagatgcagaaacaccagccagttcgacggcgactacatcagcaagctgcccaagagcaaccagtaccccagccccaagagatgcttcagcagctacgacgacatgaacctgaagagaagaaccagcttccccctgatgagaagcaagagcctgcagctgaccggcaaggaggtggaccccaacgacctgtacatcgtggagcccctgaagttcagccccgagaagaagaagaagagatgcaagtacaagatcgagaagatcgagaccatcaagcccgaggagcccctgcaccccatcgccaacggcgacatcaagggcagaaagcccttcaccaaccagagagacttcagcaacatgggcgaggtgtaccacagcagctacaagggcccccccagcgagggcagcagcgagaccagcagccagagcgaggagagctacttctgcggcatcagcgcctgcaccagcctgtgcaacggccagagccagaagaccaagaccgagaagagagccctgaagagaagaagaagcaaggtgcaggaccagggcaagctgatcaagaccctgatccagaccaagagcggcagcctgcccagcctgcacgacatcatcaagggcaacaaggagatcaccgtgggcaccttcggcgtgaccgccgtgagcggccacatctag

SEQ ID NO: 17082 - DNA, 1227 bp, Artificial Sequence
  Description of Artificial Sequence: Synthetic coding sequence
atgcccgtgatcagcagcagacaggactgcgacagcgccaccagcaccgtgaccgacatcctgtgcgccgccgaggtgaagagcagcaagggcaccgaggacagaggcagaatcctgggcgacagcaacctgcaggtgagcaagctgctgagccagttccccctgaagagcaccgagaccagcaaggtgcccgacaacaagaacgtgctggacaagaccagagtgaccaaggacttcctgcaggacaacctgttcagcggccccggccccaaggagcccaccggcctgagccccttcctgctgctgccccccagacccccccccgccagacccgacaagctgcccgagctgcccgcccagaagagacagctgcccgtgttcgccaagatctgcagcaagcccaaggccgaccccgccgtggagagacaccacctgatggagtggagccccggcaccaaggagcccaagaagggccagggcagcctgttcctgagccagtggccccagagccagaaggacgcctgcggcgaggagggctgctgcgacgccgtgggcaccgccagcctgaccctgccccccaagaagcccacctgccccgccgagaagaacctgctgtacgagttcctgggcgccaccaagaaccccagcggccagcccagactgagaaacaaggtggaggtggacggccccgagctgaagttcaacgcccccgtgaccgtggccgacaagaacaaccccaagtacaccggcaacgtgttcaccccccacttccccaccgccatgaccagcgccaccctgaaccagcccctgtggctgaacctgaactacccccccccccccgtgttcaccaaccacagcaccttcctgcagtaccagggcctgtacccccagcaggccgccagaatgccctaccagcaggccctgcacccccagctgggctgctacagccagcaggtgatgccctacaacccccagcagatgggccagcagatcttcagaagcagctacacccccctgctgagctacatccccttcgtgcagcccaactacccctacccccagagaaccccccccaagatgagcgccaaccccagagacccccccctgatggccggcgacggcccccagtacctgttcccccagggctacggcttcggcagcaccagcggcggccccctgatgcacagcccctacttcagcagcagcggcaacggcatcaacttctag

SEQ ID NO: 17083 - DNA, 1797 bp, Artificial Sequence
  Description of Artificial Sequence: Synthetic coding sequence
atgagaggcggcggcggctgcgtgctggccctgggcggccagagaggcttccagaaggagagaagaagaatggccagcggcaacggcctgcccagcagcagcgccctggtggccaagggcccctgcgccctgggccccttccccagatacatctggatccaccaggacaccccccaggacagcctggacaagacctgccacgagatctggaagagagtgcagggcctgcccgaggccagccagccctggaccagcatggagcagctgagcgtgcccgtggtgggcaccctgagaggcaacgagctgagcttccaggaggaggccctggagctgagcagcggcaaggacgagatcagcctgctggtggagcaggagttcctgagcctgaccaaggagcacagcatcctggtggaggagagcagcggcgagctggaggtgcccggcagcagccccgagggcaccagagagctggccccctgcatcctggccccccccctggtggccggcagcaacgagagacccagagccagcatcatcgtgggcgacaagctgctgaagcagaaggtggccatgcccgtgatcagcagcagacaggactgcgacagcgccaccagcaccgtgaccgacatcctgtgcgccgccgaggtgaagagcagcaagggcaccgaggacagaggcagaatcctgggcgacagcaacctgcaggtgagcaagctgctgagccagttccccctgaagagcaccgagaccagcaaggtgcccgacaacaagaacgtgctggacaagaccagagtgaccaaggacttcctgcaggacaacctgttcagcggccccggccccaaggagcccaccggcctgagccccttcctgctgctgccccccagacccccccccgccagacccgacaagctgcccgagctgcccgcccagaagagacagctgcccgtgttcgccaagatctgcagcaagcccaaggccgaccccgccgtggagagacaccacctgatggagtggagccccggcaccaaggagcccaagaagggccagggcagcctgttcctgagccagtggccccagagccagaaggacgcctgcggcgaggagggctgctgcgacgccgtgggcaccgccagcctgaccctgccccccaagaagcccacctgccccgccgagaagaacctgctgtacgagttcctgggcgccaccaagaaccccagcggccagcccagactgagaaacaaggtggaggtggacggccccgagctgaagttcaacgcccccgtgaccgtggccgacaagaacaaccccaagtacaccggcaacgtgttcaccccccacttccccaccgccatgaccagcgccaccctgaaccagcccctgtggctgaacctgaactacccccccccccccgtgttcaccaaccacagcaccttcctgcagtaccagggcctgtacccccagcaggccgccagaatgccctaccagcaggccctgcacccccagctgggctgctacagccagcaggtgatgccctacaacccccagcagatgggccagcagatcttcagaagcagctacacccccctgctgagctacatccccttcgtgcagcccaactacccctacccccagagaaccccccccaagatgagcgccaaccccagagacccccccctgatggccggcgacggcccccagtacctgttcccccagggctacggcttcggcagcaccagcggcggccccctgatgcacagcccctacttcagcagcagcggcaacggcatcaacttctag

SEQ ID NO: 17084 - DNA, 426 bp, Artificial Sequence
  Description of Artificial Sequence: Synthetic coding sequence
atggagcccagccacaaggacgccgagaccgccgccgccgccgccgccgtggccgccgccgaccccagaggcgccagcagcagcagcggcgtggtggtgcaggtgagagagaagaagggccccctgagagccgccatcccctacatgcccttccccgtggccgtgatctgcctgttcctgaacaccttcgtgcccggcctgggcaccttcgtgagcgccttcaccgtgctgtgcggcgccagaaccgacctgcccgacagacacgtgtgctgcgtgttctggctgaacatcgccgccgccctgatccagatcctgaccgccatcgtgatggtgggctggatcatgagcatcttctggggcatggacatggtgatcctggccatcagccagggctacaaggagcagggcatcccccagcagctgtag

SEQ ID NO: 17085 - DNA, 426 bp, Artificial Sequence
  Description of Artificial Sequence: Synthetic coding sequence
atggagcccagccacaaggacgccgagaccgccgccgccgccgccgccgtggccgccgccgaccccagaggcgccagcagcagcagcggcgtggtggtgcaggtgagagagaagaagggccccctgagagccgccatcccctacatgcccttccccgtggccgtgatctgcctgttcctgaacaccttcgtgcccggcctgggcaccttcgtgagcgccttcaccgtgctgtgcggcgccagaaccgacctgcccgacagacacgtgtgctgcgtgttctggctgaacatcgccgccgccctgatccagatcctgaccgccatcgtgatggtgggctggatcatgagcatcttctggggcatggacatggtgatcctggccaccagcaccggctacaaggagcagggcatcccccagcagctgtag

SEQ ID NO: 17086 - DNA, 639 bp, Artificial Sequence
  Description of Artificial Sequence: Synthetic coding sequence
atgagaagcagactgctgctgagcgtggcccacctgcccaccatcagagagaccaccgaggagatgctgctgggcggccccggccaggagcccccccccagccccagcctggacgactacgtgagaagcatcagcagactggcccagcccaccagcgtgctggacaaggccaccgcccagggccagcccagacccccccacagacccgcccaggcctgcagaaagggcagacccgccgtgagcctgagagacatcaccgccagattcagcggccagcagcccaccctgcccatggccgacaccgtggaccccctggactggctgttcggcgagagccaggagaagcagcccagccagagagacctgcccagaagaaccggccccagcgccggcctgtggggcccccacagacagatggacagcagcaagcccatgggcgcccccagaggcagactgtgcgaggccagaatgcccggccacagcctggccagacccccccaggacggccagcagagcagcgacctgagaagctggaccttcggccagagcgcccaggccatggccagcagacacagacccagacccagcagcgtgctgagaaccctgtacagccacctgcccgtgatccacgagctgtag

SEQ ID NO: 17087 - DNA, 384 bp, Artificial Sequence
  Description of Artificial Sequence: Synthetic coding sequence
atgagaagcagactgctgctgagcgtggcccacctgcccaccatcagagagaccaccgaggagatgctgctgggcggccccggccaggagcccccccccagccccagcctggacgactacgtgagaagcatcagcagactggcccagcccaccagcgtgctggacaaggccaccgcccagggccagcccagacccccccacagacccgcccaggcctgcagaaagggcagacccgccgtgagcctgctggccagcggcgtgcacatcgacagatggaccgccgccagcccctggggcccccccgagggcggcagcgtgaagcccggctgcctgggcatcccctggcaggaccacagaagaatgggcagcagagccctgacctag

SEQ ID NO: 17088 - DNA, 255 bp, Artificial Sequence
  Description of Artificial Sequence: Synthetic coding sequence
atgagaagcagactgctgctgagcgtggcccacctgcccaccatcagagagaccaccgaggagatgctgctgggcggccccggccaggagcccccccccagccccagcctggacgactacgtgagaagcatcagcagactggcccagcccaccagcgtgctggacaaggccaccgcccagggccagcccagacccccccacagacccgcccaggcctgcagaaagggcagacccgccgtgagcctgagagactag

SEQ ID NO: 17089 - DNA, 504 bp, Artificial Sequence
  Description of Artificial Sequence: Synthetic coding sequence
ctgggcctgctggtggagagacaggagagcgagggcctgcccagagtgagaccccccgtgcacggcagaccccaggccaccgccgccggcatcaccggcgccatgagcaccgagggccccagcctggccagcagccccgccatcagccccctggccttcctgagcgcccccgtgacccccggcaccctggccgaggccaccgaccccctgcccatgctgatcgccctggcctgcatcttcctgctgctggccacctgcctgctgttcatgaccctgtgcaagcccgccgccctggaccccagcagaagaagagcccacgagtgcatgccccaccaccccggcagccccagcgagccccagctgagactgtggaagagactgggcagcctgagactgagcctgcacagcttcagacacggcagacccaccgtgcccagacagcccctgcccggccccgaggacaacagaagccactgcgactacatggagagcaccaagatgtag

SEQ ID NO: 17090 - DNA, 402 bp, Artificial Sequence
  Description of Artificial Sequence: Synthetic coding sequence
atgagcaccgagggccccagcctggccagcagccccgccatcagccccctggccttcctgagcgcccccgtgacccccggcaccctggccgaggccaccgaccccctgcccatgctgatcgccctggcctgcatcttcctgctgctggccacctgcctgctgttcatgaccctgtgcaagcccgccgccctggaccccagcagaagaagagcccacgagtgcatgccccaccaccccggcagccccagcgagccccagctgagactgtggaagagactgggcagcctgagactgagcctgcacagcttcagacacggcagacccaccgtgcccagacagcccctgcccggccccgaggacaacagaagccactgcgactacatggagagcaccaagatgtag

SEQ ID NO: 17091 - DNA, 402 bp, Artificial Sequence; identical to SEQ ID NO: 17090
  Description of Artificial Sequence: Synthetic coding sequence

SEQ ID NO: 17092 - DNA, 468 bp, Artificial Sequence
  Description of Artificial Sequence: Synthetic coding sequence
atggagagcctgcagaccccccagcacagagagaaccaggacaagagagagaaggagtacggcgtgaagcacatgcccatgggcaacaacgccggcaacctggagcccgagaagagaaaggccgtgagagtggccctgagcagcgccaccgccgcccagaacatccccagcagcgtgcactgcggctgcagcaagcagtggagactgagactgcccagcgagagcctgcagagcagaggccaggtgatgaagagacccaacaacatcctgaagctgagaaacctggacctgctgatctacccctggcccgagctgagaagaagacaggtggccagcgacctgatgagcctgctgctgctgcccgccttcagcggcctgacctgggcccccttcctgttcctgttcacctacctgccccccttcctgaacctgctgaccgtgggcttcgtgagctacttcctggtgtag

SEQ ID NO: 17093 - DNA, 1524 bp, Artificial Sequence
  Description of Artificial Sequence: Synthetic coding sequence
tgagagtgccccagaggcagaagcgccctgctgaagggccccccccaggagaagcccaacagaagaagcgccctgctgagcgtgggcgagatcagcgagctgtgccccgagatcaccgacttcctgtgcagagacaagaagtgcatcgccagccacctgctgtgcgactacaagcccgactgcagcgacagaagcgacgaggcccactgcgcccactacaccagcaccaccggcagctgcaacttcgagaccagcagcggcaactggaccaccgcctgcagcctgacccaggacagcgaggacgacctggactgggccatcggcagcagaatccccgccaaggccctgatccccgacagcgaccacacccccggcagcggccagcacttcctgtacgtgaacagcagcggcagcaaggagggcagcgtggccagaatcaccaccagcaagagcttccccgccagcctgggcatgtgcaccgtgagattctggttctacatgatcgaccccagaagcatgggcatcctgaaggtgtacaccatcgaggagagcggcctgaacatcctggtgtggagcgtgatcggcaacaagagaaccggctggacctacggcagcgtgcccctgagcagcaacagccccttcaaggtggccttcgaggccgacctggacggcaacgaggacatcttcatcgccctggacgacatcagcttcacccccgagtgcgtgaccggcggccccgtgcccgtgcagcccagcccctgcgaggccgaccagttcagctgcatctacaccctgcagtgcgtgcccctgagcggcaagtgcgacggccacgaggactgcatcgacggcagcgacgagatggactgccccctgagccccaccccccccctgtgcagcaacatggagttcccctgcagcaccgacgagtgcatccccagcctgctgctgtgcgacggcgtgcccgactgccacttcaacgaggacgagctgatctgcagcaacaagagctgcagcaacggcgccctggtgtgcgccagcagcaacagctgcatccccgcccaccagagatgcgacggcttcgccgactgcatggacttccagctggacgagagcagctgcagcgagtgccccctgaactactgcagaaacggcggcacctgcgtggtggagaagaacggccccatgtgcagatgcagacagggctggaagggcaacagatgccacatcaagttcaacccccccgccaccgacttcacctacgcccagaacaacacctggaccctgctgggcatcggcctggccttcctgatgacccacatcaccgtggccgtgctgtgcttcctggccaacagaaaggtgcccatcagaaagaccgagggcagcggcaactgcgccttcgtgaaccccgtgtacggcaactggagcaaccccgagaagaccgagagcagcgtgtacagcttcagcaaccccctgtacggcaccaccagcggcagcctggagaccctgagccaccacctgaagtag

SEQ ID NO: 17094 - DNA, 4461 bp, Artificial Sequence
  Description of Artificial Sequence: Synthetic coding sequence
cccagagaccacagcctgaacgccagccagggccacttcatgttcatcctgaagaagagcagcagcctgtggcaggtggccaagctgcagagccccaccttcagccagaccggccccggctgcatcctgagcttctggttctacaactacggcctgagcgtgggcgccgccgagctgcagctgcacatggagaacagccacgacagcaccgtgatctggagagtgctgtacaaccagggcaagcagtggctggaggccaccatccagctgggcagactgagccagcccttccacctgagcctggacaaggtgagcctgggcatctacgacggcgtgagcgccatcgacgacatcagattcgagaactgcaccctgcccctgcccgccgagagctgcgagggcctggaccacttctggtgcagacacaccagagcctgcatcgagaagctgagactgtgcgacctggtggacgactgcggcgacagaaccgacgaggtgaactgcgcccccgagctgcagtgcaacttcgagaccggcatctgcaactgggagcaggacgccaaggacgacttcgactggaccagaagccagggccccacccccaccctgaacaccggccccatgaaggacaacaccctgggcaccgccaagggccactacctgtacatcgagagcagcgagccccaggccttccaggacagcgccgccctgctgagccccatcctgaacgccaccgacaccaagggctgcaccttcagattctactaccacatgttcggcaagagaatctacagactggccatctaccagagaatctggagcgacagcagaggccagctgctgtggcagatcttcggcaaccagggcaacagatggatcagaaagcacctgaacatcagcagcagacagcccttccagatcctggtggaggccagcgtgggcgacggcttcaccggcgacatcgccatcgacgacctgagcttcatggactgcaccctgtaccccggcaacctgcccgccgacctgcccaccccccccgagaccagcgtgcccgtgaccctgcccccccacaactgcaccgacaacgagttcatctgcagaagcgacggccactgcatcgagaagatgcagaagtgcgacttcaagtacgactgccccgacaagagcgacgaggccagctgcgtgatggaggtgtgcagcttcgagaagagaagcctgtgcaagtggtaccagcccatccccgtgcacctgctgcaggacagcaacaccttcagatggggcctgggcaacggcatcagcatccaccacggcgaggagaaccacagacccagcgtggaccacacccagaacaccaccgacggctggtacctgtacgccgacagcagcaacggcaagttcggcgacaccgccgacatcctgacccccatcatcagcctgaccggccccaagtgcaccctggtgttctggacccacatgaacggcgccaccgtgggcagcctgcaggtgctgatcaagaaggacaacgtgaccagcaagctgtgggcccagaccggccagcagggcgcccagtggaagagagccgaggtgttcctgggcatcagaagccacacccagatcgtgttcagagccaagagaggcatcagctacatcggcgacgtggccgtggacgacatcagcttccaggactgcagccccctgctgagccccgagagaaagtgcaccgaccacgagttcatgtgcgccaacaagcactgcatcgccaaggacaagctgtgcgacttcgtgaacgactgcgccgacaacagcgacgagaccaccttcatctgcagaaccagcagcggcagatgcgacttcgagttcgacctgtgcagctggaagcaggagaaggacgaggacttcgactggaacctgaaggccagcagcatccccgccgccggcaccgagcccgccgccgaccacaccctgggcaacagcagcggccactacatcttcatcaagagcctgttcccccagcagcccatgagagccgccagaatcagcagccccgtgatcagcaagagaagcaagaactgcaagatcatcttccactaccacatgtacggcaacggcatcggcgccctgaccctgatgcaggtgagcgtgaccaaccagaccaaggtgctgctgaacctgaccgtggagcagggcaacttctggagaagagaggagctgagcctgttcggcgacgaggacttccagctgaagttcgagggcagagtgggcaagggccagagaggcgacatcgccctggacgacatcgtgctgaccgagaactgcctgagcctgcacgacagcgtgcaggaggagctggccgtgcccctgcccaccggcttctgccccctgggctacagagagtgccacaacggcaagtgctacagactggagcagagctgcaacttcgtggacaactgcggcgacaacaccgacgagaacgagtgcggcagcagctgcaccttcgagaagggctggtgcggctggcagaacagccaggccgacaacttcgactgggtgctgggcgtgggcagccaccagagcctgagaccccccaaggaccacaccctgggcaacgagaacgccatcctgctgatgagaagacacaagtaccccatcagaagcgtgaacctgcacaccgtgaagcacgtgctgaaggcccagaccgtgggcaactgcagcgtgagcaagctggaggccagactgctggacttcctgagcgtgcccaacgagaacaccttcggcagcagcgaccacaccaactggcacttcatgtacctggaggccaccgccgtgggcctgagaggcgacaaggcccacttcagaagcaccatgtggagagagagcagcgccgcctgcaccatgagcttctggtacttcgtgagcgccaaggccaccggcagcatccagatcctgatcaagagaggcagaagaagaagaagagcccccaaccccgtgctgagcggcagccccaccatccccagacagggcagccagcagctgggcggctggagaggcggcagcgccagacacagagccagagccttccccgagcccgagtgccccagaggcagaagcgccctgctgaagggccccccccaggagaagcccaacagaagaagcgccctgctgagcgtgggcgagatcagcgagctgtgccccgagatcaccgacttcctgtgcagagacaagaagtgcatcgccagccacctgctgtgcgactacaagcccgactgcagcgacagaagcgacgaggcccactgcgcccactacaccagcaccaccggcagctgcaacttcgagaccagcagcggcaactggaccaccgcctgcagcctgacccaggacagcgaggacgacctggactgggccatcggcagcagaatccccgccaaggccctgatccccgacagcgaccacacccccggcagcggccagcacttcctgtacgtgaacagcagcggcagcaaggagggcagcgtggccagaatcaccaccagcaagagcttccccgccagcctgggcatgtgcaccgtgagattctggttctacatgatcgaccccagaagcatgggcatcctgaaggtgtacaccatcgaggagagcggcctgaacatcctggtgtggagcgtgatcggcaacaagagaaccggctggacctacggcagcgtgcccctgagcagcaacagccccttcaaggtggccttcgaggccgacctggacggcaacgaggacatcttcatcgccctggacgacatcagcttcacccccgagtgcgtgaccggcggccccgtgcccgtgcagcccagcccctgcgaggccgaccagttcagctgcatctacaccctgcagtgcgtgcccctgagcggcaagtgcgacggccacgaggactgcatcgacggcagcgacgagatggactgccccctgagccccaccccccccctgtgcagcaacatggagttcccctgcagcaccgacgagtgcatccccagcctgctgctgtgcgacggcgtgcccgactgccacttcaacgaggacgagctgatctgcagcaacaagagctgcagcaacggcgccctggtgtgcgccagcagcaacagctgcatccccgcccaccagagatgcgacggcttcgccgactgcatggacttccagctggacgagagcagctgcagcgacacctggaccctgctgggcatcggcctggccttcctgatgacccacatcaccgtggccgtgctgtgcttcctggccaacagaaaggtgcccatcagaaagaccgagggcagcggcaactgcgccttcgtgaaccccgtgtacggcaactggagcaaccccgagaagaccgagagcagcgtgtacagcttcagcaaccccctgtacggcaccaccagcggcagcctggagaccctgagccaccacctgaagtag

SEQ ID NO: 17095 - DNA, 777 bp, Artificial Sequence
  Description of Artificial Sequence: Synthetic coding sequence
ctgaagttcgagggcagagtgggcaagggccagagaggcgacatcgccctggacgacatcgtgctgaccgagaactgcctgagcctgcacgacagcgtgcaggaggagctggccgtgcccctgcccaccggcttctgccccctgggctacagagagtgccacaacggcaagtgctacagactggagcagagctgcaacttcgtggacaactgcggcgacaacaccgacgagaacgagtgcggcagcagctgcaccttcgagaagggctggtgcggctggcagaacagccaggccgacaacttcgactgggtgctgggcgtgggcagccaccagagcctgagaccccccaaggaccacaccctgggcaacgagaacggccacttcatgtacctggaggccaccgccgtgggcctgagaggcgacaaggcccacttcagaagcaccatgtggagagagagcagcgccgcctgcaccatgagcttctggtacttcgtgagcgccaaggccaccggcagcatccagatcctgatcaagaccgagaagggcctgagcaaggtgtggcaggagagcaagcagaaccccggcaaccactggcagaaggccgacatcctgctgggcaagctgagaaacttcgaggtgatcttccagggcatcagaaccagagacctgggcggcggcgccgccatcgacgacatcgagttcaagaactgcaccaccgtgggcgagatcagcgagctgtgccccgagatcaccgacttcctgtgcagagacaagtag

SEQ ID NO: 17096 - DNA, 4422 bp, Artificial Sequence
  Description of Artificial Sequence: Synthetic coding sequence
atgttcatcctgaagaagagcagcagcctgtggcaggtggccaagctgcagagccccaccttcagccagaccggccccggctgcatcctgagcttctggttctacaactacggcctgagcgtgggcgccgccgagctgcagctgcacatggagaacagccacgacagcaccgtgatctggagagtgctgtacaaccagggcaagcagtggctggaggccaccatccagctgggcagactgagccagcccttccacctgagcctggacaaggtgagcctgggcatctacgacggcgtgagcgccatcgacgacatcagattcgagaactgcaccctgcccctgcccgccgagagctgcgagggcctggaccacttctggtgcagacacaccagagcctgcatcgagaagctgagactgtgcgacctggtggacgactgcggcgacagaaccgacgaggtgaactgcgcccccgagctgcagtgcaacttcgagaccggcatctgcaactgggagcaggacgccaaggacgacttcgactggaccagaagccagggccccacccccaccctgaacaccggccccatgaaggacaacaccctgggcaccgccaagggccactacctgtacatcgagagcagcgagccccaggccttccaggacagcgccgccctgctgagccccatcctgaacgccaccgacaccaagggctgcaccttcagattctactaccacatgttcggcaagagaatctacagactggccatctaccagagaatctggagcgacagcagaggccagctgctgtggcagatcttcggcaaccagggcaacagatggatcagaaagcacctgaacatcagcagcagacagcccttccagatcctggtggaggccagcgtgggcgacggcttcaccggcgacatcgccatcgacgacctgagcttcatggactgcaccctgtaccccggcaacctgcccgccgacctgcccaccccccccgagaccagcgtgcccgtgaccctgcccccccacaactgcaccgacaacgagttcatctgcagaagcgacggccactgcatcgagaagatgcagaagtgcgacttcaagtacgactgccccgacaagagcgacgaggccagctgcgtgatggaggtgtgcagcttcgagaagagaagcctgtgcaagtggtaccagcccatccccgtgcacctgctgcaggacagcaacaccttcagatggggcctgggcaacggcatcagcatccaccacggcgaggagaaccacagacccagcgtggaccacacccagaacaccaccgacggctggtacctgtacgccgacagcagcaacggcaagttcggcgacaccgccgacatcctgacccccatcatcagcctgaccggccccaagtgcaccctggtgttctggacccacatgaacggcgccaccgtgggcagcctgcaggtgctgatcaagaaggacaacgtgaccagcaagctgtgggcccagaccggccagcagggcgcccagtggaagagagccgaggtgttcctgggcatcagaagccacacccagatcgtgttcagagccaagagaggcatcagctacatcggcgacgtggccgtggacgacatcagcttccaggactgcagccccctgctgagccccgagagaaagtgcaccgaccacgagttcatgtgcgccaacaagcactgcatcgccaaggacaagctgtgcgacttcgtgaacgactgcgccgacaacagcgacgagaccaccttcatctgcagaaccagcagcggcagatgcgacttcgagttcgacctgtgcagctggaagcaggagaaggacgaggacttcgactggaacctgaaggccagcagcatccccgccgccggcaccgagcccgccgccgaccacaccctgggcaacagcagcggccactacatcttcatcaagagcctgttcccccagcagcccatgagagccgccagaatcagcagccccgtgatcagcaagagaagcaagaactgcaagatcatcttccactaccacatgtacggcaacggcatcggcgccctgaccctgatgcaggtgagcgtgaccaaccagaccaaggtgctgctgaacctgaccgtggagcagggcaacttctggagaagagaggagctgagcctgttcggcgacgaggacttccagctgaagttcgagggcagagtgggcaagggccagagaggcgacatcgccctggacgacatcgtgctgaccgagaactgcctgagcctgcacgacagcgtgcaggaggagctggccgtgcccctgcccaccggcttctgccccctgggctacagagagtgccacaacggcaagtgctacagactggagcagagctgcaacttcgtggacaactgcggcgacaacaccgacgagaacgagtgcggcagcagctgcaccttcgagaagggctggtgcggctggcagaacagccaggccgacaacttcgactgggtgctgggcgtgggcagccaccagagcctgagaccccccaaggaccacaccctgggcaacgagaacgccatcctgctgatgagaagacacaagtaccccatcagaagcgtgaacctgcacaccgtgaagcacgtgctgaaggcccagaccgtgggcaactgcagcgtgagcaagctggaggccagactgctggacttcctgagcgtgcccaacgagaacaccttcggcagcagcgaccacaccaactggcacttcatgtacctggaggccaccgccgtgggcctgagaggcgacaaggcccacttcagaagcaccatgtggagagagagcagcgccgcctgcaccatgagcttctggtacttcgtgagcgccaaggccaccggcagcatccagatcctgatcaagagaggcagaagaagaagaagagcccccaaccccgtgctgagcggcagccccaccatccccagacagggcagccagcagctgggcggctggagaggcggcagcgccagacacagagccagagccttccccgagcccgagtgccccagaggcagaagcgccctgctgaagggccccccccaggagaagcccaacagaagaagcgccctgctgagcgtgggcgagatcagcgagctgtgccccgagatcaccgacttcctgtgcagagacaagaagtgcatcgccagccacctgctgtgcgactacaagcccgactgcagcgacagaagcgacgaggcccactgcgcccactacaccagcaccaccggcagctgcaacttcgagaccagcagcggcaactggaccaccgcctgcagcctgacccaggacagcgaggacgacctggactgggccatcggcagcagaatccccgccaaggccctgatccccgacagcgaccacacccccggcagcggccagcacttcctgtacgtgaacagcagcggcagcaaggagggcagcgtggccagaatcaccaccagcaagagcttccccgccagcctgggcatgtgcaccgtgagattctggttctacatgatcgaccccagaagcatgggcatcctgaaggtgtacaccatcgaggagagcggcctgaacatcctggtgtggagcgtgatcggcaacaagagaaccggctggacctacggcagcgtgcccctgagcagcaacagccccttcaaggtggccttcgaggccgacctggacggcaacgaggacatcttcatcgccctggacgacatcagcttcacccccgagtgcgtgaccggcggccccgtgcccgtgcagcccagcccctgcgaggccgaccagttcagctgcatctacaccctgcagtgcgtgcccctgagcggcaagtgcgacggccacgaggactgcatcgacggcagcgacgagatggactgccccctgagccccaccccccccctgtgcagcaacatggagttcccctgcagcaccgacgagtgcatccccagcctgctgctgtgcgacggcgtgcccgactgccacttcaacgaggacgagctgatctgcagcaacaagagctgcagcaacggcgccctggtgtgcgccagcagcaacagctgcatccccgcccaccagagatgcgacggcttcgccgactgcatggacttccagctggacgagagcagctgcagcgacacctggaccctgctgggcatcggcctggccttcctgatgacccacatcaccgtggccgtgctgtgcttcctggccaacagaaaggtgcccatcagaaagaccgagggcagcggcaactgcgccttcgtgaaccccgtgtacggcaactggagcaaccccgagaagaccgagagcagcgtgtacagcttcagcaaccccctgtacggcaccaccagcggcagcctggagaccctgagccaccacctgaagtag

SEQ ID NO: 17097 - DNA, 1053 bp, Artificial Sequence
  Description of Artificial Sequence: Synthetic coding sequence
atgtgcaccgtgagattctggttctacatgatcgaccccagaagcatgggcatcctgaaggtgtacaccatcgaggagagcggcctgaacatcctggtgtggagcgtgatcggcaacaagagaaccggctggacctacggcagcgtgcccctgagcagcaacagccccttcaaggtggccttcgaggccgacctggacggcaacgaggacatcttcatcgccctggacgacatcagcttcacccccgagtgcgtgaccggcggccccgtgcccgtgcagcccagcccctgcgaggccgaccagttcagctgcatctacaccctgcagtgcgtgcccctgagcggcaagtgcgacggccacgaggactgcatcgacggcagcgacgagatggactgccccctgagccccaccccccccctgtgcagcaacatggagttcccctgcagcaccgacgagtgcatccccagcctgctgctgtgcgacggcgtgcccgactgccacttcaacgaggacgagctgatctgcagcaacaagagctgcagcaacggcgccctggtgtgcgccagcagcaacagctgcatccccgcccaccagagatgcgacggcttcgccgactgcatggacttccagctggacgagagcagctgcagcgagtgccccctgaactactgcagaaacggcggcacctgcgtggtggagaagaacggccccatgtgcagatgcagacagggctggaagggcaacagatgccacatcaagttcaacccccccgccaccgacttcacctacgcccagaacaacacctggaccctgctgggcatcggcctggccttcctgatgacccacatcaccgtggccgtgctgtgcttcctggccaacagaaaggtgcccatcagaaagaccgagggcagcggcaactgcgccttcgtgaaccccgtgtacggcaactggagcaaccccgagaagaccgagagcagcgtgtacagcttcagcaaccccctgtacggcaccaccagcggcagcctggagaccctgagccaccacctgaagtag

SEQ ID NO: 17098 - DNA, 318 bp, Artificial Sequence
  Description of Artificial Sequence: Synthetic coding sequence
atgaacctgggcgtgagcatgctgagaatcctgttcctgctggacgtgggcggcgcccaggtgctggccaccggcaagacccccggcgccgagatcgacttcaagtacgccctgatcggcaccgccgtgggcgtggccatcagcgccggcttcctggccctgaagatctgcatgatcagaagacacctgttcgacgacgacagcagcgacctgaagagcacccccggcggcctgagcgacaccatccccctgaagaagagagcccccagaagaaaccacaacttcagcaagagagacgcccaggtgatcgagctgtag

SEQ ID NO: 17099 - DNA, 1443 bp, Artificial Sequence
  Description of Artificial Sequence: Synthetic coding sequence
atgctgggcagattccagcccttcagcctggtgagaagcttcagactgggcttcgaggcctgctgctaccccaaccagaagtgcgccacccagaccatcagaccccccgacagcagatgcctggtgcaggccgtgagccagaacttcaacttcgccaaggacgtgctggaccagtggagccagctggagaaggacggcctgagaggcccctaccccgccctgtggaaggtgagcgccaagggcgaggaggacaagtggagcttcgagagaatgacccagctgagcaagaaggccgccagcatcctgagcgacacctgcgccctgagccacggcgacagactgatgatcatcctgccccccacccccgaggcctactggatctgcctggcctgcgtgagactgggcatcaccttcgtgcccggcagcccccagctgaccgccaagaagatcagataccagctgagaatgagcaaggcccagtgcatcgtggccaacgaggccatggcccccgtggtgaacagcgccgtgagcgactgccccaccctgaagaccaagctgctggtgagcgacaagagctacgacggctggctggacttcaagaagctgatccaggtggccccccccaagcagacctacatgagaaccaagagccaggaccccatggccatcttcttcaccaagggcaccaccggcgcccccaagatggtggagtacagccagtacggcctgggcatgggcttcagccaggccagcagaagatggatggacctgcagcccaccgacgtgctgtggagcctgggcgacgccttcggcggcagcctgagcctgagcgccgtgctgggcacctggttccagggcgcctgcgtgttcctgtgccacatgcccaccttctgccccgagaccgtgctgaacgtgctgagcagattccccatcaccaccctgagcgccaaccccgagatgtaccaggagctgctgcagcacaagtgcttcaccagctacagattcaagagcctgaagcagtgcgtggccgccggcggccccatcagccccggcgtgatcgaggactggaagagaatcaccaagctggacatctacgagggctacggccagaccgagaccggcctgctgtgcgccaccagcaagaccatcaagctgaagcccagcagcctgggcaagcccctgcccccctacatcgtgcagatcgtggacgagaacagcaacctgctgccccccggcgaggagggcaacatcgccatcagaatcaagctgaaccagcccgccagcctgtactgcccccacatggtgagctgggaggagtacgccagcgccagaggccacatgctgtacctgaccggcgacagaggcatcatggacgaggacggctacttctggtggagcggcagagtggacgacgtggccaacgccctgggccagagactgtag

SEQ ID NO: 17100 - DNA, 1443 bp, Artificial Sequence; identical to SEQ ID NO: 17099
  Description of Artificial Sequence: Synthetic coding sequence

SEQ ID NO: 17101 - DNA, 561 bp, Artificial Sequence
  Description of Artificial Sequence: Synthetic coding sequence
atgagcaaggcccagtgcatcgtggccaacgaggccatggcccccgtggtgaacagcgccgtgagcgactgccccaccctgaagaccaagctgctggtgagcgacaagagctacgacggctggctggacttcaagaagctgatccaggtggccccccccaagcagacctacatgagaaccaagagccaggaccccatggccatcttcttcaccaagggcaccaccggcgcccccaagatggtggagtacagccagtacggcctgggcatgggcttcagccaggccagcagaagatggatggacctgcagcccaccgacgtgctgtggagcctgggcgacgccttcggcggcagcctgagcctgagcgccgtgctgggcacctggttccagggcgcctgcgtgttcctgtgccacatgcccaccttctgccccgagaccgtgctgaacgtgctgagcagattccccatcaccaccctgagcgccaaccccgagatgtaccaggagctgctgcagcacaagtgcttcaccagagtgtacagcgtgcccctgcccaagcagtag

SEQ ID NO: 17102 - DNA, 1521 bp, Artificial Sequence
  Description of Artificial Sequence: Synthetic coding sequence
atgctgggcagattccagcccttcagcctggtgagaagcttcagactgggcttcgaggcctgctgctaccccaaccagaagtgcgccacccagaccatcagaccccccgacagcagatgcctggtgcaggccgtgagccagaacttcaacttcgccaaggacgtgctggaccagtggagccagctggagaaggacaacggcctgcagctgcacccctgctgctgcaagagacaggacttcatcctgttccacggctgcctgttctacatcgacggcctgagaggcccctaccccgccctgtggaaggtgagcgccaagggcgaggaggacaagtggagcttcgagagaatgacccagctgagcaagaaggccgccagcatcctgagcgacacctgcgccctgagccacggcgacagactgatgatcatcctgccccccacccccgaggcctactggatctgcctggcctgcgtgagactgggcatcaccttcgtgcccggcagcccccagctgaccgccaagaagatcagataccagctgagaatgagcaaggcccagtgcatcgtggccaacgaggccatggcccccgtggtgaacagcgccgtgagcgactgccccaccctgaagaccaagctgctggtgagcgacaagagctacgacggctggctggacttcaagaagctgatccaggtggccccccccaagcagacctacatgagaaccaagagccaggaccccatggccatcttcttcaccaagggcaccaccggcgcccccaagatggtggagtacagccagtacggcctgggcatgggcttcagccaggccagcagaagatggatggacctgcagcccaccgacgtgctgtggagcctgggcgacgccttcggcggcagcctgagcctgagcgccgtgctgggcacctggttccagggcgcctgcgtgttcctgtgccacatgcccaccttctgccccgagaccgtgctgaacgtgctgagcagattccccatcaccaccctgagcgccaaccccgagatgtaccaggagctgctgcagcacaagtgcttcaccagctacagattcaagagcctgaagcagtgcgtggccgccggcggccccatcagccccggcgtgatcgaggactggaagagaatcaccaagctggacatctacgagggctacggccagaccgagaccggcctgctgtgcgccaccagcaagaccatcaagctgaagcccagcagcctgggcaagcccctgcccccctacatcgtgcagatcgtggacgagaacagcaacctgctgccccccggcgaggagggcaacatcgccatcagaatcaagctgaaccagcccgccagcctgtactgcccccacatggtgagctgggaggagtacgccagcgccagaggccacatgctgtacctgaccggcgacagaggcatcatggacgaggacggctacttctggtggagcggcagagtggacgacgtggccaacgccctgggccagagactgtag

SEQ ID NO: 17103 - DNA, 366 bp, Artificial Sequence
  Description of Artificial Sequence: Synthetic coding sequence
atggtgagaatcctggccaacggcgagatcgtgcaggacgacgaccccagagtgagaaccaccacccagccccccagaggcagcatccccagacagagcttcttcaacagaggccacggcgccccccccggcggccccggccccagacagcagcaggccggcgccagactgggcgccgcccagagccccttcaacgacctgaacagacagctggtgaacatgggcttcccccagtggcacctgggcaaccacgccgtggagcccgtgaccagcatcctgctgctgttcctgctgatgatgctgggcgtgagaggcctgctgctggtgggcctggtgtacctggtgagccacctgagccagagatag

SEQ ID NO: 17104 - DNA, 312 bp, Artificial Sequence
  Description of Artificial Sequence: Synthetic coding sequence
atgagccccgtgctgagcggcatccacagcatctacagcgcctgggtgaccagcgtgaacatcaccgactgcaagccccccagcatcagcggcgccgcccaccagggccccaccgcccccggcagaatggtgagaatcctggccaacggcgagatcgtgcaggacgacgaccccagagtgagaaccaccacccagccccccagaggcagcatccccagacagagcttcttcaacagaggccacggcgccccccccggcggccccggccccagacagcagcaggccggcgccagactgggcgccgcccagtag

SEQ ID NO: 17105 - DNA, 924 bp, Artificial Sequence
  Description of Artificial Sequence: Synthetic coding sequence
gccagccccagaagacccagacccgccagaagccccgcccccgaggtgcccctgagagtgagaagaagacacggcagaccccacggccccggcggcagacagctggccctgggcatccccgccctgagaagcctgcccggctgcgtgcccagactgctgggccccgtggacaagggccacgacgtgaccttctacaagacctggtacagaagcagcagaggcgaggtgcagacctgcagcgagagaagacccatcagaaacctgaccttccaggacctgcacctgcaccacggcggccaccaggccgccaacaccagccacgacctggcccagagacacggcctggagagcgccagcgaccaccacggcaacttcagcatcaccatgagaaacctgaccctgctggacagcggcctgtactgctgcctggtggtggagatcagacaccaccacagcgagcacagagtgcacggcgccatggagctgcaggtgcagaccggcaaggacgcccccagcaactgcgtggtgtaccccagcagcagccaggacagcgagaacatcaccgccgccgccctggccaccggcgcctgcatcgtgggcatcctgtgcctgcccctgatcctgctgctggtgtacaagcagagacaggccgccagcaacagactggcccaggagctgctggcccaggacagcaacatccagggcatcgagaaccccggcttcgaggccagcccccccgcccagggcatccccgaggccaaggtgagacaccccctgagctacgtggcccagagacagcccagcgagagcggcagacacctgctgagcgagcccagcacccccctgagcccccccggccccggcgacgtgttcttccccagcctggaccccgtgcccgacagccccaacttcgaggtgatctag

SEQ ID NO: 17106 - DNA, 936 bp, Artificial Sequence
  Description of Artificial Sequence: Synthetic coding sequence
atgggcgtgcccaccgccctggaggccggcagctggagatggggcagcctgctgttcgccctgttcctggccgccagcctgggccccgtggccgccttcaaggtggccaccccctacagcctgtacgtgtgccccgagggccagaacgtgaccctgacctgcagactgctgggccccgtggacaagggccacgacgtgaccttctacaagacctggtacagaagcagcagaggcgaggtgcagacctgcagcgagagaagacccatcagaaacctgaccttccaggacctgcacctgcaccacggcggccaccaggccgccaacaccagccacgacctggcccagagacacggcctggagagcgccagcgaccaccacggcaacttcagcatcaccatgagaaacctgaccctgctggacagcggcctgtactgctgcctggtggtggagatcagacaccaccacagcgagcacagagtgcacggcgccatggagctgcaggtgcagaccggcaaggacgcccccagcaactgcgtggtgtaccccagcagcagccaggacagcgagaacatcaccgccgccgccctggccaccggcgcctgcatcgtgggcatcctgtgcctgcccctgatcctgctgctggtgtacaagcagagacaggccgccagcaacagaagagcccaggagctggtgagaatggacagcaacatccagggcatcgagaaccccggcttcgaggccagcccccccgcccagggcatccccgaggccaaggtgagacaccccctgagctacgtggcccagagacagcccagcgagagcggcagacacctgctgagcgagcccagcacccccctgagcccccccggccccggcgacgtgttcttccccagcctggaccccgtgcccgacagccccaacttcgaggtgatctag

SEQ ID NO: 17107 - DNA, 435 bp, Artificial Sequence
  Description of Artificial Sequence: Synthetic coding sequence
tgaaccgccggcgagctgcccgccaacagcgtgagcggcttcttcaagagaatggtgaagagcgaggccagcaacgccgccaccgcctacttcagacccgccagacccctgcccagcctggtgaccgtgctgggcctgggctacttcgcctgggtggtgttctggccccagagcatcccctaccagaacctgggccccctgggccccttcacccagtacctggtggaccaccaccacaccctgctgtgcaacggctactggctggcctggctgatccacgtgggcgagagcctgtacgccatcgtgctgtgcaagcacaagggcatcaccagcggcagagcccagctgctgtggttcctgcagaccttcttcttcggcatcgccagcctgaccatcctgatcgcctacaagagaaagagacagaagcagacctag

SEQ ID NO: 17108 - DNA, 312 bp, Artificial Sequence
  Description of Artificial Sequence: Synthetic coding sequence
atggccaccgccgccggcgccacctacttccagagaggcagcctgttctggttcaccgtgatcaccctgagcttcggctactacacctgggtggtgttctggccccagagcatcccctaccagaacctgggccccctgggccccttcacccagtacctggtggaccaccaccacaccctgctgtgcaacggctactggctggcctggctgatccacgtgggcgagagcctgtacgccatcgtgctgtgcaagcagaacgagctgagaatcagaatcaagatgagaaagctgatcctgagagacagcgagtag

SEQ ID NO: 17109 - DNA, 255 bp, Artificial Sequence
  Description of Artificial Sequence: Synthetic coding sequence
atggccaccgccgccggcgccacctacttccagagaggcagcctgttctggttcaccgtgatcaccctgagcttcggctactacacctgggtggtgttctggccccagagcatcccctaccagaacctgggccccctgggccccttcacccagtacctggtggaccaccaccacaccctgctgtgcaacggctactggctggcctggctgatccacgtgggcgagagcctgtacgccatcgtgctgtgcaagtag

SEQ ID NO: 17110 - DNA, 312 bp, Artificial Sequence; identical to SEQ ID NO: 17108
  Description of Artificial Sequence: Synthetic coding sequence

SEQ ID NO: 17111 - DNA, 372 bp, Artificial Sequence
  Description of Artificial Sequence: Synthetic coding sequence
atggccaccgccgccggcgccacctacttccagagaggcagcctgttctggttcaccgtgatcaccctgagcttcggctactacacctgggtggtgttctggccccagagcatcccctaccagaacctgggccccctgggccccttcacccagtacctggtggaccaccaccacaccctgctgtgcaacggctactggctggcctggctgatccacgtgggcgagagcctgtacgccatcgtgctgtgcaagcacaagggcatcaccagcggcagagcccagctgctgtggttcctgcagaccttcttcttcggcatcgccagcctgaccatcctgatcgcctacaagagaaagagacagaagcagacctag

SEQ ID NO: 17112 - DNA, 306 bp, Artificial Sequence
  Description of Artificial Sequence: Synthetic coding sequence
tgagagttcctgagaagcgtgtgggtggtgttctggccccagagcatcccctaccagaacctgggccccctgggccccttcacccagtacctggtggaccaccaccacaccctgctgtgcaacggctactggctggcctggctgatccacgtgggcgagagcctgtacgccatcgtgctgtgcaagcacaagggcatcaccagcggcagagcccagctgctgtggttcctgcagaccttcttcttcggcatcgccagcctgaccatcctgatcgcctacaagagaaagagacagaagcagacctag

SEQ ID NO: 17113 - DNA, 285 bp, Artificial Sequence
  Description of Artificial Sequence: Synthetic coding sequence
agcgtggagctgcccctggacgccgacgtgcagaccagcaacctgctgatcaccttcctgaagtacagcagcatcgtgatgcaggacaccaaggacgagcacagactgcacagcggcaagctgtgcctgatcatcctgacctgcatcgccgagcccatgagacacagaaagaaggccgccgacaagaacctgccctgcagacccctggtgtgcgccgtgctggacctgatggtggagttcatcgtgacccacatgatgaaggagttccccatggacctgtactag

SEQ ID NO: 17114 - DNA, 597 bp, Artificial Sequence
  Description of Artificial Sequence: Synthetic coding sequence
atggcccaggtggagaagagaggcggcctgctgagaaagagcagcgccagcaagaagcccctgaaggagaaggtggtgctgatgtacgacgagatcttcatgaccgaggaccccagcaagtgcagccccagattctgggaggagctgttcctgatgaaggtgaacctggagtacctggagggcaagctggagagcctggacggcgaggagctgatgaagatcaaggacaacatcaactgcctgttccagcactgcatccaggccctgggcgaggagcaccccatcagagtggtgaacgccctgcagaccctgtgcgccctgatcagaggcgtgcaccagaagaacaagagcaccagcggcttcgacatcatcaacatgctgatgggcttcgacaaggccgagctgtgcatgaaggtgagacacaagctgcagatgtgcctgtggatggccgccagcgacagctgcagctggaccctgagcgccgacaagtgcacccagagattcggcctgagaaagatccagatgatcgagttcggcctggccttcagatgcttctacttcaccgacctgctgtacctgaacaagggcaagttctag

SEQ ID NO: 17115 - DNA, 2070 bp, Artificial Sequence
  Description of Artificial Sequence: Synthetic coding sequence
atggcccaggtggagaagagaggcggcctgctgagaaagagcagcgccagcaagaagcccctgaaggagaaggtggtgctgatgtacgacgagatcttcatgaccgaggaccccagcaagtgcagccccagattctgggaggagctgttcctgatgaaggtgaacctggagtacctggagggcaagctggagagcctggacggcgaggagctgatgaagatcaaggacaacatcaactgcctgttccagcactgcatccaggccctgggcgaggagcaccccatcagagtggtgaacgccctgcagaccctgtgcgccctgatcagaggcgtgcaccagaagaacaagagcaccagcggcttcgacatcatcaacatgctgatgggcttcgacaaggccgagctgtgcatgaagaacctgatggagagcctggacagcctgctgtgcgccgagggcagcgagagcctgaagagcctgtgcctgaagctgctgctgtgcctggtgaccgtgaccgacaacatcagccagaacaccatcctggagtacgtgatgatcaacagcatcttcgaggccatcctgcagatcctgagccacccccccagcagaagagagcacggctacgacgccgtggtgctgctggccctgctggtgaactacagaaagtacgagagcgtgaacccctacatcgtgaagctgagcatcgtggacgacgaggccaccctgaacggcatgggcctggtgatcgcccaggccctgagcgagtacaacagacagtacaaggacaaggaggaggagcaccagagcggcttcttcagcgccctgaccaacatggtgggcagcatgttcatcgccgacgcccacgagaagatcagcgtgcagaccaacgaggccatcctgctggccctgtacgaggccgtgcacctgaacagaaacttcatcaccgtgctggcccagagccaccccgagatgggcctggtgaccacccccgtgagccccgcccccaccacccccgtgacccccctgggcaccaccccccccagcagcgacgtgatcagcagcgtggagctgcccctggacgccgacgtgcagaccagcaacctgctgatcaccttcctgaagtacagcagcatcgtgatgcaggacaccaaggacgagcacagactgcacagcggcaagctgtgcctgatcatcctgacctgcatcgccgaggaccagtacgccaacgccttcctgcacgacgacaacatgaacttcagagtgaacctgcacagaatgcccatgagacacagaaagaaggccgccgacaagaacctgccctgcagacccctggtgtgcgccgtgctggacctgatggtggagttcatcgtgacccacatgatgaaggagttccccatggacctgtacatcagatgcatccaggtggtgcacaagctgctgtgctaccagaagaagtgcagagtgagactgcactacacctggagagagctgtggagcgccctgatcaacctgctgaagttcctgatgagcaacgagaccgtgctgctggccaagcacaacatcttcaccctggccctgatgatcgtgaacctgttcaacatgttcatcacctacggcgacaccttcctgcccacccccagcagctacgacgagctgtactacgagatcatcagaatgcaccagagcttcgacaacctgtacagcatggtgctgagactgagcaccaacgccggccagtggaaggaggccgccagcaaggtgacccacgccctggtgaacatcagagccatcatcaaccacttcaaccccaagatcgagagctacgccgccgtgaaccacatcagccagctgagcgaggagcaggtgctggaggtggtgagagccaactacgacaccctgaccctgaagctgcaggacggcctggaccagtacgagagatacagcgagcagcacaaggaggccgccttcttcaaggagctggtgagaagcatcagcaccaacgtgagaagaaacctggccttccacaccctgagccaggaggtgctgctgaaggagttcagcaccatcagctag

SEQ ID NO: 17116 - DNA, 285 bp, Artificial Sequence; identical to SEQ ID NO: 17113
  Description of Artificial Sequence: Synthetic coding sequence

SEQ ID NO: 17117 - DNA, 240 bp, Artificial Sequence
  Description of Artificial Sequence: Synthetic coding sequence
atggagctggaggccatgagcagatacaccagccccgtgaaccccgccgtgttcccccacctgaccgtggtgctgctggccatcggcatgttcttcaccgcctggttcttcgtgtacgaggtgaccagcaccaagtacaccagagacatctacaaggagctgctgatcagcctggtggccagcctgttcatgggcttcggcgtgctgttcctgctgctgtgggtgggcatctacgtgtag

SEQ ID NO: 17118 - DNA, 240 bp, Artificial Sequence; identical to SEQ ID NO: 17117
  Description of Artificial Sequence: Synthetic coding sequence

SEQ ID NO: 17119 - DNA, 2349 bp, Artificial Sequence
  Description of Artificial Sequence: Synthetic coding sequence
atggccgccgccgccgccgccggccccagccccggcagcggccccggcgacagccccgagggccccgagggcgaggcccccgagagaagaagaaaggcccacggcatgctgaagctgtactacggcctgagcgagggcgaggccgccggcagacccgccggccccgaccccctggaccccaccgacctgaacggcgcccacttcgaccccgaggtgtacctggacaagctgagaagagagtgccccctggcccagctgatggacagcgagaccgacatggtgagacagatcagagccctggacagcgacatgcagaccctggtgtacgagaactacaacaagttcatcagcgccaccgacaccatcagaaagatgaagaacgacttcagaaagatggaggacgagatggacagactggccaccaacatggccgtgatcaccgacttcagcgccagaatcagcgccaccctgcaggacagacacgagagaatcaccaagctggccggcgtgcacgccctgctgagaaagctgcagttcctgttcgagctgcccagcagactgaccaagtgcgtggagctgggcgcctacggccaggccgtgagataccagggcagagcccaggccgtgctgcagcagtaccagcacctgcccagcttcagagccatccaggacgactgccaggtgatcaccgccagactggcccagcagctgagacagagattcagagagggcggcagcggcgcccccgagcaggccgagtgcgtggagctgctgctggccctgggcgagcccgccgaggagctgtgcgaggagttcctggcccacgccagaggcagactggagaaggagctgagaaacctggaggccgagctgggccccagcccccccgcccccgacgtgctggagttcaccgaccacggcggcagcggcttcgtgggcggcctgtgccaggtggccgccgcctaccaggagctgttcgccgcccagggccccgccggcgccgagaagctggccgccttcgccagacagctgggcagcagatacttcgccctggtggagagaagactggcccaggagcagggcggcggcgacaacagcctgctggtgagagccctggacagattccacagaagactgagagcccccggcgccctgctggccgccgccggcctggccgacgccgccaccgagatcgtggagagagtggccagagagagactgggccaccacctgcagggcctgagagccgccttcctgggctgcctgaccgacgtgagacaggccctggccgcccccagagtggccggcaaggagggccccggcctggccgagctgctggccaacgtggccagcagcatcctgagccacatcaaggccagcctggccgccgtgcacctgttcaccgccaaggaggtgagcttcagcaacaagccctacttcagaggcgagttctgcagccagggcgtgagagagggcctgatcgtgggcttcgtgcacagcatgtgccagaccgcccagagcttctgcgacagccccggcgagaagggcggcgccaccccccccgccctgctgctgctgctgagcagactgtgcctggactacgagaccgccaccatcagctacatcctgaccctgaccgacgagcagttcctggtgcaggaccagttccccgtgacccccgtgagcaccctgtgcgccgaggccagagagaccgccagaagactgctgacccactacgtgaaggtgcagggcctggtgatcagccagatgctgagaaagagcgtggagaccagagactggctgagcaccctggagcccagaaacgtgagagccgtgatgaagagagtggtggaggacaccaccgccatcgacgtgcaggtgggcctgctgtacgaggagggcgtgagaaaggcccagagcagcgacagcagcaagagaaccttcagcgtgtacagcagcagcagacagcagggcagatacgcccccagctacacccccagcgcccccatggacaccaacctgctgagcaacatccagaagctgttcagcgagagaatcgacgtgttcagccccgtggagttcaacaaggtgagcgtgctgaccggcatcatcaagatcagcctgaagaccctgctggagtgcgtgagactgagaaccttcggcagattcggcctgcagcaggtgcaggtggactgccacttcctgcagctgtacctgtggagattcgtggccgacgaggagctggtgcacctgctgctggacgaggtggtggccagcgccgccctgagatgccccgaccccgtgcccatggagcccagcgtggtggaggtgatctgcgagagaggctag

SEQ ID NO: 17120 - DNA, 594 bp, Artificial Sequence
  Description of Artificial Sequence: Synthetic coding sequence
atgagcgccagagcccccaaggagctgagactggccctgcccccctgcctgctgaacagaaccttcgccagccccaacgccagcggcagcggcaacaccggcgccagaggccccggcgccgtgggcagcggcacctgcatcacccaggtgggccagcagctgttccagagcttcagcagcaccctggtgctgatcgtgctggtgaccctgatcttctgcctgatcgtgctgagcctgagcaccttccacatccacaagagaagaatgaagaagagaaagatgcagagagcccaggaggagtacgagagagaccactgcagcggcagcagaggcggcggcggcctgcccagacccggcagacaggcccccacccacgccaaggagaccagactggagagacagcccagagacagccccttctgcgcccccagcaacgccagcagcctgagcagcagcagccccggcctgccctgccagggcccctgcgccccccccccccccccccccgccagcagcccccagggcgcccacgccgccagcagctgcctggacaccgccggcgagggcctgctgcagaccgtggtgctgagctag

SEQ ID NO: 17121 - DNA, 1131 bp, Artificial Sequence
  Description of Artificial Sequence: Synthetic coding sequence
atgggccaccagttcctgagaggcctgctgaccctgctgctgccccccccccccctgtacaccagacacagaatgctgggccccgagagcgtgcccccccccaagagaagcagaagcaagctgatggccccccccagaatcggcacccacaacggcaccttccactgcgacgaggccctggcctgcgccctgctgagactgctgcccgagtacagagacgccgagatcgtgagaaccagagaccccgagaagctggccagctgcgacatcgtggtggacgtgggcggcgagtacgaccccagaagacacagatacgaccaccaccagagaagcttcaccgagaccatgagcagcctgagccccggcaagccctggcagaccaagctgagcagcgccggcctgatctacctgcacttcggccacaagctgctggcccagctgctgggcaccagcgaggaggacagcatggtgggcaccctgtacgacaagatgtacgagaacttcgtggaggaggtggacgccgtggacaacggcatcagccagtgggccgagggcgagcccagatacgccctgaccaccaccctgagcgccagagtggccagactgaaccccacctggaaccaccccgaccaggacaccgaggccggcttcaagagagccatggacctggtgcaggaggagttcctgcagagactggacttctaccagcacagctggctgcccgccagagccctggtggaggaggccctggcccagagattccaggtggaccccagcggcgagatcgtggagctggccaagggcgcctgcccctggaaggagcacctgtaccacctggagagcggcctgagcccccccgtggccatcttcttcgtgatctacaccgaccaggccggccagtggagaatccagtgcgtgcccaaggagccccacagcttccagagcagactgcccctgcccgagccctggagaggcctgagagacgaggccctggaccaggtgagcggcatccccggctgcatcttcgtgcacgccagcggcttcaccggcggccaccacaccagagagggcgccctgagcatggccagagccaccctggcccagagaagctacctgccccagatcagctag

SEQ ID NO: 17122 - DNA, 978 bp, Artificial Sequence
  Description of Artificial Sequence: Synthetic coding sequence
atgggccaccagttcctgagaggcctgctgaccctgctgctgccccccccccccctgtacaccagacacagaatgctgggccccgagagcgtgcccccccccaagagaagcagaagcaagctgatggccccccccagaatcggcacccacaacggcaccttccactgcgacgaggccctggcctgcgccctgctgagactgctgcccgagtacagagacgccgagatcgtgagaaccagagaccccgagaagctggccagctgcgacatcgtggtggacgtgggcggcgagtacgaccccagaagacacagatacgaccaccaccagagaagcttcaccgagaccatgagcagcctgagccccggcaagccctggcagaccaagctgagcagcgccggcctgatctacctgcacttcggccacaagctgctggcccagctgctgggcaccagcgaggaggacagcatggtgggcaccctgtacgacaaggccggcttcaagagagccatggacctggtgcaggaggagttcctgcagagactggacttctaccagcacagctggctgcccgccagagccctggtggaggaggccctggcccagagattccaggtggaccccagcggcgagatcgtggagctggccaagggcgcctgcccctggaaggagcacctgtaccacctggagagcggcctgagcccccccgtggccatcttcttcgtgatctacaccgaccaggccggccagtggagaatccagtgcgtgcccaaggagccccacagcttccagagcagactgcccctgcccgagccctggagaggcctgagagacgaggccctggaccaggtgagcggcatccccggctgcatcttcgtgcacgccagcggcttcaccggcggccaccacaccagagagggcgccctgagcatggccagagccaccctggcccagagaagctacctgccccagatcagctag

SEQ ID NO: 17123 - DNA, 351 bp, Artificial Sequence
  Description of Artificial Sequence: Synthetic coding sequence
atgaaccagaccgacaagaaccagcaggagatccccagctacctgaacgacgagccccccgagggcagcatgaaggaccacccccagcagcagcccggcatgctgagcagagtgaccggcggcatcttcagcgtgaccaagggcgccgtgggcgccaccatcggcggcgtggcctggatcggcggcaagagcctggaggtgaccaagaccgccgtgaccaccgtgcccagcatgggcatcggcctggtgaagggcggcgtgagcgccgtggccggcggcgtgaccgccgtgggcagcgccgtggtgaacaaggtgcccctgaccggcaagaagaaggacaagagcgactag

SEQ ID NO: 17124 - DNA, 351 bp, Artificial Sequence; identical to SEQ ID NO: 17123
  Description of Artificial Sequence: Synthetic coding sequence

SEQ ID NO: 17125 - DNA, 351 bp, Artificial Sequence; identical to SEQ ID NO: 17123
  Description of Artificial Sequence: Synthetic coding sequence

SEQ ID NO: 17126 - DNA, 351 bp, Artificial Sequence; identical to SEQ ID NO: 17123
  Description of Artificial Sequence: Synthetic coding sequence

SEQ ID NO: 17127 - DNA, 351 bp, Artificial Sequence; identical to SEQ ID NO: 17123
  Description of Artificial Sequence: Synthetic coding sequence

SEQ ID NO: 17128 - DNA, 351 bp, Artificial Sequence; identical to SEQ ID NO: 17123
  Description of Artificial Sequence: Synthetic coding sequence

SEQ ID NO: 17129 - DNA, 12741 bp, Artificial Sequence
  Description of Artificial Sequence: Synthetic coding sequence
atgggcctgctgctggtgttccccctgatccagagccagagcagaaccgaccccagcctgtgcaacatcaccgccgaggtgctgctgaactgcctgagagactgccagcccctgagcctgaccaaggagcccgccgactgcctgaacggcatcgagaccctgctgtgcagctggctggaggagaccagcgacaccggcagacacatcccccacaagcagaaggagaacgccgccgccgccctggtggccctggcctgcgccagaggcagcctgaagaccttcgtgcacaccgtgcacctgctgcagaagcagaccgacctgggcagcctgcccgtggccgacgtgctgtacagactgctgctgctggagggcggccccggcagccccagctgcctgctgggcggcaagcacatcgtgagctggggctacgaggacatgctgcccgcccccgacagcaacaccggcagcagcagcgagaacaaggacgccgacctgggcagatgcctgaccgccgacggcctgtacctgtacaccaccaacagcgtgggcagaggcgtgagcaagctgggcagcggcctgcacggcaccctgagaggcttcgtgtactgcagaaacgaggagctggagcccggctgggtggccttcggcagcggcagcctgctgcacagacccgtgagcttcgacaacaagccccacagcctgttccaggtgatcgaccagaacaccctgcaggtgtgccaggtggtgcccatgcccgccaaccacctgcccatcggcagcaccatgagcaccgtgcacctgagcagcgacggcacctacttctactggatctggagccccgccagcctgaacgagaagacccccaagggccacagcgtgttcatggacatcttcgagctggtggtggagaacggcgtgttcgtggccaaccccctgcaggagagaaccatcctgatgagaaaggagggcgagagcgccaagagcatcaacgagatgctgctgagcagactgagcagatacagagccagccccagcgccaccctggccgccctgaccggcagcaccatcagcaacaccctgaaggaggaccaggccgccaacaccagctgcggcctgcccctgaagatgctgagaaagacccccatctacacctgcggcacctacctggtgatgctggtgcccccccccggcggcagcggcagcagcgccaccagaagcctgttcggcggcaccagcggcctgagcagcctgaagagagcctgctacgacaccgtgaacaacatgctgtggacctgcagcaacgactacatcgaccagtggtgcaaccccggcaaccaggccttccactacgtgtgccagagactgggcgtgagccacatcatcaccgagcccaaggaggaggccatcaccaccaacgaggtgatcaaccagctgctgcaccacgtgggcgccatgtgcatccaccagctgaacctgctggccaccaaccccaacctgcccatcaccagcgtgctgggcaagcagcaccccatcgaggcccaccacctgagcagcatctgcgacatcatggagaaggccatggtgaacggcgacacctgcatcatcagatgcatcctggtggtgttccaggtggtgttcaagttcttcttcagcccccagaccgagagaaacagagacatcatcagaagaagcggcctgctgctgtggcagctgctgatggcccccaaggaccagatctgccccgagatccagaaggaggtgtgcctggccatcagcagcggcctgaacatcctgtaccccggcgagaccgagatcaacaacctgctgaagctggtgctgaccgagggcgagagaaacagcggcctgagccagctgagagacgtgatcctgaccaacctggccgagcagctgcagaacaacagattcggcagcgacgaggacgaccactacagactgaacgacgagctgctgcactacatcctgaagatcgtggtgagagagagctgcatcctgatcaccaagtgccagaccgtgagcaaggacgacttccagaagctgctgagcaccgtgcccgccgccagcagctgcctgagatacctgatggccgtgcagaaccacctgctgagcaacaccatcctgatcaagcccgacgagaacgacgacagcgacagcagcctgcagggcgagaccctgaaggtgcaggagctgaaggtgagcatcctggccctggccacccagatcctgaccggctgcgacgaggtgctggagatgctgcagcaggtgaccaccgccctgatcaacagcgacatcgccgacagagagcagagactgaagggcctggagcaggtgaccaaggccaccatgctgggccacctgctgcccgtgctgctgaccagcctgatgcaccccaacctgcagaccctgatcatggccgacgccctgatgccccagctggtgcagctggtgctgtacaccagccagaccgccctgctgctgaagacccagtgccccgtgttcgccgaggtgggctgcagcccctgcggcgcccccgaccagaagtgcagactgttccccgacgagagaatgctggaggagaaggaggagcccggcttcctgaccggcctgaagatccccgccccctgggccgccggcaagaccgtggagaccgtgcaccccgtgagagacaactacaagttcaaggagaccgtgcacatccccggcgccagatgcctgtacctgagattcgacagcagatgcagcagccagtacgactacgacaagctggtgatctacgccggccccaacaccaacagcagaaaggtggccgagtacggcggcaacaccctgggctacggcagcagaagcgtgctgggcaccggctggcccaaggacctggtgaagtgcatcagcccccccagcctgaacttcaaggtggagggcgacaccgtgaccttcagcttcgagatgagaagcggcagagagcacaacacccccgacaaggccatgtggggcttcgcctgcaccgtgagagcccaggagagcagcgaggacgtgagcggcggcctgcccttcctggtggacctggccctgggcctgagcgtgctggcctgcagcatgctgagaatcctgtacaacggccccgagatcaccaaggaggaggaggcctgccaggagctgctgagaagcaagctgctgcagagatgccagtggcaggtggaggccaacggcgtgatcagccccgccctgacccccagccccagccccctgcccctgaccatcgaggaggacagagagttcacctaccccagcgacgtgctggtgccccccgtgggcaactacttcgacctgcccagaatcagactgccccccggcatcatgatcaagctgagagagatcagcggcagagccagaccccagttcagacccagcatcaaggaggtgatccagcccgacgtgatggaggagatggtggtgagctgcgtgatcaagcacctgaacctggtggacgccctgcagagcctgatcaacttccagtaccaggaggagcacgccgaggagtacgacctgctgtgcaagatcatgggcgagaccttcaagaagctgaacgccatggagagacagctgcagagcgtggccgagctggagcagaagtggcagagcgaggtggacgacgccatgcagggcaagctggagaacaacatgcccttcttctacgactaccacttcaacgagaacaagatgaaggagctggagctgctgtgcagcatgaaggaggtgagcttcgacggcaacgacctggagaacatggtgctgagcctgagagagaagttcctgcaggaggtgaacagcctgatccagaagcccagccaccccctggccaagaccaagaccctggtgaagagcctgatgaacagagccgagctgctgctgcacgtgaccatcgccgcccagagcggcctgaccagaagcatcagcggcacccccgccgagacccccgcctgcaagagcgccagcgagaccaaggtgatcagccacgccgtgagacagcccgtgttcctgagaagcatgagcgcccccagcgacctggagatgatcggcaacgaggacctggagttcaccagagccaaccagagaagaagacacgtgaccagccacagaagcagcagcttcaccctgctgcagagcctggccatcgaggacagcagagacaagcccacctacagcgtgctgctgggccagctgttcgccttcatcggcaccaaccccgaccaggccgtgagcagcagcagcttcctgctggccgcccagaccagatggagaagaggcaacaccagaaagcaggccctggtgcacatgagagagctgctgaccgccgccgtgagagtgggcggcgtgacccacctggtgggccccgtgaccatggtgctgcagggcggccccagaatcgaggagctgacctgcggcggcatggtggagcaggtgcaggaggccttcggcgagaccatgaccagcgtggtgagcctgtgcgccagataccccatcgcctgcgccaacagcatcggcctgctgtgcaccatcccctacaccagaagcgaggagaagtgcctggtgagaagcggcctggtgcagctgatggacagactgtgcagcctgagcaaccagaccgagagcagcagcagcgagaagcagaccaagaagcagaaggtggccaccatggcctgggccgccttccaggtgctggccaacagatgcgtggagtgggagaaggaggagggcggcagcaccgaggccgtgcacagcggcctggccagacaggtgagcagcctgctgaccaaccacctggccagagccaccgagtgctgcggcaaccaggccgccggcaacgacgccctgcaggacgtgctgagcctgctgaacgacctgagcagaagccacatcggcaaggccatcctgagccagcccgcctgcgtgagcaagctgctgagcctgctgctggaccagagacccagccccaagctggtgctgatcatcctgcagctgtgcagagccgccctgcccctgatgagcgtggaggactgcggcaacgtggagctgcccccctggagctacagcgtgcccagcctgaacagcgagcaggaggaccccagcgaccccgccagcaagatcgccagcctgctgctggccaagctggccgactacgtggtgcccggctgccagaccgtgctgagccccaccgccagcgagcccgacaccaccctgaccaagaccagccccaagaacagcctgaagggcgacaaggaccccggcgaggagagcgaggccgtggacggcaagctgagcatcttcatccacaagagagaggaccagagcagccacgaggtgctgcagcccctgctgagcagcagcgagggcagacccttcagactgggcaccggcgccaacatggagaaggtggtgaagatggacagagacatgaccaagggcggctgctgcgaggtgatcaccgaggaggccgccgccgccctgagaaaggccaccaagtgggcccagagcggcctgatcgtgagcatcggcccccccgtggagagcatcaaccccgagaccgtgagcggcctgagcaccggcgacaagaagaagaccgcccagaccagcatctgcagagagagaaacagcgagctggccagaaccgaccccgtgagacccttcatcagcggccacgtggccaacagcatggccgccgaggtgatcgccctgctgcacagcctgctgatggcccccgagagcaacgccgcccagatctggaccaccaccgccgagaaggtgctgagcagagccctgatgtacatcccccagctgggcaagtacgccgagagcatcctggagaacggcagcagcagcggcagaaagctggccaagctgcagagaatcgccagacaggccgtggccgccctgtgcgccctgggcggcttcaaggagaccatcaagatcggcagcgaggtgcaggtgctgggcagaggcatcagcggcagcatcggcgtggtggccagcatcaacgagcaggagggcatcgccaccgtgagattcccccccatcgactgcagaaagaccagccaggccagcgacaccctgaccatccccctgagcagactgtgcgtgcccagaagcgaggccctgcccctgcacaagctgagcatcaccgagaaggtggtgcaggccgtgcagagcatgctgctgccccaggagggcagcctgagcatccacaccagcctgcccgccaccggcgacggcagcgcccccgtgatggccgtggtgagactgctggccgagatcagaaccagagcctgcctggtgatggcccagctgctggaggacagcctgttctgcgaggagttcatccagcagtgccccgccgccgtggaggtgctgaacctggtggcccaggagtgcagcgccggcgagagactggccgtggtggaggtgcagtgcgagagactgagaatgctgtacagagactgcgccagacccccccccccccccctgcaggccgacagaagacagcccaaggagatcacctggagccccagcagagtgttcccccccgtgagagcctgcatgttcagcagccacctgaccagcgtgaccttcctggccgaccccagcgccggcggcggcctgcccagaggcaccttcatctacgccaccagccccctgcccgtgcaggcccccagcttctactgggagatcgagatcgtgagctacggcgacaccgacgacgacaccggccccatcgtgagcttcggcttcaccaccgaggccgagaagagagacggcgcctggaccaaccccgtgggcacctgcctgttccacaacaacggcagagccgtgcactacaacggcagcagcctgctgcagtggaagagcgtgagactggacgtgaccctgagccccggcgacgtggccggcatcggctgggagagaaccgagggcaccccccccccccccggccagcccgccaagggcagagtgtacttcacctactgcggccagagactgagcccctacctggaggacgtgagcggcggcatgtggcccgtggtgcacatccagaagaagaacaccaagaccagagccaacttcggcagcagacccttcgcctacgccgagggccaggcccacagaaacgccgccgacctgtgcaccgacctggccgaggagatcagcgccaacttcgaggccctgcccttcgccatggccagcgacagcgacaacgacgccggcaccagcatcgccagcgaccccggcacccacggccccccctgcagaatcgccgccgtggccaccgcccagcagcagtacgacagcgacaccagctgccactacaaggtggagctgagctacgagaacttcatcaccagcggccccgacccccaccccccccccatcgccgacgacgagagcgacgacgacgacgacgacgacatcccccaggaggaccactacgccctgctggtgaaggcctgggagaccaaggtgttccccaccatcagaagaagattcagaaacgaggccgagagaaagagcggcctggaccagatcaagggcgccctgcagctgggcatggtggacatcgccagacagaccgtggagttcctgtacgaggagaacggcggcatccccagagacctgtacctgcccaccatcgaggacatcaaggacgaggccaacaagttcaccatcgacaaggtgagaaagggcctgaccgtggtgaccagaagccccgacagcaacaacgtggccagcagcgccgtgggcaccgccctgcccaagttcgccatcagaggcatgctgaagaccttcggcctgcacggcgtggtgctggacgtggacagcgtgaacgagctggtgcaggtggagacctacctgagaagcgagggcgtgctggtgagatactggtaccccatcgacatgctggagagaccccccgccggctacagaagaaccgccaccaacggcctggtgaccctggacaacaccaacctgcagatccacagagagctgctgagatgcgaggccgccctggccagactgtactgcagaatggccctgctgaacatcttcgcccccaagctgccccacctgttcaccagactgttccacatccccgccatcagagacatcaccctggagcacctgcagctgctgagcaaccagctgctggccccccccctgcccgacggcaccatcagcagcagcagcatcctgctggcccagagcctgcagcactgcatccacagccagaactgcagcgccaccgacctgttctaccagggcaacagccagaccgtgagagagtggctgaacgtggccatcaccagaaccctgcaccagggcgaggagagcctgctggagctgaccaagcagatctgcagcttcctgcagaccgcccccgagcagttccccagcgaggagttccccatcagcgagagcaaggtgaacatggacgtgaacttccccggcgccgccttcgtggtggtgagctgcaaggagagccagagcggcttcagaaaggacagcagcctgtacaaggccccctgggccagagtgctggtgtacggcctgggccacaaggtgaagagaaacggccagctgaacctgatcgaggccgcctgctaccccagagacgccagccccgccaacaccggcctggcccccccccccaccgccgaccagtaccccagcgtggtgctgagcaccgacagagtgcacatcaagctgggcgtgagccccccccccggcgccgtgctggtgctgcacagcctgcccctggagttccccctggccatggccttcgccgagcagctgctgagctggaagagcgaggacagcgagggcaagagcgaggacgagcccgacaccatccccaccagcgtgctgctgcaggtggtggagctgctgggcaacttcctgtggaccaccgacatggccgcctgcgtgaaggagctggtgttccacctgctggccgagctgctgagaaccgtgcacaccctggagcagagaagacaccccgccggcctgagcagcagcatcgccctgcagctgaacccctgcctggccatgctgatggccctgcagagcgagctgcacaagctgtacgacgaggagacccagaactgggtgagcggcggcgcctgcggcggcagcggcggcgccgccgccggcgaccagggcagattcagcacctacttccacgccctgatggagggctgcctggccgtggccgaggtgaccctgcccaccaacatgagcgtgaccgccagcggcgtgaccagcgccaccgcccccaacctgagcgacagcagcagcagcagcagcagcagccccggccagaccccccagagccccagcctgctgagcaagagaaagaaggtgaagatgaagagagagaaggccagcagcagcggcaagagacagagcagcagaaccgtggacagcgaccccaccgtgctgagcatcggcggcagcaagcccgaggacatgctgtggttccacagagccctgaccctgctgatcatcctgagacacctgaccagaaaggacccccagggcctgggcgtgaccagcgacgccatcgccgacgcctgccaggccctggtgggccccaccgcccacagcagactgctggtgatcagcggcatccccacccacctggacgagggcgtggtgagaggcgccatcagaaaggcctgcaacgcccacggcggcgtgttcaaggacgagatctacatccccctgcaggaggaggacaccaagaagcccaaggacaaggccgagggcggcgacggcaaggtggagcccgagaagaccctggccttccccggcaccgacagcatggaggtgagcaccagcagcagcctgacccccgccatgagcatcagcgccagcgccagcaccagccaggccagcatctgcagcagccagggcatcagccagaccgtgagcgacctgagcgtggaccccctgcccgccggcctggagctgcccatcccccccggcctgctggagccccacgccgtgagcagccaggagagcctggacatcagcctgtgcagcaccggcagcctgggcagcctgggcagcctgggcgagcccctggacaacgccgagaccgccagcgtgagcgacatgggcagcatgtacaccgtgaccagcctggacaaccagcccctggccgccagacccatcaagggcttcgccgtggtggagatcagaagcagagccaagatcgagaagatcagagccagcctgttcaacaacaacgacctgatcggcctgagcagcctggacggcgaggacgagctgatggagatgagcaccgaggagatcctgaccgtgagcgtggtgaaccagagcctgttcgacacccagggcagccccggcctggaggactacttcaacgacaagagcatcaagggcgagaagctggtgcccggcgccagagaggtgctgaccgagatcttcaagagctgcgcccacagcgagcagaccctgagcctgacccccgccaagcccatcagagtgagcgacatctacctgagcaaggagcagatcaacagccagacccccggcaacctgctgcacctgttcttcaccaacgtgagaccccccaagaaggtgctggaggaccagctgacccagatcctgagaaagtacggcgtgcccaagcccaagttcgacaagagcaagtacagcaaggccggcaaggagcagcaccccgtgaaggtggtgagcaccaagagacccatcaccaagccccccgccaaggacaaggccgtgctgaacagcgtgagcagaaccgccctgagcgagaagaagcccaccgtgaagcccaagagccccgagaagagcaagcccgacgagaaggaccccgagaagagccccaccaagaagcaggaggtgcccgaggagaagtacctgaccctggagggcttccacaagttcgtgatcgacagagccagacaggacatcagaagcgtgtggagagccatcctgagctgcggctacgacctgcacttcgagagatgcgcctgcatcgacgtgagacacgcccagaaggccagcagaaagtggaccctggagatggacgtggccctggtgcagtacatcaaccagctgtgcagacacctggccatcacccccgccagactgcacccccacgaggtgtacctggaccccgccgacgccgccgaccccagagtggcctgcctgctgaacgtgcccatcgagagcctgagactgagattcgccctgctgcagagcctgaacaccaccctggagaccttcttcctgcccctggtggagctgagacagacccccatgtacacccacagcatcgccgccctgctgaaggaggccaagggcctgatcttctacgacaccaaggtgaccgtgatgaacagagtgctgaacgccaccgtgcagagaaccgccgaccacgccgcccccgagatcaccctggaccccctggagatcgtgggcggcgagatcagagccagcgagaacagctacttctgccaggccgccagacagctggccagcgtgcccagcagccagctgtgcgtgaagctggccagcggcggcgaccccacctacgccttcaacatcagattcaccggcgaggaggtgcacggcaccagcggcagcttcagacacttcctgtggcaggtgtgcaaggagctgcagagcagcagcctgagcctgctgctgctgtgccccagcagcgccgtgaacaagaacaagggcaagtacatcctgacccccagccccatcacctacggcgaggagcagctgctgcacttcctgggccagctgctgggcatcgccatcagagccgacgtgcccctgcccctggacctgctgcccagcttctggaagaccctggtgggcgagcccctggaccccgagcaggacctgcaggaggccgacatcctgacctacaactacgtgaagaagttcgagagcatcaacgacgagaccgagctggaggccctgtgcgccgagatcgccagccagcacctggccaccgagagccccgacagccccaacaagccctgctgcagattcacctacctgaccatgaccggcgaggaggtggagctgtgcagcagaggcagacacatcctggtggcctgggagaacaaggacatctacgccgccgccatcagaagcctgagactgagagagctgcagaacgtggagtgcgtgaccgccgtgagagccggcctgggcagcatcatccccctgcagctgctgaccatgctgagccccctggagatggagctgagaacctgcggcctgccctacatcaacctggagttcctgaaggcccacaccatgtaccaggtgggcctgatggagaccgaccagcacatcgagttcttctggggcgccctggagatgttcacccaggaggagctgtgcaagttcatcaagttcgcctgcaaccaggagagaatccccttcacctgcccctgcaaggacggcggccccgacaccgcccacgtgcccccctaccccatgaagatcgccccccccgacggcaccgccggcagccccgacagcagatacatcagagtggagacctgcatgttcatgatcaagctgccccagtacagcagcctggagatcatgctggagaagctgagatgcgccatccactacagagaggaccccctgagcggctag

SEQ ID NO: 17130 - DNA, 11991 bp, Artificial Sequence
  Description of Artificial Sequence: Synthetic coding sequence
atgcccgccaaccacctgcccatcggcagcaccatgagcaccgtgcacctgagcagcgacggcacctacttctactggatctggagccccgccagcctgaacgagaagacccccaagggccacagcgtgttcatggacatcttcgagctggtggtggagaacggcgtgttcgtggccaaccccctgcaggagagaaccatcctgatgagaaaggagggcgagagcgccaagagcatcaacgagatgctgctgagcagactgagcagatacagagccagccccagcgccaccctggccgccctgaccggcagcaccatcagcaacaccctgaaggaggaccaggccgccaacaccagctgcggcctgcccctgaagatgctgagaaagacccccatctacacctgcggcacctacctggtgatgctggtgcccccccccggcggcagcggcagcagcgccaccagaagcctgttcggcggcaccagcggcctgagcagcctgaagagagcctgctacgacaccgtgaacaacatgctgtggacctgcagcaacgactacatcgaccagtggtgcaaccccggcaaccaggccttccactacgtgtgccagagactgggcgtgagccacatcatcaccgagcccaaggaggaggccatcaccaccaacgaggtgatcaaccagctgctgcaccacgtgggcgccatgtgcatccaccagctgaacctgctggccaccaaccccaacctgcccatcaccagcgtgctgggcaagcagcaccccatcgaggcccaccacctgagcagcatctgcgacatcatggagaaggccatggtgaacggcgacacctgcatcatcagatgcatcctggtggtgttccaggtggtgttcaagttcttcttcagcccccagaccgagagaaacagagacatcatcagaagaagcggcctgctgctgtggcagctgctgatggcccccaaggaccagatctgccccgagatccagaaggaggtgtgcctggccatcagcagcggcctgaacatcctgtaccccggcgagaccgagatcaacaacctgctgaagctggtgctgaccgagggcgagagaaacagcggcctgagccagctgagagacgtgatcctgaccaacctggccgagcagctgcagaacaacagattcggcagcgacgaggacgaccactacagactgaacgacgagctgctgcactacatcctgaagatcgtggtgagagagagctgcatcctgatcaccaagtgccagaccgtgagcaaggacgacttccagaagctgctgagcaccgtgcccgccgccagcagctgcctgagatacctgatggccgtgcagaaccacctgctgagcaacaccatcctgatcaagcccgacgagaacgacgacagcgacagcagcctgcagggcgagaccctgaaggtgcaggagctgaaggtgagcatcctggccctggccacccagatcctgaccggctgcgacgaggtgctggagatgctgcagcaggtgaccaccgccctgatcaacagcgacatcgccgacagagagcagagactgaagggcctggagcaggtgaccaaggccaccatgctgggccacctgctgcccgtgctgctgaccagcctgatgcaccccaacctgcagaccctgatcatggccgacgccctgatgccccagctggtgcagctggtgctgtacaccagccagaccgccctgctgctgaagacccagtgccccgtgttcgccgaggtgggctgcagcccctgcggcgcccccgaccagaagtgcagactgttccccgacgagagaatgctggaggagaaggaggagcccggcttcctgaccggcctgaagatccccgccccctgggccgccggcaagaccgtggagaccgtgcaccccgtgagagacaactacaagttcaaggagaccgtgcacatccccggcgccagatgcctgtacctgagattcgacagcagatgcagcagccagtacgactacgacaagctggtgatctacgccggccccaacaccaacagcagaaaggtggccgagtacggcggcaacaccctgggctacggcagcagaagcgtgctgggcaccggctggcccaaggacctggtgaagtgcatcagcccccccagcctgaacttcaaggtggagggcgacaccgtgaccttcagcttcgagatgagaagcggcagagagcacaacacccccgacaaggccatgtggggcttcgcctgcaccgtgagagcccaggagagcagcgaggacgtgagcggcggcctgcccttcctggtggacctggccctgggcctgagcgtgctggcctgcagcatgctgagaatcctgtacaacggccccgagatcaccaaggaggaggaggcctgccaggagctgctgagaagcaagctgctgcagagatgccagtggcaggtggaggccaacggcgtgatcagccccgccctgacccccagccccagccccctgcccctgaccatcgaggaggacagagagttcacctaccccagcgacgtgctggtgccccccgtgggcaactacttcgacctgcccagaatcagactgccccccggcatcatgatcaagctgagagagatcagcggcagagccagaccccagttcagacccagcatcaaggaggtgatccagcccgacgtgatggaggagatggtggtgagctgcgtgatcaagcacctgaacctggtggacgccctgcagagcctgatcaacttccagtaccaggaggagcacgccgaggagtacgacctgctgtgcaagatcatgggcgagaccttcaagaagctgaacgccatggagagacagctgcagagcgtggccgagctggagcagaagtggcagagcgaggtggacgacgccatgcagggcaagctggagaacaacatgcccttcttctacgactaccacttcaacgagaacaagatgaaggagctggagctgctgtgcagcatgaaggaggtgagcttcgacggcaacgacctggagaacatggtgctgagcctgagagagaagttcctgcaggaggtgaacagcctgatccagaagcccagccaccccctggccaagaccaagaccctggtgaagagcctgatgaacagagccgagctgctgctgcacgtgaccatcgccgcccagagcggcctgaccagaagcatcagcggcacccccgccgagacccccgcctgcaagagcgccagcgagaccaaggtgatcagccacgccgtgagacagcccgtgttcctgagaagcatgagcgcccccagcgacctggagatgatcggcaacgaggacctggagttcaccagagccaaccagagaagaagacacgtgaccagccacagaagcagcagcttcaccctgctgcagagcctggccatcgaggacagcagagacaagcccacctacagcgtgctgctgggccagctgttcgccttcatcggcaccaaccccgaccaggccgtgagcagcagcagcttcctgctggccgcccagaccagatggagaagaggcaacaccagaaagcaggccctggtgcacatgagagagctgctgaccgccgccgtgagagtgggcggcgtgacccacctggtgggccccgtgaccatggtgctgcagggcggccccagaatcgaggagctgacctgcggcggcatggtggagcaggtgcaggaggccttcggcgagaccatgaccagcgtggtgagcctgtgcgccagataccccatcgcctgcgccaacagcatcggcctgctgtgcaccatcccctacaccagaagcgaggagaagtgcctggtgagaagcggcctggtgcagctgatggacagactgtgcagcctgagcaaccagaccgagagcagcagcagcgagaagcagaccaagaagcagaaggtggccaccatggcctgggccgccttccaggtgctggccaacagatgcgtggagtgggagaaggaggagggcggcagcaccgaggccgtgcacagcggcctggccagacaggtgagcagcctgctgaccaaccacctggccagagccaccgagtgctgcggcaaccaggccgccggcaacgacgccctgcaggacgtgctgagcctgctgaacgacctgagcagaagccacatcggcaaggccatcctgagccagcccgcctgcgtgagcaagctgctgagcctgctgctggaccagagacccagccccaagctggtgctgatcatcctgcagctgtgcagagccgccctgcccctgatgagcgtggaggactgcggcaacgtggagctgcccccctggagctacagcgtgcccagcctgaacagcgagcaggaggaccccagcgaccccgccagcaagatcgccagcctgctgctggccaagctggccgactacgtggtgcccggctgccagaccgtgctgagccccaccgccagcgagcccgacaccaccctgaccaagaccagccccaagaacagcctgaagggcgacaaggaccccggcgaggagagcgaggccgtggacggcaagctgagcatcttcatccacaagagagaggaccagagcagccacgaggtgctgcagcccctgctgagcagcagcgagggcagacccttcagactgggcaccggcgccaacatggagaaggtggtgaagatggacagagacatgaccaagggcggctgctgcgaggtgatcaccgaggaggccgccgccgccctgagaaaggccaccaagtgggcccagagcggcctgatcgtgagcatcggcccccccgtggagagcatcaaccccgagaccgtgagcggcctgagcaccggcgacaagaagaagaccgcccagaccagcatctgcagagagagaaacagcgagctggccagaaccgaccccgtgagacccttcatcagcggccacgtggccaacagcatggccgccgaggtgatcgccctgctgcacagcctgctgatggcccccgagagcaacgccgcccagatctggaccaccaccgccgagaaggtgctgagcagagccctgatgtacatcccccagctgggcaagtacgccgagagcatcctggagaacggcagcagcagcggcagaaagctggccaagctgcagagaatcgccagacaggccgtggccgccctgtgcgccctgggcggcttcaaggagaccatcaagatcggcagcgaggtgcaggtgctgggcagaggcatcagcggcagcatcggcgtggtggccagcatcaacgagcaggagggcatcgccaccgtgagattcccccccatcgactgcagaaagaccagccaggccagcgacaccctgaccatccccctgagcagactgtgcgtgcccagaagcgaggccctgcccctgcacaagctgagcatcaccgagaaggtggtgcaggccgtgcagagcatgctgctgccccaggagggcagcctgagcatccacaccagcctgcccgccaccggcgacggcagcgcccccgtgatggccgtggtgagactgctggccgagatcagaaccagagcctgcctggtgatggcccagctgctggaggacagcctgttctgcgaggagttcatccagcagtgccccgccgccgtggaggtgctgaacctggtggcccaggagtgcagcgccggcgagagactggccgtggtggaggtgcagtgcgagagactgagaatgctgtacagagactgcgccagacccccccccccccccctgcaggccgacagaagacagcccaaggagatcacctggagccccagcagagtgttcccccccgtgagagcctgcatgttcagcagccacctgaccagcgtgaccttcctggccgaccccagcgccggcggcggcctgcccagaggcaccttcatctacgccaccagccccctgcccgtgcaggcccccagcttctactgggagatcgagatcgtgagctacggcgacaccgacgacgacaccggccccatcgtgagcttcggcttcaccaccgaggccgagaagagagacggcgcctggaccaaccccgtgggcacctgcctgttccacaacaacggcagagccgtgcactacaacggcagcagcctgctgcagtggaagagcgtgagactggacgtgaccctgagccccggcgacgtggccggcatcggctgggagagaaccgagggcaccccccccccccccggccagcccgccaagggcagagtgtacttcacctactgcggccagagactgagcccctacctggaggacgtgagcggcggcatgtggcccgtggtgcacatccagaagaagaacaccaagaccagagccaacttcggcagcagacccttcgcctacgccgagggccaggcccacagaaacgccgccgacctgtgcaccgacctggccgaggagatcagcgccaacttcgaggccctgcccttcgccatggccagcgacagcgacaacgacgccggcaccagcatcgccagcgaccccggcacccacggccccccctgcagaatcgccgccgtggccaccgcccagcagcagtacgacagcgacaccagctgccactacaaggtggagctgagctacgagaacttcatcaccagcggccccgacccccaccccccccccatcgccgacgacgagagcgacgacgacgacgacgacgacatcccccaggaggaccactacgccctgctggtgaaggcctgggagaccaaggtgttccccaccatcagaagaagattcagaaacgaggccgagagaaagagcggcctggaccagatcaagggcgccctgcagctgggcatggtggacatcgccagacagaccgtggagttcctgtacgaggagaacggcggcatccccagagacctgtacctgcccaccatcgaggacatcaaggacgaggccaacaagttcaccatcgacaaggtgagaaagggcctgaccgtggtgaccagaagccccgacagcaacaacgtggccagcagcgccgtgggcaccgccctgcccaagttcgccatcagaggcatgctgaagaccttcggcctgcacggcgtggtgctggacgtggacagcgtgaacgagctggtgcaggtggagacctacctgagaagcgagggcgtgctggtgagatactggtaccccatcgacatgctggagagaccccccgccggctacagaagaaccgccaccaacggcctggtgaccctggacaacaccaacctgcagatccacagagagctgctgagatgcgaggccgccctggccagactgtactgcagaatggccctgctgaacatcttcgcccccaagctgccccacctgttcaccagactgttccacatccccgccatcagagacatcaccctggagcacctgcagctgctgagcaaccagctgctggccccccccctgcccgacggcaccatcagcagcagcagcatcctgctggcccagagcctgcagcactgcatccacagccagaactgcagcgccaccgacctgttctaccagggcaacagccagaccgtgagagagtggctgaacgtggccatcaccagaaccctgcaccagggcgaggagagcctgctggagctgaccaagcagatctgcagcttcctgcagaccgcccccgagcagttccccagcgaggagttccccatcagcgagagcaaggtgaacatggacgtgaacttccccggcgccgccttcgtggtggtgagctgcaaggagagccagagcggcttcagaaaggacagcagcctgtacaaggccccctgggccagagtgctggtgtacggcctgggccacaaggtgaagagaaacggccagctgaacctgatcgaggccgcctgctaccccagagacgccagccccgccaacaccggcctggcccccccccccaccgccgaccagtaccccagcgtggtgctgagcaccgacagagtgcacatcaagctgggcgtgagccccccccccggcgccgtgctggtgctgcacagcctgcccctggagttccccctggccatggccttcgccgagcagctgctgagctggaagagcgaggacagcgagggcaagagcgaggacgagcccgacaccatccccaccagcgtgctgctgcaggtggtggagctgctgggcaacttcctgtggaccaccgacatggccgcctgcgtgaaggagctggtgttccacctgctggccgagctgctgagaaccgtgcacaccctggagcagagaagacaccccgccggcctgagcagcagcatcgccctgcagctgaacccctgcctggccatgctgatggccctgcagagcgagctgcacaagctgtacgacgaggagacccagaactgggtgagcggcggcgcctgcggcggcagcggcggcgccgccgccggcgaccagggcagattcagcacctacttccacgccctgatggagggctgcctggccgtggccgaggtgaccctgcccaccaacatgagcgtgaccgccagcggcgtgaccagcgccaccgcccccaacctgagcgacagcagcagcagcagcagcagcagccccggccagaccccccagagccccagcctgctgagcaagagaaagaaggtgaagatgaagagagagaaggccagcagcagcggcaagagacagagcagcagaaccgtggacagcgaccccaccgtgctgagcatcggcggcagcaagcccgaggacatgctgtggttccacagagccctgaccctgctgatcatcctgagacacctgaccagaaaggacccccagggcctgggcgtgaccagcgacgccatcgccgacgcctgccaggccctggtgggccccaccgcccacagcagactgctggtgatcagcggcatccccacccacctggacgagggcgtggtgagaggcgccatcagaaaggcctgcaacgcccacggcggcgtgttcaaggacgagatctacatccccctgcaggaggaggacaccaagaagcccaaggacaaggccgagggcggcgacggcaaggtggagcccgagaagaccctggccttccccggcaccgacagcatggaggtgagcaccagcagcagcctgacccccgccatgagcatcagcgccagcgccagcaccagccaggccagcatctgcagcagccagggcatcagccagaccgtgagcgacctgagcgtggaccccctgcccgccggcctggagctgcccatcccccccggcctgctggagccccacgccgtgagcagccaggagagcctggacatcagcctgtgcagcaccggcagcctgggcagcctgggcagcctgggcgagcccctggacaacgccgagaccgccagcgtgagcgacatgggcagcatgtacaccgtgaccagcctggacaaccagcccctggccgccagacccatcaagggcttcgccgtggtggagatcagaagcagagccaagatcgagaagatcagagccagcctgttcaacaacaacgacctgatcggcctgagcagcctggacggcgaggacgagctgatggagatgagcaccgaggagatcctgaccgtgagcgtggtgaaccagagcctgttcgacacccagggcagccccggcctggaggactacttcaacgacaagagcatcaagggcgagaagctggtgcccggcgccagagaggtgctgaccgagatcttcaagagctgcgcccacagcgagcagaccctgagcctgacccccgccaagcccatcagagtgagcgacatctacctgagcaaggagcagatcaacagccagacccccggcaacctgctgcacctgttcttcaccaacgtgagaccccccaagaaggtgctggaggaccagctgacccagatcctgagaaagtacggcgtgcccaagcccaagttcgacaagagcaagtacagcaaggccggcaaggagcagcaccccgtgaaggtggtgagcaccaagagacccatcaccaagccccccgccaaggacaaggccgtgctgaacagcgtgagcagaaccgccctgagcgagaagaagcccaccgtgaagcccaagagccccgagaagagcaagcccgacgagaaggaccccgagaagagccccaccaagaagcaggaggtgcccgaggagaagtacctgaccctggagggcttccacaagttcgtgatcgacagagccagacaggacatcagaagcgtgtggagagccatcctgagctgcggctacgacctgcacttcgagagatgcgcctgcatcgacgtgagacacgcccagaaggccagcagaaagtggaccctggagatggacgtggccctggtgcagtacatcaaccagctgtgcagacacctggccatcacccccgccagactgcacccccacgaggtgtacctggaccccgccgacgccgccgaccccagagtggcctgcctgctgaacgtgcccatcgagagcctgagactgagattcgccctgctgcagagcctgaacaccaccctggagaccttcttcctgcccctggtggagctgagacagacccccatgtacacccacagcatcgccgccctgctgaaggaggccaagggcctgatcttctacgacaccaaggtgaccgtgatgaacagagtgctgaacgccaccgtgcagagaaccgccgaccacgccgcccccgagatcaccctggaccccctggagatcgtgggcggcgagatcagagccagcgagaacagctacttctgccaggccgccagacagctggccagcgtgcccagcagccagctgtgcgtgaagctggccagcggcggcgaccccacctacgccttcaacatcagattcaccggcgaggaggtgcacggcaccagcggcagcttcagacacttcctgtggcaggtgtgcaaggagctgcagagcagcagcctgagcctgctgctgctgtgccccagcagcgccgtgaacaagaacaagggcaagtacatcctgacccccagccccatcacctacggcgaggagcagctgctgcacttcctgggccagctgctgggcatcgccatcagagccgacgtgcccctgcccctggacctgctgcccagcttctggaagaccctggtgggcgagcccctggaccccgagcaggacctgcaggaggccgacatcctgacctacaactacgtgaagaagttcgagagcatcaacgacgagaccgagctggaggccctgtgcgccgagatcgccagccagcacctggccaccgagagccccgacagccccaacaagccctgctgcagattcacctacctgaccatgaccggcgaggaggtggagctgtgcagcagaggcagacacatcctggtggcctgggagaacaaggacatctacgccgccgccatcagaagcctgagactgagagagctgcagaacgtggagtgcgtgaccgccgtgagagccggcctgggcagcatcatccccctgcagctgctgaccatgctgagccccctggagatggagctgagaacctgcggcctgccctacatcaacctggagttcctgaaggcccacaccatgtaccaggtgggcctgatggagaccgaccagcacatcgagttcttctggggcgccctggagatgttcacccaggaggagctgtgcaagttcatcaagttcgcctgcaaccaggagagaatccccttcacctgcccctgcaaggacggcggccccgacaccgcccacgtgcccccctaccccatgaagatcgccccccccgacggcaccgccggcagccccgacagcagatacatcagagtggagacctgcatgttcatgatcaagctgccccagtacagcagcctggagatcatgctggagaagctgagatgcgccatccactacagagaggaccccctgagcggctag

SEQ ID NO: 17131 - DNA, 849 bp, Artificial Sequence
  Description of Artificial Sequence: Synthetic coding sequence
atggagagcagaatgtggcccgccctgctgctgagccacctgctgcccctgtggcccctgctgctgctgcccctgcccccccccgcccagggcagcagcagcagccccagaaccccccccgcccccgccagacccccctgcgccagaggcggccccagcgcccccagacacgtgtgcgtgtgggagagagcccccccccccagcagaagccccagagtgcccagaagcagaagacaggtgctgcccggcaccgccccccccgccacccccagcggcttcgaggagggcccccccagcagccagtacccctgggccatcgtgtggggccccaccgtgagcagagaggacggcggcgaccccaacagcgccaaccccggcttcctggactacggcttcgccgccccccacggcctggccaccccccaccccaacagcgacagcatgagaggcgacggcgacggcctgatcctgggcgaggcccccgccaccctgagacccttcctgttcggcggcagaggcgagggcgtggacccccagctgtacgtgaccatcaccatcagcatcatcatcgtgctggtggccaccggcatcatcttcaagttctgctgggacagaagccagaagagaagaagacccagcggccagcagggcgccctgagacaggaggagagccagcagcccctgaccgacctgagccccgccggcgtgaccgtgctgggcgccttcggcgacagccccacccccacccccgaccacgaggagcccagaggcggccccagacccggcatgccccaccccaagggcgcccccgccttccagctgaacagaatccccctggtgaacctgtag

SEQ ID NO: 17132 - DNA, 771 bp, Artificial Sequence
  Description of Artificial Sequence: Synthetic coding sequence
atggagagcagaatgtggcccgccctgctgctgagccacctgctgcccctgtggcccctgctgctgctgcccctgccccccgcccccagacacgtgtgcgtgtgggagagagcccccccccccagcagaagccccagagtgcccagaagcagaagacaggtgctgcccggcaccgccccccccgccacccccagcggcttcgaggagggcccccccagcagccagtacccctgggccatcgtgtggggccccaccgtgagcagagaggacggcggcgaccccaacagcgccaaccccggcttcctggactacggcttcgccgccccccacggcctggccaccccccaccccaacagcgacagcatgagaggcgacggcgacggcctgatcctgggcgaggcccccgccaccctgagacccttcctgttcggcggcagaggcgagggcgtggacccccagctgtacgtgaccatcaccatcagcatcatcatcgtgctggtggccaccggcatcatcttcaagttctgctgggacagaagccagaagagaagaagacccagcggccagcagggcgccctgagacaggaggagagccagcagcccctgaccgacctgagccccgccggcgtgaccgtgctgggcgccttcggcgacagccccacccccacccccgaccacgaggagcccagaggcggccccagacccggcatgccccaccccaagggcgcccccgccttccagctgaacagaatccccctggtgaacctgtag

SEQ ID NO: 17133 - DNA, 831 bp, Artificial Sequence
  Description of Artificial Sequence: Synthetic coding sequence
atggagagcagaatgtggcccgccctgctgctgagccacctgctgcccctgtggcccctgctgctgctgcccctgcccccccccgcccagggcagcagcagcagccccagaaccccccccgcccccgccagacccccctgcgccagaggcggccccagcgcccccagacacgtgtgcgtgtgggagagagcccccccccccagcagaagccccagagtgcccagaagcagaagacaggtgctgcccggcaccgccccccccgccacccccagcggcttcgaggagggcccccccagcagccagtacccctgggccatcgtgtggggccccaccgtgagcagagaggacggcggcgaccccaacagcgccaaccccggcttcctggactacggcttcgccgccccccacggcctggccaccccccaccccaacagcgacagcatgagaggcgacggcgacggcctgatcctgggcgaggcccccgccaccctgagacccttcctgttcggcggcagaggcgagggcgtggacccccagctgtacgtgaccatcaccatcagcatcatcatcgtgctggtggccaccggcatcatcttcaagttctgctgggacagaagccagaagagaagaagacccagcggccagcagggcgccctgagacaggaggagagccagcagcccctgaccgacctgagccccgccggcgtgaccgtgctgggcgccttcggcgacagccccacccccacccccgaccacgaggagcccagaggcggccccagacccggcatgccccaccccaagggcgcccccgccttccagctgaacagatag

SEQ ID NO: 17134 - DNA, 849 bp, Artificial Sequence; identical to SEQ ID NO: 17131
  Description of Artificial Sequence: Synthetic coding sequence

SEQ ID NO: 17135 - DNA, 492 bp, Artificial Sequence
  Description of Artificial Sequence: Synthetic coding sequence
atgagctggagaccccagccctgctgcatcagcagctgctgcctgaccaccgactgggtgcacctgtggtacatctggctgctggtggtgatcggcgccctgctgctgctgtgcggcctgaccagcctgtgcttcagatgctgctgcctgagcagacagcagaacggcgaggacggcggcccccccccctgcgaggtgaccgtgatcgccttcgaccacgacagcaccctgcagagcaccatcaccagcctgcagagcgtgttcggccccgccgccagaagaatcctggccgtggcccacagccacagcagcctgggccagctgcccagcagcctggacaccctgcccggctacgaggaggccctgcacatgagcagattcaccgtggccatgtgcggccagaaggcccccgacctgccccccgtgcccgaggagaagcagctgccccccaccgagaaggagagcaccagaatcgtggacagctggaactag

SEQ ID NO: 17136 - DNA, 552 bp, Artificial Sequence
  Description of Artificial Sequence: Synthetic coding sequence
atgggcgtgagagtgcacgtggtggccgccagcgccctgctgtacttcatcctgctgagcggcaccagatgcgaggagaactgcggcaaccccgagcactgcctgaccaccgactgggtgcacctgtggtacatctggctgctggtggtgatcggcgccctgctgctgctgtgcggcctgaccagcctgtgcttcagatgctgctgcctgagcagacagcagaacggcgaggacggcggcccccccccctgcgaggtgaccgtgatcgccttcgaccacgacagcaccctgcagagcaccatcaccagcctgcagagcgtgttcggccccgccgccagaagaatcctggccgtggcccacagccacagcagcctgggccagctgcccagcagcctggacaccctgcccggctacgaggaggccctgcacatgagcagattcaccgtggccatgtgcggccagaaggcccccgacctgccccccgtgcccgaggagaagcagctgccccccaccgagaaggagagcaccagaatcgtggacagctggaactag

SEQ ID NO: 17137 - DNA, 552 bp, Artificial Sequence; identical to SEQ ID NO: 17136
  Description of Artificial Sequence: Synthetic coding sequence

SEQ ID NO: 17138 - DNA, 273 bp, Artificial Sequence
  Description of Artificial Sequence: Synthetic coding sequence
atgggcgtgagagtgcacgtggtggccgccagcgccctgctgtacttcatcctgctgagcggcaccagatgcgaggagaactgcggcaaccccgagcactgcctgaccaccgactgggtgcacctgtggtacatctggctgctggtggtgatcggcgccctgctgctgctgtgcggcctgaccagcctgtgcttcagatgctgctgcctgagcagacagcagaacggcgaggacggcggcccccccccctgcgaggtgaccgtgatcgcctag

SEQ ID NO: 17139 - DNA, 174 bp, Artificial Sequence
  Description of Artificial Sequence: Synthetic coding sequence
atgcccaccggcaagcagctggccgacatcggctacaagaccttcagcaccagcatgatgctgctgaccgtgtacggcggctacctgtgcagcgtgagagtgtaccactacttccagtggagaagagcccagagacaggccgccgaggagcagaagaccagcggcatcatgtag

SEQ ID NO: 17140 - DNA, 174 bp, Artificial Sequence; identical to SEQ ID NO: 17139
  Description of Artificial Sequence: Synthetic coding sequence

SEQ ID NO: 17141 - DNA, 174 bp, Artificial Sequence; identical to SEQ ID NO: 17139
  Description of Artificial Sequence: Synthetic coding sequence

SEQ ID NO: 17142 - DNA, 174 bp, Artificial Sequence; identical to SEQ ID NO: 17139
  Description of Artificial Sequence: Synthetic coding sequence

SEQ ID NO: 17143 - DNA, 678 bp, Artificial Sequence
  Description of Artificial Sequence: Synthetic coding sequence
atggcccagagcgacttcctgtaccccgagaaccccaagagaagagaggaggtgaacagactgcaccagcagctgctggactgcctgagcgacagcttcgacgtgaccaacaagctgaccgaggtgctgaacatgcacctgggctgcagactggccagcatcgagatgaagagagacggcaccatcaaggagaactgcgacctgatcatccaggccatcatgaagatccagaaggagctgcagaaggtggacgaggccctgaaggacaagctggagcccaccctgtacagaaagctgcaggacatcaaggagaaggagaccgacaagatcgccatcgtgcagaaggtgatcagcgtgatcctgggcgaggccaccagcgccgccagcgccgtggccgtgaagctggtgggcagcaacgtgaccaccggcatcatcaacaagctggtgaccgtgctggcccagatcggcgccagcctgctgggcagcatcggcgtggccgtgctgggcctgggcatcgacatgatcgtgagagccatcctgggcgccgtggagaagacccagctgcaggccgccatcaagagctacgagaagcacctggtggagttcaagagcgccagcgagaagtacaaccacgccatcaccgaggtgatcaacaccgtgaagcaccagatgaagtag

SEQ ID NO: 17144 - DNA, 456 bp, Artificial Sequence
  Description of Artificial Sequence: Synthetic coding sequence
atggagtacgtgctggaggtgaagaacagccccagacacctgctgaagcagttcaccgtgtgcgacgtgcccctgtacgacatctgcgactacaacgtgagcagagacagatgccaggagctgggctgctgcttctacgagggcgtgtgctacaagaaggccgtgcccatctacatccacgtgttcagcgccctgatcgtgatcatcgccggcgccttcgtgatcaccatcatctacagagtgatccaggagagcagaaaggagaaggccatccccgtggacgtggccctgccccagaagagcagcgagaaggccgagctggccagcagcagcagcaagctgggcctgaagcccgccagccccggcccccccagcgccggccccagcatgaagagcgacgaggacaaggacgacgtgaccggcaccatcaccgaggccgaggagaccgaggactag

SEQ ID NO: 17145 - DNA, 258 bp, Artificial Sequence
  Description of Artificial Sequence: Synthetic coding sequence
atggaggccggcgagagaatcgacgccagccagctgccccacagagtgctggagaccagaggccacgccatcagcatcctgttcggcttctggaccagcttcatctgcgacacctacatcgtgctggcctggatcagcaagatcaagggcagccccgacgtgagcgccagcagcgacgagccctacgccagaatccagcagagcagaagacagtgccacgccgaggaggaccagagccaggtgcccgaggccggctag

SEQ ID NO: 17146 - DNA, 2124 bp, Artificial Sequence
  Description of Artificial Sequence: Synthetic coding sequence
atgagcccccacggcgacggcagaggccaggcccagggcagagccgtgagagtgggcctgagaagaagcggcggcatcagaggcggcgtggccgtgttcgccgccgtggccgccgtgttcaccttcaccctgccccccagcgtgcccggcggcgacagcggcgagctgatcaccgccgcccacgagctgggcgtggcccacccccccggctaccccctgttcaccctggtggccaagctggccatcaccctgttccccttcggcagcatcgcctacagagtgaacctgctgtgcggcctgttcggcgccgtggccgccagcctgctgttcttcaccgtgttcagactgagcggcagcagcgccggcggcatcctggccgccggcgtgttcagcttcagcagactgacctggcagtggagcatcgccgccgaggtgttcagcctgaacaacctgttcgtgggcctgctgatggccctgaccgtgcacttcgaggaggccgccaccgccaaggagagaagcaaggtggccaagatcggcgccttctgctgcggcctgagcctgtgcaaccagcacaccatcatcctgtacgtgctgtgcatcatcccctggatcctgttccagctgctgaagaagaaggagctgagcctgggcagcctgctgaagctgagcctgtacttcagcgccggcctgctgccctacgtgcacctgcccatcagcagctacctgaaccacgccagatggacctggggcgaccagaccaccctgcagggcttcctgacccacttcctgagagaggagtacggcaccttcagcctggccaagagcgagatcggcagcagcatgagcgagatcctgctgagccaggtgaccaacatgagaaccgagctgagcttcaacatccaggccctggccgtgtgcgccaacatctgcctggccaccaaggacagacagaaccccagcctggtgtggctgttcaccggcatgttctgcatctacagcctgttcttcgcctggagagccaacctggacatcagcaagcccctgttcatgggcgtggtggagagattctggatgcagagcaacgccgtggtggccgtgctggccggcatcggcctggccgccgtggtgagcgagaccaacagagtgctgaacagcaacggcctgcagtgcctggagtggctgagcgccaccctgttcgtggtgtaccagatctacagcaactacagcgtgtgcgaccagagaaccaactacgtgatcgacaagttcgccaagaacctgctgaccagcatgccccacgacgccatcatcctgctgagaggcgacctgcccggcaacagcctgagatacatgcactactgcgagggcctgagacccgacatcagcctggtggaccaggagatgatgacctacgagtggtacctgcccaagatggccaagcacctgcccggcgtgaacttccccggcaacagatggaaccccgtggagggcatcctgcccagcggcatggtgaccttcaacctgtaccacttcctggaggtgaacaagcagaaggagaccttcgtgtgcatcggcatccacgagggcgaccccacctggaagaagaactacagcctgtggccctggggcagctgcgacaagctggtgcccctggagatcgtgttcaaccccgaggagtggatcaagctgaccaagagcatctacaactggaccgaggagtacggcagattcgaccccagcagctgggagagcgtggccaacgaggagatgtggcaggccagaatgaagacccccttcttcatcttcaacctggccgagaccgcccacatgcccagcaaggtgaaggcccagctgtacgcccaggcctacgacctgtacaaggagatcgtgtacctgcagaaggagcaccccgtgaactggcacaagaactacgccatcgcctgcgagagaatgctgagactgcaggccagagacgccgaccccgaggtgctgctgagcgagaccatcagacacttcagactgtacagccagaaggcccccaacgacccccagcaggccgacatcctgggcgccctgaagcacctgagaaaggagctgcagagcctgagaaacagaaagaacgtgtag

SEQ ID NO: 17147 - DNA, 726 bp, Artificial Sequence
  Description of Artificial Sequence: Synthetic coding sequence
atgatgacctacgagtggtacctgcccaagatggccaagcacctgcccggcgtgaacttccccggcaacagatggaaccccgtggagggcatcctgcccagcggcatggtgaccttcaacctgtaccacttcctggaggtgaacaagcagaaggagaccttcgtgtgcatcggcatccacgagggcgaccccacctggaagaagaactacagcctgtggccctggggcagctgcgacaagctggtgcccctggagatcgtgttcaaccccgaggagtggatcaagctgaccaagagcatctacaactggaccgaggagtacggcagattcgaccccagcagctgggagagcgtggccaacgaggagatgtggcaggccagaatgaagacccccttcttcatcttcaacctggccgagaccgcccacatgcccagcaaggtgaaggcccagctgtacgcccaggcctacgacctgtacaaggagatcgtgtacctgcagaaggagcaccccgtgaactggcacaagaactacgccatcgcctgcgagagaatgctgagactgcaggccagagacgccgaccccgaggtgctgctgagcgagaccatcagacacttcagactgtacagccagaaggcccccaacgacccccagcaggccgacatcctgggcgccctgaagcacctgagaaaggagctgcagagcctgagaaacagaaagaacgtgtag

SEQ ID NO: 17148 - DNA, 1230 bp, Artificial Sequence
  Description of Artificial Sequence: Synthetic coding sequence
atgagcccccacggcgacggcagaggccaggcccagggcagagccgtgagagtgggcctgagaagaagcggcggcatcagaggcggcgtggccgtgttcgccgccgtggccgccgtgttcaccttcaccctgccccccagcgtgcccggcggcgacagcggcgagctgatcaccgccgcccacgagctgggcgtggcccacccccccggctaccccctgttcaccctggtggccaagctggccatcaccctgttccccttcggcagcatcgcctacagagtgaacctgctgtgcggcctgttcggcgccgtggccgccagcctgctgttcttcaccgtgttcagactgagcggcagcagcgccggcggcatcctggccgccggcgtgttcagcttcagcagactgacctggcagtggagcatcgccgccgaggtgttcagcctgaacaacctgttcgtgggcctgctgatggccctgaccgtgcacttcgaggaggccgccaccgccaaggagagaagcaaggtggccaagatcggcgccttctgctgcggcctgagcctgtgcaaccagcacaccatcatcctgtacgtgctgtgcatcatcccctggatcctgttccagctgctgaagaagaaggagctgagcctgggcagcctgctgaagctgagcctgtacttcagcgccggcctgctgccctacgtgcacctgcccatcagcagctacctgaaccacgccagatggacctggggcgaccagaccaccctgcagggcttcctgacccacttcctgagagaggagtacggcaccttcagcctggccaagagcgagatcggcagcagcatgagcgagatcctgctgagccaggtgaccaacatgagaaccgagctgagcttcaacatccaggccctggccgtgtgcgccaacatctgcctggccaccaaggacagacagaaccccagcctggtgtggctgttcaccggcatgttctgcatctacagcctgttcttcgcctggagagccaacctggacatcagcaagcccctgttcatgggcgtggtggagagattctggatgcagagcaacgccgtggtggccgtgctggccggcatcggcctggccgccgtggtgagcgagaccaacagagtgctgaacagcaacggcctgcagtgcctggagtggctgagcgccaccctgttcgtggtgtaccagatctacagcaactacagatag

SEQ ID NO: 17149 - DNA, 396 bp, Artificial Sequence
  Description of Artificial Sequence: Synthetic coding sequence
atgatgaacttcagacagagaatgggctggatcggcgtgggcctgtacctgctggccagcgccgccgccttctactacgtgttcgagatcagcgagacctacaacagactggccctggagcacatccagcagcaccccgaggagcccctggagggcaccacctggacccacagcctgaaggcccagctgctgagcctgcccttctgggtgtggaccgtgatcttcctggtgccctacctgcagatgttcctgttcctgtacagctgcaccagagccgaccccaagaccgtgggctactgcatcatccccatctgcctggccgtgatctgcaacagacaccaggccttcgtgaaggccagcaaccagatcagcagactgcagctgatcgacacctag

SEQ ID NO: 17150 - DNA, 510 bp, Artificial Sequence
  Description of Artificial Sequence: Synthetic coding sequence
atgctggccttcagcgagatgcccaagccccccgactacagcgagctgagcgacagcctgaccctggccgtgggcaccggcagattcagcggccccctgcacagagcctggagaatgatgaacttcagacagagaatgggctggatcggcgtgggcctgtacctgctggccagcgccgccgccttctactacgtgttcgagatcagcgagacctacaacagactggccctggagcacatccagcagcaccccgaggagcccctggagggcaccacctggacccacagcctgaaggcccagctgctgagcctgcccttctgggtgtggaccgtgatcttcctggtgccctacctgcagatgttcctgttcctgtacagctgcaccagagccgaccccaagaccgtgggctactgcatcatccccatctgcctggccgtgatctgcaacagacaccaggccttcgtgaaggccagcaaccagatcagcagactgcagctgatcgacacctag

SEQ ID NO: 17151 - DNA, 522 bp, Artificial Sequence
  Description of Artificial Sequence: Synthetic coding sequence
atgatggcccagctgttcctgctgcaggccaacgccgtgctgcccctgagccacgagatcaaggtgaagagacagatcagactgcccgcccccctgtacccccccgagagaaacgacagcagaagcttccagatcccccaggacctgagagagaagggctgggaggagggccagcagcacttcgccggcaaggccgccgacgccttccccgcccccgtgcagctggagggcctggaggccggccagaccaccctggccagccccgaggtgggcccctggagacccaagagactgagcggcgtgtgcctgctgagcgccctgctgcccgacccctgcaagaccaacggcaccttcctgctgcagaagcaccacctgcccagcctgctggccgtgatcctgttccccgtgatcatcctgaccggcgccagcttcgcccacctgttcgtggccctgttcgtgagccacctgctgctgaagctgcccctgggcgccggcatgagaatgcagagagacgccagatag

SEQ ID NO: 17152 - DNA, 522 bp, Artificial Sequence; identical to SEQ ID NO: 17151
  Description of Artificial Sequence: Synthetic coding sequence

SEQ ID NO: 17153 - DNA, 2817 bp, Artificial Sequence
  Description of Artificial Sequence: Synthetic coding sequence
atgcccgccctggagcacatgaaccagatcctgcacatcctgttcgtgttcctgcccttcctgtgggccctgggcaccctgcccccccccgacgccctgctgctgtgggccatggagcaggtgctggagttcggcctgggcggcagcagcatgagcacccacctgagactgctggtgatgttcatcatgagcgccggcaccgccatcgccagctacttcatccccagcaccgtgggcgtggtgctgttcatgaccggcttcggcttcctgctgagcctgaacctgagcgacatgggccacaagatcggcaccaagagcaaggacctgcccagcggccccgagaagcacttcagctggaaggagtgcctgttctacatcatcatcctggtgctggccctgctggagaccagcctgctgcaccacttcgccggcttcagccagatcagcaagagcaacagccaggccatcgtgggctacggcctgatgatcctgctgatcatcctgtggatcctgagagagatccagagcgtgtacatcatcggcatcttcagaaaccccttctaccccaaggacgtgcagaccgtgaccgtgttcttcgagaagcagaccagactgatgaagatcggcatcgtgagaagaatcctgctgaccctggtgagccccttcgccatgatcgccttcctgagcctggacagcagcctgcagggcctgcacagcgtgagcgtgtgcatcggcttcaccagagccttcagaatggtgtggcagaacaccgagaacgccctgctggagaccgtgatcgtgagcaccgtgcacctgatcagcagcaccgacatctggtggaacagaagcctggacaccggcctgagactgctgctggtgggcatcatcagagacagactgatccagttcatcagcaagctgcagttcgccgtgaccgtgctgctgaccagctggaccgagaagaagcagagaagaaagaccaccgccaccctgtgcatcctgaacatcgtgttcagccccttcgtgctggtgatcatcgtgttcagcaccctgctgagcagccccctgctgcccctgttcaccctgcccgtgttcctggtgggcttccccagacccatccagagctggcccggcgccgccggcaccaccgcctgcgtgtgcgccgacaccgtgtactactaccagatggtgcccagactgaccgccgtgctgcagaccgccatggccgccggcagcctgggcctgctgctgcccggcagccactacctgggcagattccaggacagactgatgtggatcatgatcctggagtgcggctacacctactgcagcatcaacatcaagggcctggagctgcaggagaccagctgccacaccgccgaggccagaagagtggacgaggtgttcgaggacgccttcgagcaggagtacaccagagtgtgcagcctgaacgagcacttcggcaacgtgctgaccccctgcaccgtgctgcccgtgaagctgtacagcgacgccagaaacgtgctgagcggcatcatcgacagccacgagaacctgaaggagttcaagggcgacctgatcaaggtgctggtgtggatcctggtgcagtactgcagcaagagacccggcatgaaggagaacgtgcacaacaccgagaacaagggcaaggcccccctgatgctgcccgccctgaacaccctgcccccccccaagagccccgaggacatcgacagcctgaacagcgagaccttcaacgactggagcgacgacaacatcttcgacgacgagcccaccatcaagaaggtgatcgaggagaagcaccagctgaaggacctgcccggcaccaacctgttcatccccggcagcgtggagagccagagagtgggcgaccacagcaccggcaccgtgcccgagaacgacctgtacaaggccgtgctgctgggctaccccgccgtggacaagggcaagcaggaggacatgccctacatccccctgatggagttcagctgcagccacagccacctggtgtgcctgcccgccgagtggagaaccagctgcatgcccagcagcaagatgaaggagatgagcagcctgttccccgaggactggtaccagttcgtgctgagacagctggagtgctaccacagcgaggagaaggccagcaacgtgctggaggagatcgccaaggacaaggtgctgaaggacttctacgtgcacaccgtgatgacctgctacttcagcctgttcggcatcgacaacatggcccccagccccggccacatcctgagagtgtacggcggcgtgctgccctggagcgtggccctggactggctgaccgagaagcccgagctgttccagctggccctgaaggccttcagatacaccctgaagctgatgatcgacaaggccagcctgggccccatcgaggacttcagagagctgatcaagtacctggaggagtacgagagagactggtacatcggcctggtgagcgacgagaagtggaaggaggccatcctgcaggagaagccctacctgttcagcctgggctacgacagcaacatgggcatctacaccggcagagtgctgagcctgcaggagctgctgatccaggtgggcaagctgaaccccgaggccgtgagaggccagtgggccaacctgagctgggagctgctgtacgccaccaacgacgacgaggagagatacagcatccaggcccaccccctgctgctgagaaacctgaccgtgcaggccgccgagccccccctgggctaccccatctacagcagcaagcccctgcacatccacctgtactag

SEQ ID NO: 17154 - DNA, 3519 bp, Artificial Sequence
  Description of Artificial Sequence: Synthetic coding sequence
atgagccccgacgtgcccctgctgaacgactacaagcaggacttcttcctgaagagattcccccagaccgtgctgggcggccccagattcaagctgggctactgcgcccccccctacatctacgtgaaccagatcatcctgttcctgatgccctgggtgtggggcggcgtgggcaccctgctgtaccagctgggcatcctgaaggactactacaccgccgccctgagcggcggcctgatgctgttcaccgccttcgtgatccagttcaccagcctgtacgccaagaacaagagcaccaccgtggagagaatcctgaccaccgacatcctggccgaggaggacgagcacgagttcaccagctgcaccggcgccgagaccgtgaagttcctgatccccggcaagaagtacgtggccaacaccgtgttccacagcatcctggccggcctggcctgcggcctgggcacctggtacctgctgcccaacagaatcaccctgctgtacggcagcaccggcggcaccgccctgctgttcttcttcggctggatgaccctgtgcatcgccgagtacagcctgatcgtgaacaccgccaccgagaccgccaccttccagacccaggacacctacgagatcatccccctgatgagacccctgtacatcttcttcttcgtgagcgtggacctggcccacagattcgtggtgaacatgcccgccctggagcacatgaaccagatcctgcacatcctgttcgtgttcctgcccttcctgtgggccctgggcaccctgcccccccccgacgccctgctgctgtgggccatggagcaggtgctggagttcggcctgggcggcagcagcatgagcacccacctgagactgctggtgatgttcatcatgagcgccggcaccgccatcgccagctacttcatccccagcaccgtgggcgtggtgctgttcatgaccggcttcggcttcctgctgagcctgaacctgagcgacatgggccacaagatcggcaccaagagcaaggacctgcccagcggccccgagaagcacttcagctggaaggagtgcctgttctacatcatcatcctggtgctggccctgctggagaccagcctgctgcaccacttcgccggcttcagccagatcagcaagagcaacagccaggccatcgtgggctacggcctgatgatcctgctgatcatcctgtggatcctgagagagatccagagcgtgtacatcatcggcatcttcagaaaccccttctaccccaaggacgtgcagaccgtgaccgtgttcttcgagaagcagaccagactgatgaagatcggcatcgtgagaagaatcctgctgaccctggtgagccccttcgccatgatcgccttcctgagcctggacagcagcctgcagggcctgcacagcgtgagcgtgtgcatcggcttcaccagagccttcagaatggtgtggcagaacaccgagaacgccctgctggagaccgtgatcgtgagcaccgtgcacctgatcagcagcaccgacatctggtggaacagaagcctggacaccggcctgagactgctgctggtgggcatcatcagagacagactgatccagttcatcagcaagctgcagttcgccgtgaccgtgctgctgaccagctggaccgagaagaagcagagaagaaagaccaccgccaccctgtgcatcctgaacatcgtgttcagccccttcgtgctggtgatcatcgtgttcagcaccctgctgagcagccccctgctgcccctgttcaccctgcccgtgttcctggtgggcttccccagacccatccagagctggcccggcgccgccggcaccaccgcctgcgtgtgcgccgacaccgtgtactactaccagatggtgcccagactgaccgccgtgctgcagaccgccatggccgccggcagcctgggcctgctgctgcccggcagccactacctgggcagattccaggacagactgatgtggatcatgatcctggagtgcggctacacctactgcagcatcaacatcaagggcctggagctgcaggagaccagctgccacaccgccgaggccagaagagtggacgaggtgttcgaggacgccttcgagcaggagtacaccagagtgtgcagcctgaacgagcacttcggcaacgtgctgaccccctgcaccgtgctgcccgtgaagctgtacagcgacgccagaaacgtgctgagcggcatcatcgacagccacgagaacctgaaggagttcaagggcgacctgatcaaggtgctggtgtggatcctggtgcagtactgcagcaagagacccggcatgaaggagaacgtgcacaacaccgagaacaagggcaaggcccccctgatgctgcccgccctgaacaccctgcccccccccaagagccccgaggacatcgacagcctgaacagcgagaccttcaacgactggagcgacgacaacatcttcgacgacgagcccaccatcaagaaggtgatcgaggagaagcaccagctgaaggacctgcccggcaccaacctgttcatccccggcagcgtggagagccagagagtgggcgaccacagcaccggcaccgtgcccgagaacgacctgtacaaggccgtgctgctgggctaccccgccgtggacaagggcaagcaggaggacatgccctacatccccctgatggagttcagctgcagccacagccacctggtgtgcctgcccgccgagtggagaaccagctgcatgcccagcagcaagatgaaggagatgagcagcctgttccccgaggactggtaccagttcgtgctgagacagctggagtgctaccacagcgaggagaaggccagcaacgtgctggaggagatcgccaaggacaaggtgctgaaggacttctacgtgcacaccgtgatgacctgctacttcagcctgttcggcatcgacaacatggcccccagccccggccacatcctgagagtgtacggcggcgtgctgccctggagcgtggccctggactggctgaccgagaagcccgagctgttccagctggccctgaaggccttcagatacaccctgaagctgatgatcgacaaggccagcctgggccccatcgaggacttcagagagctgatcaagtacctggaggagtacgagagagactggtacatcggcctggtgagcgacgagaagtggaaggaggccatcctgcaggagaagccctacctgttcagcctgggctacgacagcaacatgggcatctacaccggcagagtgctgagcctgcaggagctgctgatccaggtgggcaagctgaaccccgaggccgtgagaggccagtgggccaacctgagctgggagctgctgtacgccaccaacgacgacgaggagagatacagcatccaggcccaccccctgctgctgagaaacctgaccgtgcaggccgccgagccccccctgggctaccccatctacagcagcaagcccctgcacatccacctgtactag

SEQ ID NO: 17155 - DNA, 3519 bp, Artificial Sequence; identical to SEQ ID NO: 17154
  Description of Artificial Sequence: Synthetic coding sequence

SEQ ID NO: 17156 - DNA, 897 bp, Artificial Sequence
  Description of Artificial Sequence: Synthetic coding sequence
atgctgcccgccctgaacaccctgcccccccccaagagccccgaggacatcgacagcctgaacagcgagaccttcaacgactggagcgacgacaacatcttcgacgacgagcccaccatcaagaaggtgatcgaggagaagcaccagctgaaggacctgcccggcaccaacctgttcatccccggcagcgtggagagccagagagtgggcgaccacagcaccggcaccgtgcccgagaacgacctgtacaaggccgtgctgctgggctaccccgccgtggacaagggcaagcaggaggacatgccctacatccccctgatggagttcagctgcagccacagccacctggtgtgcctgcccgccgagtggagaaccagctgcatgcccagcagcaagatgaaggagatgagcagcctgttccccgaggactggtaccagttcgtgctgagacagctggagtgctaccacagcgaggagaaggccagcaacgtgctggaggagatcgccaaggacaaggtgctgaaggacttctacgtgcacaccgtgatgacctgctacttcagcctgttcggcatcgacaacatggcccccagccccggccacatcctgagagtgtacggcggcgtgctgccctggagcgtggccctggactggctgaccgagaagcccgagctgttccagctggccctgaaggccttcagatacaccctgaagctgatgatcgacaaggccagcctgggccccatcgaggacttcagagagctgatcaagtacctggaggagtacgagagagactggtacatcggcctggtgagcgacgagaagtggaaggaggccatcctgcaggagaagccctacctgttcagcctgggctacgacagcaacatgtacctgtag

SEQ ID NO: 17157 - DNA, 1584 bp, Artificial Sequence
  Description of Artificial Sequence: Synthetic coding sequence
ctgtgcatcctgaacatcgtgttcagccccttcgtgctggtgatcatcgtgttcagcaccctgctgagcagccccctgctgcccctgttcaccctgcccgtgttcctggtgggcttccccagacccatccagagctggcccggcgccgccggcaccaccgcctgcgtgtgcgccgacaccgtgtactactaccagatggtgcccagactgaccgccgtgctgcagaccgccatggccgccggcagcctgggcctgctgctgcccggcagccactacctgggcagattccaggacagactgatgtggatcatgatcctggagtgcggctacacctactgcagcatcaacatcaagggcctggagctgcaggagaccagctgccacaccgccgaggccagaagagtggacgaggtgttcgaggacgccttcgagcaggagtacaccagagtgtgcagcctgaacgagcacttcggcaacgtgctgaccccctgcaccgtgctgcccgtgaagctgtacagcgacgccagaaacgtgctgagcggcatcatcgacagccacgagaacctgaaggagttcaagggcgacctgatcaaggtgctggtgtggatcctggtgcagtactgcagcaagagacccggcatgaaggagaacgtgcacaacaccgagaacaagggcaaggcccccctgatgctgcccgccctgaacaccctgcccccccccaagagccccgaggacatcgacagcctgaacagcgagaccttcaacgactggagcgacgacaacatcttcgacgacgagcccaccatcaagaaggtgatcgaggagaagcaccagctgaaggacctgcccggcaccaacctgttcatccccggcagcgtggagagccagagagtgggcgaccacagcaccggcaccgtgcccgagaacgacctgtacaaggccgtgctgctgggctaccccgccgtggacaagggcaagcaggaggacatgccctacatccccctgatggagttcagctgcagccacagccacctggtgtgcctgcccgccgagtggagaaccagctgcatgcccagcagcaagatgaaggagatgagcagcctgttccccgaggactggtaccagttcgtgctgagacagctggagtgctaccacagcgaggagaaggccagcaacgtgctggaggagatcgccaaggacaaggtgctgaaggacttctacgtgcacaccgtgatgacctgctacttcagcctgttcggcatcgacaacatggcccccagccccggccacatcctgagagtgtacggcggcgtgctgccctggagcgtggccctggactggctgaccgagaagcccgagctgttccagctggccctgaaggccttcagatacaccctgaagctgatgatcgacaaggccagcctgggccccatcgaggacttcagagagctgatcaagtacctggaggagtacgagagagactggtacatcggcctggtgagcgacgagaagtggaaggaggccatcctgcaggagaagccctacctgttcagcctgggctacgacagcaacatgtacctgtag

SEQ ID NO: 17158 - DNA, 1866 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagcgagaccagaatgggccacccccagttctggaagtacgagttcggcgcctgcaccggcagcctggccagcctggagcagtacagcgagcagctgaaggacatggtggccttcttcctgggctgcagcttcagcctggaggaggccctggagaaggccggcctgcccagaagagaccccgccggccacagccaggccggcgcctacaagaccaccgtgccctgcgtgacccacgccggcttctgctgccccctggtggtgaccatgagacccatccccaaggacaagctggagggcctggtgagagcctgctgcagcctgggcggcgagcagggccagcccgtgcacatgggcgaccccgagctgctgggcatcaaggagctgagcaagcccgcctacggcgacgccatggtgtgcccccccggcgaggtgcccgtgttctggcccagccccctgaccagcctgggcgccgtgagcagctgcgagacccccctggccttcgccagcatccccggctgcaccgtgatgaccgacctgaaggacgccaaggccccccccggctgcctgacccccgagagaatccccgaggtgcaccacatcagccaggaccccctgcactacagcatcgccagcgtgagcgccagccagaagatcagagagctggagagcatgatcggcatcgaccccggcaacagaggcatcggccacctgctgtgcaaggacgagctgctgaaggccagcctgagcctgagccacgccagaagcgtgctgatcaccaccggcttccccacccacttcaaccacgagccccccgaggagaccgacggcccccccggcgccgtggccctggtggccttcctgcaggccctggagaaggaggtggccatcatcgtggaccagagagcctggaacctgcaccagaagatcgtggaggacgccgtggagcagggcgtgctgaagacccagatccccatcctgacctaccagggcggcagcgtggaggccgcccaggccttcctgtgcaagaacggcgacccccagacccccagattcgaccacctggtggccatcgagagagccggcagagccgccgacggcaactactacaacgccagaaagatgaacatcaagcacctggtggaccccatcgacgacctgttcctggccgccaagaagatccccggcatcagcagcaccggcgtgggcgacggcggcaacgagctgggcatgggcaaggtgaaggaggccgtgagaagacacatcagacacggcgacgtgatcgcctgcgacgtggaggccgacttcgccgtgatcgccggcgtgagcaactggggcggctacgccctggcctgcgccctgtacatcctgtacagctgcgccgtgcacagccagtacctgagaaaggccgtgggccccagcagagcccccggcgaccaggcctggacccaggccctgcccagcgtgatcaaggaggagaagatgctgggcatcctggtgcagcacaaggtgagaagcggcgtgagcggcatcgtgggcatggaggtggacggcctgcccttccacaacacccacgccgagatgatccagaagctggtggacgtgaccaccgcccaggtgtag

SEQ ID NO: 17159 - DNA, 480 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagcgagaccagcctgagagacctgcacagcgcctggcacagaaccagcctgatgaccgtggcccaggagagagccgccctgcccaccgtgctgacccccagccccatcacctggagactgagctggctgagaagcctgagaagctggagaaagagcagccccggcgagatccccctggccctgcccagcgtgcacagcatcgcccaggccagaaacccccccgtgcaggactag

SEQ ID NO: 17160 - DNA, 1866 bp, Artificial Sequence; identical to SEQ ID NO: 17158
  Description of Artificial Sequence: Synthetic coding sequence

SEQ ID NO: 17161 - DNA, 1851 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagcgagaccagaatgggccacccccagttctggaagtacgagttcggcgcctgcaccggcagcctggccagcctggagcagtacagcgagcagctgaaggacatggtggccttcttcctgggctgcagcttcagcctggaggaggccctggagaaggccggcctgcccagaagagaccccgccggccacagccagaccaccgtgccctgcgtgacccacgccggcttctgctgccccctggtggtgaccatgagacccatccccaaggacaagctggagggcctggtgagagcctgctgcagcctgggcggcgagcagggccagcccgtgcacatgggcgaccccgagctgctgggcatcaaggagctgagcaagcccgcctacggcgacgccatggtgtgcccccccggcgaggtgcccgtgttctggcccagccccctgaccagcctgggcgccgtgagcagctgcgagacccccctggccttcgccagcatccccggctgcaccgtgatgaccgacctgaaggacgccaaggccccccccggctgcctgacccccgagagaatccccgaggtgcaccacatcagccaggaccccctgcactacagcatcgccagcgtgagcgccagccagaagatcagagagctggagagcatgatcggcatcgaccccggcaacagaggcatcggccacctgctgtgcaaggacgagctgctgaaggccagcctgagcctgagccacgccagaagcgtgctgatcaccaccggcttccccacccacttcaaccacgagccccccgaggagaccgacggcccccccggcgccgtggccctggtggccttcctgcaggccctggagaaggaggtggccatcatcgtggaccagagagcctggaacctgcaccagaagatcgtggaggacgccgtggagcagggcgtgctgaagacccagatccccatcctgacctaccagggcggcagcgtggaggccgcccaggccttcctgtgcaagaacggcgacccccagacccccagattcgaccacctggtggccatcgagagagccggcagagccgccgacggcaactactacaacgccagaaagatgaacatcaagcacctggtggaccccatcgacgacctgttcctggccgccaagaagatccccggcatcagcagcaccggcgtgggcgacggcggcaacgagctgggcatgggcaaggtgaaggaggccgtgagaagacacatcagacacggcgacgtgatcgcctgcgacgtggaggccgacttcgccgtgatcgccggcgtgagcaactggggcggctacgccctggcctgcgccctgtacatcctgtacagctgcgccgtgcacagccagtacctgagaaaggccgtgggccccagcagagcccccggcgaccaggcctggacccaggccctgcccagcgtgatcaaggaggagaagatgctgggcatcctggtgcagcacaaggtgagaagcggcgtgagcggcatcgtgggcatggaggtggacggcctgcccttccacaacacccacgccgagatgatccagaagctggtggacgtgaccaccgcccaggtgtag

SEQ ID NO: 17162 - DNA, 198 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgtag

SEQ ID NO: 17163 - DNA, 1296 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagcgagaccagaatgggccacccccagttctggaagtacgagttcggcgcctgcaccggcagcctggccagcctggagcagtacagcgagcagctgaaggacatggtggccttcttcctgggctgcagcttcagcctggaggaggccctggagaaggccggcctgcccagaagagaccccgccggccacagccaggccggcgcctacaagaccaccgtgccctgcgtgacccacgccggcttctgctgccccctggtggtgaccatgagacccatccccaaggacaagctggagggcctggtgagagcctgctgcagcctgggcggcgagcagggccagcccgtgcacatgggcgaccccgagctgctgggcatcaaggagctgagcaagcccgcctacggcgacgccatggtgtgcccccccggcgaggtgcccgtgttctggcccagccccctgaccagcctgggcgccgtgagcagctgcgagacccccctggccttcgccagcatccccggctgcaccgtgatgaccgacctgaaggacgccaaggccccccccggctgcctgacccccgagagaatccccgaggtgcaccacatcagccaggaccccctgcactacagcatcgccagcgtgagcgccagccagaagatcagagagctggagagcatgatcggcatcgaccccggcaacagaggcatcggccacctgctgtgcaaggacgagctgctgaaggccagcctgagcctgagccacgccagaagcgtgctgatcaccaccggcttccccacccacttcaaccacgagccccccgaggagaccgacggcccccccggcgccgtggccctggtggccttcctgcaggccctggagaaggaggtggccatcatcgtggaccagagagcctggaacctgcaccagaagatcgtggaggacgccgtggagcagggcgtgctgaagacccagatccccatcctgacctaccagggcggcagcgtggaggccgcccaggccttcctgtgcaagaacggcgacccccagaccccctag

SEQ ID NO: 17164 - DNA, 480 bp, Artificial Sequence; identical to SEQ ID NO: 17159
  Description of Artificial Sequence: Synthetic coding sequence

SEQ ID NO: 17165 - DNA, 1866 bp, Artificial Sequence; identical to SEQ ID NO: 17158
  Description of Artificial Sequence: Synthetic coding sequence

SEQ ID NO: 17166 - DNA, 330 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagcgagaccagaatgggccacccccagttctggaagtacgagttcggcgcctgcaccggcagcctggccagcctggagcagtag

SEQ ID NO: 17167 - DNA, 606 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagcgagaccagaatgggccacccccagttctggaagtacgagttcggcgcctgcaccggcagcctggccagcctggagcagtacagcgagcagctgaaggacatggtggccttcttcctgggctgcagcttcagcctggaggaggccctggagaaggccggcctgcccagaagagaccccgccggccacagccaggccggcgcctacaagaccaccgtgccctgcgtgacccacgccggcttctgctgccccctggtggtgaccatgagacccatccccaaggacaagctggagggcctggtgagagcctgctgcagcctgggcggcgagcagggccagcccgtgcacatgggcgactag

SEQ ID NO: 17168 - DNA, 1695 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagcgagaccagaatgggccacccccagttctggaagtacgagttcggcgcctgcaccggcagcctggccagcctggagcagtacagcgagcagctgaaggacatggtggccttcttcctgggctgcagcttcagcctggaggaggccctggagaaggccggcctgcccagaagagaccccgccggccacagccagaccaccgtgccctgcgtgacccacgccggcttctgctgccccctggtggtgaccatgagacccatccccaaggacaagctggagggcctggtgagagcctgctgcagcctgggcgagctgctgggcatcaaggagctgagcaagcccgcctacggcgacgccatggtgtgcccccccggcgaggtgcccgtgttctggcccagccccctgaccagcctgggcgccgtgagcagctgcgagacccccctggccttcgccagcatccccggctgcaccgtgatgaccgacctgaaggacgccaaggccccccccggctgcctgacccccgagagaatccccgaggtgcaccacatcagccaggaccccctgcactacagcatcgccagcgtgagcgccagccagaagatcagagagctggagagcatgatcggcatcgaccccggcaacagaggcatcggccacctgctgtgcaaggacgagctgctgaaggccagcctgagcctgagccacgccagaagcgtgctgatcaccaccggcttccccacccacttcaaccacgagccccccgaggagaccgacggcccccccggcgccgtggccctggtggccttcctgcaggccctggagaaggaggtggccatcatcgtggaccagagagcctggaacctgcaccagaagatcgtggaggacgccgtggagcagggcgtgctgaagacccagatccccatcctgacctaccagggcggcagcgtggaggccgcccaggccttcctgtgcaagaacggcgacccccagacccccagattcgaccacctggtggccatcgagagagccggcagagccgccgacggcaactactacaacgccagaaagatgaacatcaagcacctggtggaccccatcgacgacctgttcctggccgccaagaagatccccggcatcagcagcaccggcgtgagcaactggggcggctacgccctggcctgcgccctgtacatcctgtacagctgcgccgtgcacagccagtacctgagaaaggccgtgggccccagcagagcccccggcgaccaggcctggacccaggccctgcccagcgtgatcaaggaggagaagatgctgggcatcctggtgcagcacaaggtgagaagcggcgtgagcggcatcgtgggcatggaggtggacggcctgcccttccacaacacccacgccgagatgatccagaagctggtggacgtgaccaccgcccaggtgtag

SEQ ID NO: 17169 - DNA, 378 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagcgagaccagaatgggccacccccagttctggaagtacgagttcggcgcctgcaccggcagcctggccagcctggagcagtacagcgagcagctgaaggacatggtggccttcttcctgggctgcagctag

SEQ ID NO: 17170 - DNA, 1746 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagcgagaccagaatgggccacccccagttctggaagtacgagttcggcgcctgcaccggcagcctggccagcctggagcagtacagcgagcagctgaaggacatggtggccttcttcctgggctgcagcttcagcctggaggaggccctggagaaggccggcctgcccagaagagaccccgccggccacagccaggccggcgcctacaagaccaccgtgccctgcgtgacccacgccggcttctgctgccccctggtggtgaccatgagacccatccccaaggacaagctggagggcctggtgagagcctgctgcagcctgggcggcgagcagggccagcccgtgcacatgggcgaccccgagctgctgggcatcaaggagctgagcaagcccgcctacggcgacgccatggtgtgcccccccggcgaggtgcccgtgttctggcccagccccctgaccagcctgggcgccgtgagcagctgcgagacccccctggccttcgccagcatccccggctgcaccgtgatgaccgacctgaaggacgccaaggccccccccggctgcctgacccccgagagaatccccgaggtgcaccacatcagccaggaccccctgcactacagcatcgccagcgtgagcgccagccagaagatcagagagctggagagcatgatcggcatcgaccccggcaacagaggcatcggccacctgctgtgcaaggacgagctgctgaaggccagcctgagcctgagccacgccagaagcgtgctgatcaccaccggcttccccacccacttcaaccacgagccccccgaggagaccgacggcccccccggcgccgtggccctggtggccttcctgcaggccctggagaaggaggtggccatcatcgtggaccagagagcctggaacctgcaccagaagatcgtggaggacgccgtggagcagggcgtgctgaagacccagatccccatcctgacctaccagggcggcagcgtggaggccgcccaggccttcctgtgcaagaacggcgacccccagacccccagattcgaccacctggtggccatcgagagagccggcagagccgccgacggcaactactacaacgccagaaagatgaacatcaagcacctggtggaccccatcgacgacctgttcctggccgccaagaagatccccggcatcagcagcaccggcgtgagcaactggggcggctacgccctggcctgcgccctgtacatcctgtacagctgcgccgtgcacagccagtacctgagaaaggccgtgggccccagcagagcccccggcgaccaggcctggacccaggccctgcccagcgtgatcaaggaggagaagatgctgggcatcctggtgcagcacaaggtgagaagcggcgtgagcggcatcgtgggcatggaggtggacggcctgcccttccacaacacccacgccgagatgatccagaagctggtggacgtgaccaccgcccaggtgtag

SEQ ID NO: 17171 - DNA, 78 bp, Artificial Sequence
  Description of Artificial Sequence: Synthetic coding sequence
atgcccttcaccctgcacctgagaagcagactgcccagcgccatcagaagcctgatcctgcagaagaagcccaactag

SEQ ID NO: 17172 - DNA, 459 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagcgagaccagaatgggccacccccagttctggaagtacgagttcggcgcctgcaccggcagcctggccagcctggagcagtacagcgagcagctgaaggacatggtggccttcttcctgggctgcagcttcagcctggaggaggccctggagaaggccggcctgcccagaagagaccccgccggccacagccaggccggcgcctacaagtag

SEQ ID NO: 17173 - DNA, 609 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagcgagaccagaatgggccacccccagttctggaagtacgagttcggcgcctgcaccggcagcctggccagcctggagcagtacagcgagcagctgaaggacatggtggccttcttcctgggctgcagcttcagcctggaggaggccctggagaaggccggcctgcccagaagagaccccgccggccacagccaggccggcgcctacaagaccaccgtgccctgcgtgacccacgccggcttctgctgccccctggtggtgaccatgagacccatccccaaggacaagctggagggcctggtgagagcctgctgcagcctgggcggcgagcagggccagcccgtgcacatgggcgacccctag

SEQ ID NO: 17174 - DNA, 1851 bp, Artificial Sequence; identical to SEQ ID NO: 17161
  Description of Artificial Sequence: Synthetic coding sequence

SEQ ID NO: 17175 - DNA, 258 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagcgagacctag

SEQ ID NO: 17176 - DNA, 1851 bp, Artificial Sequence; identical to SEQ ID NO: 17161
  Description of Artificial Sequence: Synthetic coding sequence

SEQ ID NO: 17177 - DNA, 1851 bp, Artificial Sequence; identical to SEQ ID NO: 17161
  Description of Artificial Sequence: Synthetic coding sequence

SEQ ID NO: 17178 - DNA, 252 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttcgagagattctgccaggtgaacaccggccccctgcccctgctgggccagagcgagcccgagaagtggatgctgcccccccagggcgccatcagctag

SEQ ID NO: 17179 - DNA, 459 bp, Artificial Sequence; identical to SEQ ID NO: 17172
  Description of Artificial Sequence: Synthetic coding sequence

SEQ ID NO: 17180 - DNA, 159 bp, Artificial Sequence
  Description of Artificial Sequence: Synthetic coding sequence
atgcccttcaccctgcacctgagaagcagactgcccagcgccatcagaagcctgatcctgcagaagaagcccaacatcagaaacaccagcagcatggccggcgagctgagacccgccagcctggtggtgctgcccagaagcctggcccccgccttctag

SEQ ID NO: 17181 - DNA, 1479 bp, Artificial Sequence
  Description of Artificial Sequence: Synthetic coding sequence
atggtggccttcttcctgggctgcagcttcagcctggaggaggccctggagaaggccggcgcctacaagaccaccgtgccctgcgtgacccacgccggcttctgctgccccctggtggtgaccatgagacccatccccaaggacaagctggagggcctggtgagagcctgctgcagcctgggcggcgagcagggccagcccgtgcacatgggcgaccccgagctgctgggcatcaaggagctgagcaagcccgcctacggcgacgccatggtgtgcccccccggcgaggtgcccgtgttctggcccagccccctgaccagcctgggcgccgtgagcagctgcgagacccccctggccttcgccagcatccccggctgcaccgtgatgaccgacctgaaggacgccaaggccccccccggctgcctgacccccgagagaatccccgaggtgcaccacatcagccaggaccccctgcactacagcatcgccagcgtgagcgccagccagaagatcagagagctggagagcatgatcggcatcgaccccggcaacagaggcatcggccacctgctgtgcaaggacgagctgctgaaggccagcctgagcctgagccacgccagaagcgtgctgatcaccaccggcttccccacccacttcaaccacgagccccccgaggagaccgacggcccccccggcgccgtggccctggtggccttcctgcaggccctggagaaggaggtggccatcatcgtggaccagagagcctggaacctgcaccagaagatcgtggaggacgccgtggagcagggcgtgctgaagacccagatccccatcctgacctaccagggcggcagcgtggaggccgcccaggccttcctgtgcaagaacggcgacccccagacccccagattcgaccacctggtggccatcgagagagccggcagagccgccgacggcaactactacaacgccagaaagatgaacatcaagcacctggtggaccccatcgacgacctgttcctggccgccaagaagatccccggcatcagcagcaccggcgtgggcgacggcggcaacgagctgggcatgggcaaggtgaaggaggccgtgagaagacacatcagacacggcgacgtgatcgcctgcgacgtggaggccgacttcgccgtgatcgccggcgtgagcaactggggcggctacgccctggcctgcgccctgtacatcctgtacagctgcgccgtgcacagccagtacctgagaaaggccgtgggccccagcagagcccccggcgaccaggcctggacccaggccctgcccagcgtgatcaaggaggagaagatgctgggcatcctggtgcagcacaaggtgagaagcggcgtgagcggcatcgtgggcatggaggtggacggcctgcccttccacaacacccacgccgagatgatccagaagctggtggacgtgaccaccgcccaggtgtag

SEQ ID NO: 17182 - DNA, 483 bp, Artificial Sequence
  Description of Artificial Sequence: Synthetic coding sequence
atgagaaccgccgccggcgccgtgagccccgacagcagacccgagaccagaagacagaccagaaagaacgaggaggccgcctggggccccagagtgtgcagagccgagagagaggacaacagaaagtgcccccccagcatcctgaagagaagcagacccgagcaccacagacccgaggccaagccccagagaaccagcagaagagtgtggttcagagagccccccgccgtgaccgtgcactacatcgccgacaagaacgccaccgccaccgtgagagtgcccggcagacccagaccccacggcggcagcctgctgctgcagctgtgcgtgtgcgtgctgctggtgctggccctgggcctgtactgcggcagagccaagcccgtggccaccgccctggaggacctgagagccagactgctgggcctggtgctgcacctgagacacgtggccctgacctgctggagaggcctgctgagactgtag

SEQ ID NO: 17183 - DNA, 483 bp, Artificial Sequence; identical to SEQ ID NO: 17182
  Description of Artificial Sequence: Synthetic coding sequence

SEQ ID NO: 17184 - DNA, 2325 bp, Artificial Sequence
  Description of Artificial Sequence: Synthetic coding sequence
atgagaggccccatcgtgctgcacatctgcctggccttctgcagcctgctgctgttcagcgtggccacccagtgcctggccttccccaagatcgagagaagaagagagatcgcccacgtgcacgccgagaagggccagagcgacaagatgaacaccgacgacctggagaacagcagcgtgaccagcaagcagaccccccagctggtggtgagcgaggaccccatgatgatgagcgccgtgcccagcgccaccagcctgaacaaggccttcagcatcaacaaggagacccagcccggccaggccggcctgatgcagaccgagagacccggcgtgagcacccccaccgagagcggcgtgcccagcgccgaggaggtgttcggcagcagccagcccgagagaatcagccccgagagcggcctggccaaggccatgctgaccatcgccatcaccgccacccccagcctgaccgtggacgagaaggaggagctgctgaccagcaccaacttccagcccatcgtggaggagatcaccgagaccaccaagggcttcctgaagtacatggacaaccagagcttcgccaccgagagccaggagggcgtgggcctgggccacagccccagcagctacgtgaacaccaaggagatgctgaccaccaaccccaagaccgagaagttcgaggccgacaccgaccacagaaccaccagcttccccggcgccgagagcaccgccggcagcgagcccggcagcctgacccccgacaaggagaagcccagccagatgaccgccgacaacacccaggccgccgccaccaagcagcccctggagaccagcgagtacaccctgagcgtggagcccgagaccgacagcctgctgggcgcccccgaggtgaccgtgagcgtgagcaccgccgtgcccgccgccagcgccctgagcgacgagtgggacgacaccaagctggagagcgtgagcagaatcagaacccccaagctgggcgacaacgaggagacccaggtgagaaccgagatgagccagaccgcccaggtgagccacgagggcatggagggcggccagccctggaccgaggccgcccaggtggccctgggcctgcccgagggcgagacccacaccggcaccgccctgctgatcgcccacggcaacgagagaagccccgccttcaccgaccagagcagcttcacccccaccagcctgatggaggacatgaaggtgagcatcgtgaacctgctgcagagcaccggcgacttcaccgagagcaccaaggagaacgacgccctgttcttcctggagaccaccgtgagcgtgagcgtgtacgagagcgaggccgaccagctgctgggcaacaccatgaaggacatcatcacccaggagatgaccaccgccgtgcaggagcccgacgccaccctgagcatggtgacccaggagcaggtggccaccctggagctgatcagagacagcggcaagaccgaggaggagaaggaggaccccagccccgtgagcgacgtgcccggcgtgacccagctgagcagaagatgggagcccctggccaccaccatcagcaccaccgtggtgcccctgagcttcgaggtgacccccaccgtggaggagcagatggacaccgtgaccggccccaacgaggagttcacccccgtgctgggcagccccgtgaccccccccggcatcatggtgggcgagcccagcatcagccccgccctgcccgccctggaggccagcagcgagagaagaaccgtggtgcccagcatcaccagagtgaacaccgccgccagctacggcctggaccagctggagagcgaggagggccaggaggacgaggacgaggaggacgaggaggacgaggacgaggaggaggaggacgaggaggaggacgaggaggacaaggacgccgacagcctggacgagggcctggacggcgacaccgagctgcccggcttcaccctgcccggcatcaccagccaggagcccggcctggaggagggcaacatggacctgctggagggcgccacctaccaggtgcccgacgccctggagtgggagcagcagaaccagggcctggtgagaagctggatggagaagctgaaggacaaggccggctacatgagcggcatgctggtgcccgtgggcgtgggcatcgccggcgccctgttcatcctgggcgccctgtacagcatcaaggtgatgaacagaagaagaagaaacggcttcaagagacacaagagaaagcagagagagttcaacagcatgcaggacagagtgatgctgctggccgacagcagcgaggacgagttctag

SEQ ID NO: 17185 - DNA, 729 bp, Artificial Sequence
  Description of Artificial Sequence: Synthetic coding sequence
atggccgccgccctgtggggcttcttccccgtgctgctgctgctgctgctgagcggcgacgtgcagagcagcgaggtgcccggcgccgccgccgagggcagcggcggcagcggcgtgggcatcggcgacagattcaagatcgagggcagagccgtggtgcccggcgtgaagccccaggactggatcagcgccgccagagtgctggtggacggcgaggagcacgtgggcttcctgaagaccgacggcagcttcgtggtgcacgacatccccagcggcagctacgtggtggaggtggtgagccccgcctacagattcgaccccgtgagagtggacatcaccagcaagggcaagatgagagccagatacgtgaactacatcaagaccagcgaggtggtgagactgccctaccccctgcagatgaagagcagcggcccccccagctacttcatcaagagagagagctggggctggaccgacttcctgatgaaccccatggtgatgatgatggtgctgcccctgctgatcttcgtgctgctgcccaaggtggtgaacaccagcgaccccgacatgagaagagagatggagcagagcatgaacatgctgaacagcaaccacgagctgcccgacgtgagcgagttcatgaccagactgttcagcagcaagagcagcggcaagagcagcagcggcagcagcaagaccggcaagagcggcgccggcaagagaagatag

SEQ ID NO: 17186 - DNA, 1596 bp, Artificial Sequence
  Description of Artificial Sequence: Synthetic coding sequence
atggccgtggcccccagcttcaacatgaccaacccccagcccgccatcgagggcggcatcagcgaggtggagatcatcagccagcaggtggacgaggagaccaagagcatcgcccccgtgcagctggtgaacttcgcctacagagacctgcccctggccgccgtggacctgagcaccgccggcagccagctgctgagcaacctggacgaggactaccagagagagggcagcaactggctgaagccctgctgcggcaagagagccgccgtgtggcaggtgttcctgctgagcgccagcctgaacagcttcctggtggcctgcgtgatcctggtggtgatcctgctgaccctggagctgctgatcgacatcaagctgctgcagttcagcagcgccttccagttcgccggcgtgatccactggatcagcctggtgatcctgagcgtgttcttcagcgagaccgtgctgagaatcgtggtgctgggcatctgggactacatcgagaacaagatcgaggtgttcgacggcgccgtgatcatcctgagcctggcccccatggtggccagcaccgtggccaacggccccagaagcccctgggacgccatcagcctgatcatcatgctgagaatctggagagtgaagagagtgatcgacgcctacgtgctgcccgtgaagctggagatggagatggtgatccagcagtacgagaaggccaaggtgatccaggacgagcagctggagagactgacccagatctgccaggagcagggcttcgagatcagacagctgagagcccacctggcccagcaggacctggacctggccgccgagagagaggccgccctgcaggccccccacgtgctgagccagcccagaagcagattcaaggtgctggaggccggcacctgggacgaggagaccgccgccgagagcgtggtggaggagctgcagcccagccaggaggccaccatgaaggacgacatgaacagctacatcagccagtactacaacggccccagcagcgacagcggcgtgcccgagcccgccgtgtgcatggtgaccaccgccgccatcgacatccaccagcccaacatcagcagcgacctgttcagcctggacatgcccctgaagctgggcggcaacggcaccagcgccaccagcgagagcgccagcagaagcagcgtgaccagagcccagagcgacagcagccagaccctgggcagcagcatggactgcagcaccgccagagaggagcccagcagcgagcccggccccagccccccccccctgcccagccagcagcaggtggaggaggccaccgtgcaggacctgctgagcagcctgagcgaggacccctgccccagccagaaggccctggaccccgcccccctggccagacccagccccgccggcagcgcccagaccagccccgagctggagcacagagtgagcctgttcaaccagaagaaccaggagggcttcaccgtgttccagatcagacccgtgatccacttccagcccaccgtgcccatgctggaggacaagttcagaagcctggagagcaaggagcagaagctgcacagagtgcccgaggcctag

SEQ ID NO: 17187 - DNA, 252 bp, Artificial Sequence
  Description of Artificial Sequence: Synthetic coding sequence
atgagcttcttccagctgctgatgaagagaaaggagctgatccccctggtggtgttcatgaccgtggccgccggcggcgccagcagcttcgccgtgtacagcctgtggaagaccgacgtgatcctggacagaaagaagaaccccgagccctgggagaccgtggaccccaccgtgccccagaagctgatcaccatcaaccagcagtggaagcccatcgaggagctgcagaacgtgcagagagtgaccaagtag

SEQ ID NO: 17188 - DNA, 252 bp, Artificial Sequence; identical to SEQ ID NO: 17187
  Description of Artificial Sequence: Synthetic coding sequence

SEQ ID NO: 17189 - DNA, 528 bp, Artificial Sequence
  Description of Artificial Sequence: Synthetic coding sequence
atggagacctggagaaagggcagcttcagaaacgccagcttcttcaagcagctgagcctgggcagacccagaagactgagaagacagagcagcgtgctgagccaggccagcaccgccggcggcgaccacgaggagtacagcaacagagaggtgatcagagagctgcagggcagacccgacggcagaagactgcccctgtggggcgacgagcagcccagagccaccctgctggccccccccaagccccccagactgtacagagagagcagcagctgccccaacatcctggagcccccccccgcctacaccgccgcctacagcgccaccctgcccagcgccctgagcctgagcagcgccctgcaccagcacagcgagaagggcctggtggacaccccctgcttccagagaacccccacccccgacctgagcgaccccttcctgagcttcaaggtggacctgggcatcagcctgctggaggaggtgctgcagatgctgagagagcagttccccagcgagcccagcttctag

SEQ ID NO: 17190 - DNA, 528 bp, Artificial Sequence; identical to SEQ ID NO: 17189
  Description of Artificial Sequence: Synthetic coding sequence

SEQ ID NO: 17191 - DNA, 675 bp, Artificial Sequence
  Description of Artificial Sequence: Synthetic coding sequence
atgcccctgacccccgagccccccagcggcagagtggagggcccccccgcctgggaggccgccccctggcccagcctgccctgcggcccctgcatccccatcatgctggtgctggccaccctggccgccctgttcatcctgaccaccgccgtgctggccgagagactgttcagaagagccctgagacccgaccccagccacagagcccccaccctggtgtggagacccggcggcgagctgtggatcgagcccatgggcaccgccagagagagaagcgaggactggtacggcagcgccgtgcccctgctgaccgacagagcccccgagccccccacccaggtgggcaccctggaggccagagccaccgccccccccgcccccagcgcccccaacagcgcccccagcaacctgggcccccagaccgtgctggaggtgcccgccagaagcaccttctggggcccccagccctgggagggcagaccccccgccaccggcctggtgagctgggccgagcccgagcagagacccgaggccagcgtgcagttcggcagcccccaggccagaagacagagacccggcagccccgaccccgagtggggcctgcagcccagagtgaccctggagcagatcagcgccttctggaagagagagggcagaaccagcgtgggcttctag

SEQ ID NO: 17192 - DNA, 1407 bp, Artificial Sequence
  Description of Artificial Sequence: Synthetic coding sequence
atggccgacgacgccggcctggagacccccctgtgcagcgagcagttcggcagcggcgaggccagaggctgcagagccgccgccgacggcagcctgcagtgggaggtgggcggctggagatggtggggcctgagcagagccttcaccgtgaagcccgagggcagagacgccggcgaggtgggcgccagcggcgcccccagcccccccctgagcggcctgcaggccgtgttcctgccccagggcttccccgacagcgtgagccccgactacctgccctaccagctgtgggacagcgtgcaggccttcgccagcagcctgagcggcagcctggccacccaggccgtgctgctgggcatcggcgtgggcaacgccaaggccaccgtgagcgccgccaccgccacctggctggtgaaggacagcaccggcatgctgggcagaatcgtgttcgcctggtggaagggcagcaagctggactgcaacgccaagcagtggagactgttcgccgacatcctgaacgacgtggccatgttcctggagatcatggcccccgtgtaccccatctgcttcaccatgaccgtgagcaccagcaacctggccaagtgcatcgtgagcgtggccggcggcgccaccagagccgccctgaccgtgcaccaggccagaagaaacaacatggccgacgtgagcgccaaggacagcagccaggagaccctggtgaacctggccggcctgctggtgagcctgctgatgctgcccctggtgagcggctgccccggcttcagcctgggctgcttcttcttcctgaccgccctgcacatctacgccaactacagagccgtgagagccctggtgatggagaccctgaacgagggcagactgagactggtgctgaagcactacctgcagagaggcgaggtgctggaccccaccgccgccaacagaatggagcccctgtggaccggcttctggcccgcccccagcctgagcctgggcgtgcccctgcacagactggtgagcagcgtgttcgagctgcagcagctggtggagggccaccaggagagctacctgctgtgctgggaccagagccagaaccaggtgcaggtggtgctgaaccagaaggccggccccaagaccatcctgagagccgccacccacggcctgatgctgggcgccctgcagggcgacggccccctgcccgccgagctggaggagctgagaaacagagtgagagccggccccaagaaggagagctgggtggtggtgaaggagacccacgaggtgctggacatgctgttccccaagttcctgaagggcctgcaggacgccggctggaagaccgagaagcaccagctggaggtggacgagtggagagccacctggctgctgagccccgagaagaaggtgctgtag

SEQ ID NO: 17193 - DNA, 585 bp, Artificial Sequence
  Description of Artificial Sequence: Synthetic coding sequence
atgctgggcagaatcgtgttcgcctggtggaagggcagcaagctggactgcaacgccaagcagtggagactgttcgccgacatcctgaacgacgtggccatgttcctggagatcatggcccccgtgtaccccatctgcttcaccatgaccgtgagcaccagcaacctggccaagtgcatcgtgagcgtggccggcggcgccaccagagccgccctgaccgtgcaccaggccagaagaaacaacatggccgacgtgagcgccaaggacagcagccaggagaccctggtgaacctggccggcctgctggtgagcctgctgatgctgcccctggtgagcggctgccccggcttcagcctgggctgcttcttcttcctgaccgccctgcacatctacgccaactacagagccgtgagagccctggtgatggagaccctgaacgagggcagactgagactggtgctgaagcactacctgcagagaggcgaggtgctggaccccaccgccgccaacagaatggagcccctgtggaccggcgaccccgcccccggcctgggcagctgcgtgagcaccagccccaccgcctag

SEQ ID NO: 17194 - DNA, 1269 bp, Artificial Sequence
  Description of Artificial Sequence: Synthetic coding sequence
atggccgacgacgccggcctggagacccccctgtgcagcgagcagttcggcagcggcgaggccagaggctgcagagccgccgccgacggcagcctgccccagggcttccccgacagcgtgagccccgactacctgccctaccagctgtgggacagcgtgcaggccttcgccagcagcctgagcggcagcctggccacccaggccgtgctgctgggcatcggcgtgggcaacgccaaggccaccgtgagcgccgccaccgccacctggctggtgaaggacagcaccggcatgctgggcagaatcgtgttcgcctggtggaagggcagcaagctggactgcaacgccaagcagtggagactgttcgccgacatcctgaacgacgtggccatgttcctggagatcatggcccccgtgtaccccatctgcttcaccatgaccgtgagcaccagcaacctggccaagtgcatcgtgagcgtggccggcggcgccaccagagccgccctgaccgtgcaccaggccagaagaaacaacatggccgacgtgagcgccaaggacagcagccaggagaccctggtgaacctggccggcctgctggtgagcctgctgatgctgcccctggtgagcggctgccccggcttcagcctgggctgcttcttcttcctgaccgccctgcacatctacgccaactacagagccgtgagagccctggtgatggagaccctgaacgagggcagactgagactggtgctgaagcactacctgcagagaggcgaggtgctggaccccaccgccgccaacagaatggagcccctgtggaccggcttctggcccgcccccagcctgagcctgggcgtgcccctgcacagactggtgagcagcgtgttcgagctgcagcagctggtggagggccaccaggagagctacctgctgtgctgggaccagagccagaaccaggtgcaggtggtgctgaaccagaaggccggccccaagaccatcctgagagccgccacccacggcctgatgctgggcgccctgcagggcgacggccccctgcccgccgagctggaggagctgagaaacagagtgagagccggccccaagaaggagagctgggtggtggtgaaggagacccacgaggtgctggacatgctgttccccaagttcctgaagggcctgcaggacgccggctggaagaccgagaagcaccagctggaggtggacgagtggagagccacctggctgctgagccccgagaagaaggtgctgtag

SEQ ID NO: 17195 - DNA, 471 bp, Artificial Sequence
  Description of Artificial Sequence: Synthetic coding sequence
atggccgacgacgccggcctggagacccccctgtgcagcgagcagttcggcagcggcgaggccagaggctgcagagccgccgccgacggcagcctgcagtgggaggtgggcggctggagatggtggggcctgagcagagccttcaccgtgaagcccgagggcagagacgccggcgaggtgggcgccagcggcgcccccagcccccccctgagcggcctgcaggccgtgttcctgccccagggcttccccgacagcgtgagccccgactacctgccctaccagctgtgggacagcgtgcaggccttcgccagcagcctgagcggcagcctggccacccaggccgtgctgctgggcatcggcgtgggcaacgccaaggccaccgtgagcgccgccaccgccacctggctggtgaaggacagcaccggcatgctgggcagaatcgtgttcgcctggtggaagggcgccagctag

SEQ ID NO: 17196 - DNA, 2892 bp, Artificial Sequence
  Description of Artificial Sequence: Synthetic coding sequence
atggccgtgttcccctggcacagcagaaacagaaactacaaggccgagttcgccagctgcagactggaggccgtgcccctggagttcggcgactaccaccccctgaagcccatcaccgtgaccgagagcaagaccaagaaggtgaacagaaagggcagcaccagcagcaccagcagcagcagcagcagcagcgtggtggaccccctgagcagcgtgctggacggcaccgaccccctgagcatgttcgccgccaccgccgaccccgccgccctggccgccgccatggacagcagcagaagaaagagagacagagacgacaacagcgtggtgggcagcgacttcgagccctggaccaacaagagaggcgagatcctggccagatacaccaccaccgagaagctgagcatcaacctgttcatgggcagcgagaagggcaaggccggcaccgccaccctggccatgagcgagaaggtgagaaccagactggaggagctggacgacttcgaggagggcagccagaaggagctgctgaacctgacccagcaggactacgtgaacagaatcgaggagctgaaccagagcctgaaggacgcctgggccagcgaccagaaggtgaaggccctgaagatcgtgatccagtgcagcaagctgctgagcgacaccagcgtgatccagttctaccccagcaagttcgtgctgatcaccgacatcctggacaccttcggcaagctggtgtacgagagaatcttcagcatgtgcgtggacagcagaagcgtgctgcccgaccacttcagccccgagaacgccaacgacaccgccaaggagacctgcctgaactggttcttcaagatcgccagcatcagagagctgatccccagattctacgtggaggccagcatcctgaagtgcaacaagttcctgagcaagaccggcatcagcgagtgcctgcccagactgacctgcatgatcagaggcatcggcgaccccctggtgagcgtgtacgccagagcctacctgtgcagagtgggcatggaggtggccccccacctgaaggagaccctgaacaagaacttcttcgacttcctgctgaccttcaagcagatccacggcgacaccgtgcagaaccagctggtggtgcagggcgtggagctgcccagctacctgcccctgtacccccccgccatggactggatcttccagtgcatcagctaccacgcccccgaggccctgctgaccgagatgatggagagatgcaagaagctgggcaacaacgccctgctgctgaacagcgtgatgagcgccttcagagccgagttcatcgccaccagaagcatggacttcatcggcatgatcaaggagtgcgacgagagcggcttccccaagcacctgctgttcagaagcctgggcctgaacctggccctggccgacccccccgagagcgacagactgcagatcctgaacgaggcctggaaggtgatcaccaagctgaagaacccccaggactacatcaactgcgccgaggtgtgggtggagtacacctgcaagcacttcaccaagagagaggtgaacaccgtgctggccgacgtgatcaagcacatgacccccgacagagccttcgaggacagctacccccagctgcagctgatcatcaagaaggtgatcgcccacttccacgacttcagcgtgctgttcagcgtggagaagttcctgcccttcctggacatgttccagaaggagagcgtgagagtggaggtgtgcaagtgcatcatggacgccttcatcaagcaccagcaggagcccaccaaggaccccgtgatcctgaacgccctgctgcacgtgtgcaagaccatgcacgacagcgtgaacgccctgaccctggaggacgagaagagaatgctgagctacctgatcaacggcttcatcaagatggtgagcttcggcagagacttcgagcagcagctgagcttctacgtggagagcagaagcatgttctgcaacctggagcccgtgctggtgcagctgatccacagcgtgaacagactggccatggagaccagaaaggtgatgaagggcaaccacagcagaaagaccgccgccttcgtgagagcctgcgtggcctactgcttcatcaccatccccagcctggccggcatcttcaccagactgaacctgtacctgcacagcggccaggtggccctggccaaccagtgcctgagccaggccgacgccttcttcaaggccgccatcagcctggtgcccgaggtgcccaagatgatcaacatcgacggcaagatgagacccagcgagagcttcctgctggagttcctgtgcaacttcttcagcaccctgctgatcgtgcccgaccaccccgagcacggcgtgctgttcctggtgagagagctgctgaacgtgatccaggactacacctgggaggacaacagcgacgagaagatcagaatctacacctgcgtgctgcacctgctgagcgccatgagccaggagacctacctgtaccacatcgacaaggtggacagcaacgacagcctgtacggcggcgacagcaagttcctggccgagaacaacaagctgtgcgagaccgtgatggcccagatcctggagcacctgaagaccctggccaaggacgaggccctgaagagacagagcagcctgggcctgagcttcttcaacagcatcctggcccacggcgacctgagaaacaacaagctgaaccagctgagcgtgaacctgtggcacctggcccagagacacggctgcgccgacaccagaaccatggtgaagaccctggagtacatcaagaagcagagcaagcagcccgacatgacccacctgaccgagctggccctgagactgcccctgcagaccagaacctag

SEQ ID NO: 17197 - DNA, 2613 bp, Artificial Sequence
  Description of Artificial Sequence: Synthetic coding sequence
atggccgtgttcccctggcacagcagaaacagaaactacaaggccgagttcgccagctgcagactggaggccgtgcccctggagttcggcgactaccaccccctgaagcccatcaccgtgaccgagagcaagaccaagaaggtgaacagaaagggcagcaccagcagcaccagcagcagcagcagcagcagcgtggtggaccccctgagcagcgtgctggacggcaccgaccccctgagcatgttcgccgccaccgccgaccccgccgccctggccgccgccatggacagcagcagaagaaagagagacagagacgacaacagcgtggtgggcagcgacttcgagccctggaccaacaagagaggcgagatcctggccagatacaccaccaccgagaagctgagcatcaacctgttcatgggcagcgagaagggcaaggccggcaccgccaccctggccatgagcgagaaggtgagaaccagactggaggagctggacgacttcgaggagggcagccagaaggagctgctgaacctgacccagcaggactacgtgaacagaatcgaggagctgaaccagagcctgaaggacgcctgggccagcgaccagaaggtgaaggccctgaagatcgtgatccagtgcagcaagctgctgagcgacaccagcgtgatccagttctaccccagcaagttcgtgctgatcaccgacatcctggacaccttcggcaagctggtgtacgagagaatcttcagcatgtgcgtggacagcagaagcgtgctgcccgaccacttcagccccgagaacgccaacgacaccgccaaggagacctgcctgaactggttcttcaagatcgccagcatcagagagctgatccccagattctacgtggaggccagcatcctgaagtgcaacaagttcctgagcaagaccggcatcagcgagtgcctgcccagactgacctgcatgatcagaggcatcggcgaccccctggtgagcgtgtacgccagagcctacctgtgcagagccctgctgaccgagatgatggagagatgcaagaagctgggcaacaacgccctgctgctgaacagcgtgatgagcgccttcagagccgagttcatcgccaccagaagcatggacttcatcggcatgatcaaggagtgcgacgagagcggcttccccaagcacctgctgttcagaagcctgggcctgaacctggccctggccgacccccccgagagcgacagactgcagatcctgaacgaggcctggaaggtgatcaccaagctgaagaacccccaggactacatcaactgcgccgaggtgtgggtggagtacacctgcaagcacttcaccaagagagaggtgaacaccgtgctggccgacgtgatcaagcacatgacccccgacagagccttcgaggacagctacccccagctgcagctgatcatcaagaaggtgatcgcccacttccacgacttcagcgtgctgttcagcgtggagaagttcctgcccttcctggacatgttccagaaggagagcgtgagagtggaggtgtgcaagtgcatcatggacgccttcatcaagcaccagcaggagcccaccaaggaccccgtgatcctgaacgccctgctgcacgtgtgcaagaccatgcacgacagcgtgaacgccctgaccctggaggacgagaagagaatgctgagctacctgatcaacggcttcatcaagatggtgagcttcggcagagacttcgagcagcagctgagcttctacgtggagagcagaagcatgttctgcaacctggagcccgtgctggtgcagctgatccacgcctgcgtggcctactgcttcatcaccatccccagcctggccggcatcttcaccagactgaacctgtacctgcacagcggccaggtggccctggccaaccagtgcctgagccaggccgacgccttcttcaaggccgccatcagcctggtgcccgaggtgcccaagatgatcaacatcgacggcaagatgagacccagcgagagcttcctgctggagttcctgtgcaacttcttcagcaccctgctgatcgtgcccgaccaccccgagcacggcgtgctgttcctggtgagagagctgctgaacgtgatccaggactacacctgggaggacaacagcgacgagaagatcagaatctacacctgcgtgctgcacctgctgagcgccatgagccaggagacctacctgtaccacatcgacaaggtggacagcaacgacagcctgtacggcggcgacagcaagttcctggccgagaacaacaagctgtgcgagaccgtgatggcccagatcctggagcacctgaagaccctggccaaggacgaggccctgaagagacagagcagcctgggcctgagcttcttcaacagcatcctggcccacggcgacctgagaaacaacaagctgaaccagctgagcgtgaacctgtggcacctggcccagagacacggctgcgccgacaccagaaccatggtgaagaccctggagtacatcaagaagcagagcaagcagcccgacatgacccacctgaccgagctggccctgagactgcccctgcagaccagaacctag

SEQ ID NO: 17198 - DNA, 3159 bp, Artificial Sequence
  Description of Artificial Sequence: Synthetic coding sequence
atggcccccgccggcgtggtgaccagagccgtgagaagcggcgagctgcccctgaccagcatggccagcgccgagaacgaggcctgcgccgtgagaagcgtggcctgccccagccaggcctggagactgcagaaggtgctgtgcggcagatgcggcgccgccagctgccccagccagacctggagacccagaggcgccggcagcggcggcgtgagaatgggcagcagagccgacggccccagaaccagcggccacgtgaccggcaagatggccgtgttcccctggcacagcagaaacagaaactacaaggccgagttcgccagctgcagactggaggccgtgcccctggagttcggcgactaccaccccctgaagcccatcaccgtgaccgagagcaagaccaagaaggtgaacagaaagggcagcaccagcagcaccagcagcagcagcagcagcagcgtggtggaccccctgagcagcgtgctggacggcaccgaccccctgagcatgttcgccgccaccgccgaccccgccgccctggccgccgccatggacagcagcagaagaaagagagacagagacgacaacagcgtggtgggcagcgacttcgagccctggaccaacaagagaggcgagatcctggccagatacaccaccaccgagaagctgagcatcaacctgttcatgggcagcgagaagggcaaggccggcaccgccaccctggccatgagcgagaaggtgagaaccagactggaggagctggacgacttcgaggagggcagccagaaggagctgctgaacctgacccagcaggactacgtgaacagaatcgaggagctgaaccagagcctgaaggacgcctgggccagcgaccagaaggtgaaggccctgaagatcgtgatccagtgcagcaagctgctgagcgacaccagcgtgatccagttctaccccagcaagttcgtgctgatcaccgacatcctggacaccttcggcaagctggtgtacgagagaatcttcagcatgtgcgtggacagcagaagcgtgctgcccgaccacttcagccccgagaacgccaacgacaccgccaaggagacctgcctgaactggttcttcaagatcgccagcatcagagagctgatccccagattctacgtggaggccagcatcctgaagtgcaacaagttcctgagcaagaccggcatcagcgagtgcctgcccagactgacctgcatgatcagaggcatcggcgaccccctggtgagcgtgtacgccagagcctacctgtgcagagtgggcatggaggtggccccccacctgaaggagaccctgaacaagaacttcttcgacttcctgctgaccttcaagcagatccacggcgacaccgtgcagaaccagctggtggtgcagggcgtggagctgcccagctacctgcccctgtacccccccgccatggactggatcttccagtgcatcagctaccacgcccccgaggccctgctgaccgagatgatggagagatgcaagaagctgggcaacaacgccctgctgctgaacagcgtgatgagcgccttcagagccgagttcatcgccaccagaagcatggacttcatcggcatgatcaaggagtgcgacgagagcggcttccccaagcacctgctgttcagaagcctgggcctgaacctggccctggccgacccccccgagagcgacagactgcagatcctgaacgaggcctggaaggtgatcaccaagctgaagaacccccaggactacatcaactgcgccgaggtgtgggtggagtacacctgcaagcacttcaccaagagagaggtgaacaccgtgctggccgacgtgatcaagcacatgacccccgacagagccttcgaggacagctacccccagctgcagctgatcatcaagaaggtgatcgcccacttccacgacttcagcgtgctgttcagcgtggagaagttcctgcccttcctggacatgttccagaaggagagcgtgagagtggaggtgtgcaagtgcatcatggacgccttcatcaagcaccagcaggagcccaccaaggaccccgtgatcctgaacgccctgctgcacgtgtgcaagaccatgcacgacagcgtgaacgccctgaccctggaggacgagaagagaatgctgagctacctgatcaacggcttcatcaagatggtgagcttcggcagagacttcgagcagcagctgagcttctacgtggagagcagaagcatgttctgcaacctggagcccgtgctggtgcagctgatccacagcgtgaacagactggccatggagaccagaaaggtgatgaagggcaaccacagcagaaagaccgccgccttcgtgagagcctgcgtggcctactgcttcatcaccatccccagcctggccggcatcttcaccagactgaacctgtacctgcacagcggccaggtggccctggccaaccagtgcctgagccaggccgacgccttcttcaaggccgccatcagcctggtgcccgaggtgcccaagatgatcaacatcgacggcaagatgagacccagcgagagcttcctgctggagttcctgtgcaacttcttcagcaccctgctgatcgtgcccgaccaccccgagcacggcgtgctgttcctggtgagagagctgctgaacgtgatccaggactacacctgggaggacaacagcgacgagaagatcagaatctacacctgcgtgctgcacctgctgagcgccatgagccaggagacctacctgtaccacatcgacaaggtggacagcaacgacagcctgtacggcggcgacagcaagttcctggccgagaacaacaagctgtgcgagaccgtgatggcccagatcctggagcacctgaagaccctggccaaggacgaggccctgaagagacagagcagcctgggcctgagcttcttcaacagcatcctggcccacggcgacctgagaaacaacaagctgaaccagctgagcgtgaacctgtggcacctggcccagagacacggctgcgccgacaccagaaccatggtgaagaccctggagtacatcaagaagcagagcaagcagcccgacatgacccacctgaccgagctggccctgagactgcccctgcagaccagaacctag

SEQ ID NO: 17199 - DNA, 2442 bp, Artificial Sequence
  Description of Artificial Sequence: Synthetic coding sequence
atgccccccctgggcgtgctggtgcacgagaagagccacctgtgcgacgtgaacagcttctgcctgggcaaggccggcaccgccaccctggccatgagcgagaaggtgagaaccagactggaggagctggacgacttcgaggagggcagccagaaggagctgctgaacctgacccagcaggactacgtgaacagaatcgaggagctgaaccagagcctgaaggacgcctgggccagcgaccagaaggtgaaggccctgaagatcgtgatccaggccgagctggtgtacgagagaatcttcagcatgtgcgtggacagcagaagcgtgctgcccgaccacttcagccccgagaacgccaacgacaccgccaaggagacctgcctgaactggttcttcaagatcgccagcatcagagagctgatccccagattctacgtggaggccagcatcctgaagtgcaacaagttcctgagcaagaccggcatcagcgagtgcctgcccagactgacctgcatgatcagaggcatcggcgaccccctggtgagcgtgtacgccagagcctacctgtgcagagtgggcatggaggtggccccccacctgaaggagaccctgaacaagaacttcttcgacttcctgctgaccttcaagcagatccacggcgacaccgtgcagaaccagctggtggtgcagggcgtggagctgcccagctacctgcccctgtacccccccgccatggactggatcttccagtgcatcagctaccacgcccccgaggccctgctgaccgagatgatggagagatgcaagaagctgggcaacaacgccctgctgctgaacagcgtgatgagcgccttcagagccgagttcatcgccaccagaagcatggacttcatcggcatgatcaaggagtgcgacgagagcggcttccccaagcacctgctgttcagaagcctgggcctgaacctggccctggccgacccccccgagagcgacagactgcagatcctgaacgaggcctggaaggtgatcaccaagctgaagaacccccaggactacatcaactgcgccgaggtgtgggtggagtacacctgcaagcacttcaccaagagagaggtgaacaccgtgctggccgacgtgatcaagcacatgacccccgacagagccttcgaggacagctacccccagctgcagctgatcatcaagaaggtgatcgcccacttccacgacttcagcgtgctgttcagcgtggagaagttcctgcccttcctggacatgttccagaaggagagcgtgagagtggaggtgtgcaagtgcatcatggacgccttcatcaagcaccagcaggagcccaccaaggaccccgtgatcctgaacgccctgctgcacgtgtgcaagaccatgcacgacagcgtgaacgccctgaccctggaggacgagaagagaatgctgagctacctgatcaacggcttcatcaagatggtgagcttcggcagagacttcgagcagcagctgagcttctacgtggagagcagaagcatgttctgcaacctggagcccgtgctggtgcagctgatccacagcgtgaacagactggccatggagaccagaaaggtgatgaagggcaaccacagcagaaagaccgccgccttcgtgagagcctgcgtggcctactgcttcatcaccatccccagcctggccggcatcttcaccagactgaacctgtacctgcacagcggccaggtggccctggccaaccagtgcctgagccaggccgacgccttcttcaaggccgccatcagcctggtgcccgaggtgcccaagatgatcaacatcgacggcaagatgagacccagcgagagcttcctgctggagttcctgtgcaacttcttcagcaccctgctgatcgtgcccgaccaccccgagcacggcgtgctgttcctggtgagagagctgctgaacgtgatccaggactacacctgggaggacaacagcgacgagaagatcagaatctacacctgcgtgctgcacctgctgagcgccatgagccaggagacctacctgtaccacatcgacaaggtggacagcaacgacagcctgtacggcggcgacagcaagttcctggccgagaacaacaagctgtgcgagaccgtgatggcccagatcctggagcacctgaagaccctggccaaggacgaggccctgaagagacagagcagcctgggcctgagcttcttcaacagcatcctggcccacggcgacctgagaaacaacaagctgaaccagctgagcgtgaacctgtggcacctggcccagagacacggctgcgccgacaccagaaccatggtgaagaccctggagtacatcaagaagcagagcaagcagcccgacatgacccacctgaccgagctggccctgagactgcccctgcagaccagaacctag

SEQ ID NO: 17200 - DNA, 822 bp, Artificial Sequence
  Description of Artificial Sequence: Synthetic coding sequence
atggcccccgccggcgtggtgaccagagccgtgagaagcggcgagctgcccctgaccagcatggccagcgccgagaacgaggcctgcgccgtgagaagcgtggcctgccccagccaggcctggagactgcagaaggtgctgtgcggcagatgcggcgccgccagctgccccagccagacctggagacccagaggcgccggcagcggcggcgtgagaatgggcagcagagccgacggccccagaaccagcggccacgtgaccggcaagatggccgtgttcccctggcacagcagaaacagaaactacaaggccgagttcgccagctgcagactggaggccgtgcccctggagttcggcgactaccaccccctgaagcccatcaccgtgaccgagagcaagaccaagaaggtgaacagaaagggcagcaccagcagcaccagcagcagcagcagcagcagcgtggtggaccccctgagcagcgtgctggacggcaccgaccccctgagcatgttcgccgccaccgccgaccccgccgccctggccgccgccatggacagcagcagaagaaagagagacagagacgacaacagcgtggtgggcagcgacttcgagccctggaccaacaagagaggcgagatcctggccagatacaccaccaccgagaagctgagcatcaacctgttcatgggcagcgagaaggacggcggctacagcgagcccagaagcagacacagaacccccgcctggaccaccgagcagagctgggactgccacatcggcaacgtgagagagggcgccgaccccgccggcggcgccggctag

SEQ ID NO: 17201 - DNA, 2880 bp, Artificial Sequence
  Description of Artificial Sequence: Synthetic coding sequence
atggcccccgccggcgtggtgaccagagccgtgagaagcggcgagctgcccctgaccagcatggccagcgccgagaacgaggcctgcgccgtgagaagcgtggcctgccccagccaggcctggagactgcagaaggtgctgtgcggcagatgcggcgccgccagctgccccagccagacctggagacccagaggcgccggcagcggcggcgtgagaatgggcagcagagccgacggccccagaaccagcggccacgtgaccggcaagatggccgtgttcccctggcacagcagaaacagaaactacaaggccgagttcgccagctgcagactggaggccgtgcccctggagttcggcgactaccaccccctgaagcccatcaccgtgaccgagagcaagaccaagaaggtgaacagaaagggcagcaccagcagcaccagcagcagcagcagcagcagcgtggtggaccccctgagcagcgtgctggacggcaccgaccccctgagcatgttcgccgccaccgccgaccccgccgccctggccgccgccatggacagcagcagaagaaagagagacagagacgacaacagcgtggtgggcagcgacttcgagccctggaccaacaagagaggcgagatcctggccagatacaccaccaccgagaagctgagcatcaacctgttcatgggcagcgagaagggcaaggccggcaccgccaccctggccatgagcgagaaggtgagaaccagactggaggagctggacgacttcgaggagggcagccagaaggagctgctgaacctgacccagcaggactacgtgaacagaatcgaggagctgaaccagagcctgaaggacgcctgggccagcgaccagaaggtgaaggccctgaagatcgtgatccagtgcagcaagctgctgagcgacaccagcgtgatccagttctaccccagcaagttcgtgctgatcaccgacatcctggacaccttcggcaagctggtgtacgagagaatcttcagcatgtgcgtggacagcagaagcgtgctgcccgaccacttcagccccgagaacgccaacgacaccgccaaggagacctgcctgaactggttcttcaagatcgccagcatcagagagctgatccccagattctacgtggaggccagcatcctgaagtgcaacaagttcctgagcaagaccggcatcagcgagtgcctgcccagactgacctgcatgatcagaggcatcggcgaccccctggtgagcgtgtacgccagagcctacctgtgcagagccctgctgaccgagatgatggagagatgcaagaagctgggcaacaacgccctgctgctgaacagcgtgatgagcgccttcagagccgagttcatcgccaccagaagcatggacttcatcggcatgatcaaggagtgcgacgagagcggcttccccaagcacctgctgttcagaagcctgggcctgaacctggccctggccgacccccccgagagcgacagactgcagatcctgaacgaggcctggaaggtgatcaccaagctgaagaacccccaggactacatcaactgcgccgaggtgtgggtggagtacacctgcaagcacttcaccaagagagaggtgaacaccgtgctggccgacgtgatcaagcacatgacccccgacagagccttcgaggacagctacccccagctgcagctgatcatcaagaaggtgatcgcccacttccacgacttcagcgtgctgttcagcgtggagaagttcctgcccttcctggacatgttccagaaggagagcgtgagagtggaggtgtgcaagtgcatcatggacgccttcatcaagcaccagcaggagcccaccaaggaccccgtgatcctgaacgccctgctgcacgtgtgcaagaccatgcacgacagcgtgaacgccctgaccctggaggacgagaagagaatgctgagctacctgatcaacggcttcatcaagatggtgagcttcggcagagacttcgagcagcagctgagcttctacgtggagagcagaagcatgttctgcaacctggagcccgtgctggtgcagctgatccacgcctgcgtggcctactgcttcatcaccatccccagcctggccggcatcttcaccagactgaacctgtacctgcacagcggccaggtggccctggccaaccagtgcctgagccaggccgacgccttcttcaaggccgccatcagcctggtgcccgaggtgcccaagatgatcaacatcgacggcaagatgagacccagcgagagcttcctgctggagttcctgtgcaacttcttcagcaccctgctgatcgtgcccgaccaccccgagcacggcgtgctgttcctggtgagagagctgctgaacgtgatccaggactacacctgggaggacaacagcgacgagaagatcagaatctacacctgcgtgctgcacctgctgagcgccatgagccaggagacctacctgtaccacatcgacaaggtggacagcaacgacagcctgtacggcggcgacagcaagttcctggccgagaacaacaagctgtgcgagaccgtgatggcccagatcctggagcacctgaagaccctggccaaggacgaggccctgaagagacagagcagcctgggcctgagcttcttcaacagcatcctggcccacggcgacctgagaaacaacaagctgaaccagctgagcgtgaacctgtggcacctggcccagagacacggctgcgccgacaccagaaccatggtgaagaccctggagtacatcaagaagcagagcaagcagcccgacatgacccacctgaccgagctggccctgagactgcccctgcagaccagaacctag

SEQ ID NO: 17202 - DNA, 759 bp, Artificial Sequence
  Description of Artificial Sequence: Synthetic coding sequence
atgggcagcgagctgatcggcagactggcccccagactgggcctggccgagcccgacatgctgagaaaggccgaggagtacctgagactgagcagagtgaagtgcgtgggcctgagcgccagaaccaccgagaccagcagcgccgtgatgtgcctggacctggccgccagctggatgaagtgccccctggacagagcctacctgatcaagctgagcggcctgaacaaggagacctaccagagctgcctgaagagcttcgagtgcctgctgggcctgaacagcaacatcggcatcagagacctggccgtgcagttcagctgcatcgaggccgtgaacatggccagcaagatcctgaagagctacgagagcagcctgccccagacccagcaggtggacctggacctgagcagacccctgttcaccagcgccgccctgctgagcgcctgcaagatcctgaagctgaaggtggacaagaacaagatggtggccaccagcggcgtgaagaaggccatcttcgacagactgtgcaagcagctggagaagatcggccagcaggtggacagagagcccggcgacgtggccaccccccccagaaagagaaagaagatcgtggtggaggcccccgccaaggagatggagaaggtggaggagatgccccacaagccccagaaggacgaggacctgacccaggactacgaggagtggaagagaaagatcctggagaacgccgccagcgcccagaaggccaccgccgagtag

SEQ ID NO: 17203 - DNA, 1071 bp, Artificial Sequence
  Description of Artificial Sequence: Synthetic coding sequence
atgggcctgatggtgagaggcggcgtgacctgcagaagccaggagagactgctgggcgtgggcaccggcaccgccagcgcccagccccccgtgaccgccagcccctactgcagcttcaccggcagaagcagagccgacgcccccgccagagccgccggcaacggccagcccagactgagagcccaggtggacctgagcagcgccagcagcgtgctggtgaccgtgctggacgccaaggccctgcccctgaccctgctgagctggggcagcctgtgcgccaccgcccagaaccacaacaaccaggagggcgcccccgcccagcccaagggcagcatggccaaccagagagccctgagattccccccccccagcggcagcccccccggcctgcacaccagaatgagactgaccagccccccccagccccacttcgagccccccccccccaccaccgtgggcgcccccagaagcctgcagggcgactggttcggcagcgacagcagagccgtgagagccctgagactgatcggctgggccagcagaagcctgcaccccctgcccggcagcagagacagagcccaccccgccgccgaggaggaggacgaccccgacagacccatcgagttcagcagcagcaaggccaacccccacagatggagcgtgggccacaccatgggcaagggccaccagagaccctggtggaaggtgctgcccctgagctgcttcctggtggccctgatcatctggtgctacctgagagaggagagcgaggccgaccagtggctgagacaggagggcagcagacagccccccttcggcttcgacgtgaccttcgccagagactgccccggctacgcctgcgtgctgagcaccgagggcctgggctggtggatgggccacctggccatgctgatcagagtgaaggccgagcagaacctgagcagaagcgagaccgcccccagactggccctggacgtgcagggcttccacagacaggacttcagcgacccctggggcagattccagctgcactgcatgctgctggacctgcccagcctgtgcatcacctag

SEQ ID NO: 17204 - DNA, 399 bp, Artificial Sequence
  Description of Artificial Sequence: Synthetic coding sequence
atgaacagagtgctgtgcgcccccgccgccggcgccgtgagagccctgagactgatcggctgggccagcagaagcctgcaccccctgcccggcagcagagacagagcccaccccgccgccgaggaggaggacgaccccgacagacccatcgagttcagcagcagcaaggccaacccccacagatggagcgtgggccacaccatgggcaagggccaccagagaccctggtggaaggtgctgcccctgagctgcttcctggtggccctgatcatctggtgctacctgagagaggagagcgaggccgaccagtggctgagacaggtgtggggcgaggtgcccgagcccagcgacagaagcgaggagcccgagacccccgccgcctacagagccagaacctag

SEQ ID NO: 17205 - DNA, 399 bp, Artificial Sequence
  Description of Artificial Sequence: Synthetic coding sequence
atgggcgccggcgtgggcgtggccggctgcaccagaggccacagaaactgggtgcccagccagctgccccccagagagatcaaggccggcgtgagcctggccgtggtgaccgagttcgcctgggtgctggcccccagacccaagagagccaccgccagcgccctgggcaccgagagccccagattcctggacagacccgacttcttcgactaccccgacagcgaccaggccagactgctggccgtggcccagttcatcggcgagaagcccatcgtgttcatcaacagcggcagcagccccggcctgttccaccacatcctggtgggcctgctggtggtggccttcttcttcctgctgttccagttctgcacccacatcaacttccagaagggcgcctag

SEQ ID NO: 17206 - DNA, 960 bp, Artificial Sequence
  Description of Artificial Sequence: Synthetic coding sequence
atggccccccagagaagagccgccaccaaggcccccgagggcaacggcgccgccgagagaagaaacagaagcagcaccaagaaggacagagcccccagagaggtgcagagactgtggcagagaccctggctgagaaccgccggcctgggcgccggcttcgtgctgaccgccctgctgctgtggagcagcctgggcgccgacgacggcgtggccgaggtgctggccagaagaggcgaggtggtggccggcagattcatcgaggtgccctgcagcgaggactacgacagccacagaagattcgagggctgcacccccagaaagtgcggcagaggcgtgaccgacgtggtgatcaccagagaggaggccgagagaatcagaagcgtggccgagaagggcctgagcctgggcggcagcgacggcggcgccagcatcctggacctgcacagcggcgccctgagcgtgggcaagcacttcgtgaacctgtacagatacttcggcgacaagatccagaacatcttcagcgaggaggacttcagactgtacagagaggtgagacagaaggtgcagctgaccatcgccgaggccttcggcatcagcgccagcagcctgcacctgaccaagcccaccttcttcagcagaatcaacagcaccgaggccagaaccgcccacgacgagtactggcacgcccacgtggacaaggtgacctacggcagcttcgactacaccagcctgctgtacctgagcaactacctggaggacttcggcggcggcagattcatgttcatggaggagggcgccaacaagaccgtggagcccagagccggcagagtgagcttcttcaccagcggcagcgagaacctgcacagagtggagaaggtgcactggggcaccagatacgccatcaccatcgccttcagctgcaaccccgaccacggcatcgaggaccccgccttcccctag

SEQ ID NO: 17207 - DNA, 996 bp, Artificial Sequence
  Description of Artificial Sequence: Synthetic coding sequence
atggccccccagagaagagccgccaccaaggcccccgagggcaacggcgccgccgagagaagaaacagaagcagcaccaagaaggacagagcccccagagaggtgcagagactgtggcagagaccctggctgagaaccgccggcctgggcgccggcttcgtgctgaccgccctgctgctgtggagcagcctgggcgccgacgacggcgtggccgaggtgctggccagaagaggcgaggtggtggccggcagattcatcgaggtgccctgcagcgaggactacgacagccacagaagattcgagggctgcacccccagaaagtgcggcagaggcgtgaccgacgtggtgatcaccagagaggaggccgagagaatcagaagcgtggccgagaagggcctgagcctgggcggcagcgacggcggcgccagcatcctggacctgcacagcggcgccctgagcgtgggcaagcacttcgtgaacctgtacagatacttcggcgacaagatccagaacatcttcagcgaggaggacttcagactgtacagagaggtgagacagaaggtgcagctgaccatcgccgaggccttcggcatcagcgccagcagcctgcacctgaccaagcccaccttcttcagcagaatcaacagcaccgaggccagaaccgcccacgacgagtactggcacgcccacgtggacaaggtgacctacggcagcttcgactacaccagcctgctgtacctgagcaactacctggaggacttcggcggcggcagattcatgttcatggaggagggcgccaacaagaccgtggagcccagagccggctgcttctgcttcagaatgatgagctgcggcttccaggaggtgaacggccccagagccagcgaggccgccggcgccaaggccggcgtgagatgcccccccggcacccaccacccccccgagagaggcgagacccacgccatcctggaggccgagagcatcgcctactgctag

SEQ ID NO: 17208 - DNA, 234 bp, Artificial Sequence
  Description of Artificial Sequence: Synthetic coding sequence
atggccgccaccgacttcgtgcaggagatgagagccgtgggcgagagactgctgctgaagctgcagagactgccccaggccgagcccgtggagatcgtggccttcagcgtgatcatcctgttcaccgccaccgtgctgctgctgctgctgatcgcctgcagctgctgctgcacccactgctgctgccccgagagaagaggcagaaaggtgcaggtgcagcccacccccccctag

SEQ ID NO: 17209 - DNA, 1578 bp, Artificial Sequence
  Description of Artificial Sequence: Synthetic coding sequence
atggccgccgccccccccctgagagacagactgagcttcctgcacagactgcccatcctgctgaagggcaccagcgacgacgacgtgccctgccccggctacctgttcgaggagatcgccaagatcagccacgagagccccggcagcagccagtgcctgctggagtacctgctgagcagactgcacagcagcagcggccacggcaagctgaaggtgctgaagatcctgctgtacctgtgcagccacggcagcagcttcttcctgctgatcctgaagagaaacagcgccttcatccaggaggccgccgccttcgccggcccccccgaccccctgcacggcaacagcctgtaccagaaggtgagagccgccgcccaggacctgggcagcaccctgttcagcgacaccgtgctgcccctggcccccagccagcccctgggcaccccccccgccaccggcatgggcagccaggccagaccccacagcaccctgcagggcttcggctacagcaaggagcacggcagaaccgccgtgagacaccagcccggccaggccggcggcggctgggacgagctggacagcggccccagcagccagaacagcagccagaacagcgacctgagcagagtgagcgacagcggcagccacagcggcagcgacagccacagcggcgccagcagagagcccggcgacctggccgagagagtggaggtggtggccctgagcgactgccagcaggagctgagcctggtgagaaccgtgaccagaggccccagagccttcctgagcagagaggaggcccagcacttcatcaaggcctgcggcctgctgaactgcgaggccgtgctgcagctgctgacctgccacctgagaggcaccagcgagtgcacccagctgagagccctgtgcgccatcgccagcctgggcagcagcgacctgctgccccaggagcacatcctgctgagaaccagaccctggctgcaggagctgagcatgggcagccccggccccgtgaccaacaaggccaccaagatcctgagacacttcgaggccagctgcggccagctgagccccgccagaggcaccagcgccgagcccggccccaccgccgccctgcccggccccagcgacctgctgaccgacgccgtgcccctgcccggcagccaggtgttcctgcagcccctgagcagcacccccgtgagcagcagaagccccgcccccagcagcggcatgcccagcagccccgtgcccacccccccccccgacgccagccccatccccgcccccggcgaccccagcgaggccgaggccagactggccgagagcagaagatggagacccgagagaatccccggcggcaccgacagccccaagagaggccccagcagctgcgcctggagcagagacagcctgttcgccggcatggagctggtggcctgccccagactggtgggcgccggcgccgccgccggcgagagctgccccgacgcccccagagccccccagaccagcagccagagaaccgccgccaaggagccccccggcagcgagcccagcgccttcgccttcctgaacgcctag

SEQ ID NO: 17210 - DNA, 1326 bp, Artificial Sequence
  Description of Artificial Sequence: Synthetic coding sequence
atgggcagccaggccagaccccacagcaccctgcagggcttcggctacagcaaggagcacggcagaaccggcagcgccggcgaggccttcctgagcaccatccagaaggccgccgaggtggtggccagcgccatgagacccggccccgagagccccagcaccagaagactgctgcccagaggcgacacctaccagcccgccatgatgcccagcgccagccacggcccccccaccctgggcaacctgctgcccggcgccatccccggccccagagccgtgagacaccagcccggccaggccggcggcggctgggacgagctggacagcggccccagcagccagaacagcagccagaacagcgacctgagcagagtgagcgacagcggcagccacagcggcagcgacagccacagcggcgccagcagagagcccggcgacctggccgagagagtggaggtggtggccctgagcgactgccagcaggagctgagcctggtgagaaccgtgaccagaggccccagagccttcctgagcagagaggaggcccagcacttcatcaaggcctgcggcctgctgaactgcgaggccgtgctgcagctgctgacctgccacctgagaggcaccagcgagtgcacccagctgagagccctgtgcgccatcgccagcctgggcagcagcgacctgctgccccaggagcacatcctgctgagaaccagaccctggctgcaggagctgagcatgggcagccccggccccgtgaccaacaaggccaccaagatcctgagacacttcgaggccagctgcggccagctgagccccgccagaggcaccagcgccgagcccggccccaccgccgccctgcccggccccagcgacctgctgaccgacgccgtgcccctgcccggcagccaggtgttcctgcagcccctgagcagcacccccgtgagcagcagaagccccgcccccagcagcggcatgcccagcagccccgtgcccacccccccccccgacgccagccccatccccgcccccggcgaccccagcgaggccgaggccagactggccgagagcagaagatggagacccgagagaatccccggcggcaccgacagccccaagagaggccccagcagctgcgcctggagcagagacagcctgttcgccggcatggagctggtggcctgccccagactggtgggcgccggcgccgccgccggcgagagctgccccgacgcccccagagccccccagaccagcagccagagaaccgccgccaaggagccccccggcagcgagcccagcgccttcgccttcctgaacgcctag

SEQ ID NO: 17211 - DNA, 1074 bp, Artificial Sequence
  Description of Artificial Sequence: Synthetic coding sequence
atggagagcagcagaggcagacccggccccgagaccgacctgctggccgtggccgagcaccaggccctggtgttcggcggcggccccggcagaaccagcagcgagccccccgccggcctgagagtgagcggcgaggaggagaccgagaacgtgggcggcgccaacagacaccccagaaccagccccaagaccagcagctgcggcgtggtgcacagacccgagagagaggccctggagaacgagcccggcccccagggcaccctgagcggcgccggcagcagaagaggcgcccccggcgccgagcacgagcccagcctgagcagcagacacaagaaccccgccccccccgagggcaagcccagcagcggcagagactgcagaagaggcggccccggcggcggcatggacgtggagcagcaggaggaggaggacaacgacgaggaggccgccgccggcagcagagccggcagaagcttcagcagcagactgcaggacagcagaagcctggacggcctgagcgaggcctgcggcggcgccggcagcagcggcagcgccgagagcggcgccggcggcggcagaagagccaccatcagcagccccctggagctggagggcaccgtgagcagacacggcgacctgacccacttcgtggccaacaacctgcagctgaagatcagactgagcggcgcccccccccccccccccagcgcccccgccagaccctgccccgcccccgcccccacccccacccccgccatcccccccatcgaccccgaggtgctgagagacctggagagactgagcagagagctgggcggcagagtggacagactgctgagaggcctgggcggcgccgtgcaggagctgaccgccctgagcgtgggctgcatccagacctacagagacgccgtggacagcctgggcgaggccgtggacatgagcatcaagggcatgtacaccctgctggccagatgcgaggagctggagagagccctgcagcccgtgcagggcctggccagacaggtgagagacatcagaagaaccctggaggtgctggaggccctgtgcaagtag

SEQ ID NO: 17212 - DNA, 342 bp, Artificial Sequence
  Description of Artificial Sequence: Synthetic coding sequence
atggccggccccgccgccgccttcagaagactgggcgccctgagcggcgccgccgccctgggcttcgccagctacggcgcccacggcgcccagttccccgacgcctacggcaaggagctgttcgacaaggccaacaagcaccacttcctgcacagcctggccctgctgggcgtgccccactgcagaaagcccctgtgggccggcctgctgctggccagcggcaccaccctgttctgcaccagcttctactaccaggccctgagcggcgaccccagcatccagaccctggcccccgccggcggcaccctgctgctgctgggctggctggccctggccctgtag

SEQ ID NO: 17213 - DNA, 564 bp, Artificial Sequence
  Description of Artificial Sequence: Synthetic coding sequence
atgtacctgcaggtggagaccagaaccagcagcagactgcacctgaagagagcccccggcatcagaagctggagcctgctggtgggcatcctgagcatcggcctggccgccgcctactacagcggcgacagcctgggctggaagctgttctacgtgaccggctgcctgttcgtggccgtgcagaacctggaggactgggaggaggccatcttcgacaagagcaccggcaaggtggtgctgaagaccttcagcctgtacaagaagctgctgaccctgttcagagccggccacgaccaggtggtggtgctgctgcacgacgtgagagacgtgagcgtggaggaggagaaggtgagatacttcggcaagggctacatggtggtgctgagactggccaccggcttcagccaccccctgacccagagcgccgtgatgggccacagaagcgacgtggaggccatcgccaagctgatcaccagcttcctggagctgcactgcctggagagccccaccgagctgagccagagcagcgacagcgaggccggcgaccccgccagccagagctag

SEQ ID NO: 17214 - DNA, 672 bp, Artificial Sequence
  Description of Artificial Sequence: Synthetic coding sequence
atgtggaagcccagccccagcagcagccccgccagctggagctgcaccgccctgagagccccccagagctgcctgagagccgccaccgtgagacccgtgaccctgcaggccagagccgacagccccaccgtgcccgagcccgtgcacagaccccaggacccctggcacatccccggcgtgcccgagcccgtgcacagaccccaggacccctggcacatccccggcgtgcccgagcccgtgcacagaccccaggacccctggcacatccccggcgtgcccgagcccgtgcacagaccccaggacccctggcacatccccggcgtgcccgagcccgtgcacagaccccaggacccctggccctggctgcagctggtgccccccgccgagctggcctactgcctgctgatgctgctgctggcccactgcatgaagcagcaggccagacccggccaccccgacttcctgcacagagaggcctgggcctgcctgagcgccgccggcggcctggccagccccggcctgctgctgtgggccaccgccagacccagagccagcggcgaggccggccccggcagagccctggtgggcgccgacgccgcctgctgccccagacacagcgtgctgagcctggtggacatccccagcggccaggtgctgccccagggccagtag

SEQ ID NO: 17215 - DNA, 786 bp, Artificial Sequence
  Description of Artificial Sequence: Synthetic coding sequence
gcctggagaagaagaagaagcggcaccagcggcaaggccacctggtggtgcagcggcctgagaagagccagccccacccccagcagaagagtgcagagctgggccaccgccgtgatgtggaagcccagccccagcagcagccccgccagctggagctgcaccgccctgagagccccccagagctgcctgagagccgccaccgtgagacccgtgaccctgcaggccagagccgacagccccaccgtgcccgagcccgtgcacagaccccaggacccctggcacatccccggcgtgcccgagcccgtgcacagaccccaggacccctggcacatccccggcgtgcccgagcccgtgcacagaccccaggacccctggcacatccccggcgtgcccgagcccgtgcacagaccccaggacccctggcacatccccggcgtgcccgagcccgtgcacagaccccaggacccctggccctggctgcagctggtgccccccgccgagctggcctactgcctgctgatgctgctgctggcccactgcatgaagcagcaggccagacccggccaccccgacttcctgcacagagaggcctgggcctgcctgagcgccgccggcggcctggccagccccggcctgctgctgtgggccaccgccagacccagagccagcggcgaggccggccccggcagagccctggtgggcgccgacgccgcctgctgccccagacacagcgtgctgagcctggtggacatccccagcggccaggtgctgccccagggccagtag

SEQ ID NO: 17216 - DNA, 522 bp, Artificial Sequence
  Description of Artificial Sequence: Synthetic coding sequence
atgtacctgcaggtggagaccagaaccagcagcagactgcacctgaagagagcccccggcatcagaagctggagcctgctggtggacagcctgggctggaagctgttctacgtgaccggctgcctgttcgtggccgtgcagaacctggaggactgggaggaggccatcttcgacaagagcaccggcaaggtggtgctgaagaccttcagcctgtacaagaagctgctgaccctgttcagagccggccacgaccaggtggtggtgctgctgcacgacgtgagagacgtgagcgtggaggaggagaaggtgagatacttcggcaagggctacatggtggtgctgagactggccaccggcttcagccaccccctgacccagagcgccgtgatgggccacagaagcgacgtggaggccatcgccaagctgatcaccagcttcctggagctgcactgcctggagagccccaccgagctgagccagagcagcgacagcgaggccggcgaccccgccagccagagctag

SEQ ID NO: 17217 - DNA, 564 bp, Artificial Sequence; identical to SEQ ID NO: 17213
  Description of Artificial Sequence: Synthetic coding sequence

SEQ ID NO: 17218 - DNA, 684 bp, Artificial Sequence
  Description of Artificial Sequence: Synthetic coding sequence
atgggccacagaagcgacgtggaggccatcgccagcagcagccccgccagctggagctgcaccgccctgagagccccccagagctgcctgagagccgccaccgtgagacccgtgaccctgcaggccagagccgacagccccaccgtgcccgagcccgtgcacagaccccaggacccctggcacatccccggcgtgcccgagcccgtgcacagaccccaggacccctggcacatccccggcgtgcccgagcccgtgcacagaccccaggacccctggcacatccccggcgtgcccgagcccgtgcacagaccccaggacccctggcacatccccggcgtgcccgagcccgtgcacagaccccaggacccctggccctggctgcagctggtgccccccgccgagctggcctactgcctgctgatgctgctgctggcccactgcatgaagcagcaggccagacccggccaccccgacttcctgcacagagaggcctgggcctgcctgagcgccgccggcgtgagccccgccctggacagctgcttcggcccccagcaggacctgggcagagtggagagaagagccagacccgccctggtgggcgccgacgccgcctgctgccccagacacagcgtgctgagcctggtggacatccccagcggccaggtgctgccccagggccagtag

SEQ ID NO: 17219 - DNA, 828 bp, Artificial Sequence
  Description of Artificial Sequence: Synthetic coding sequence
atggacaccatcctggtgttcagcctgatcatcgccagctacgacgccaacaagaaggacctgagagacagcagctgcagactggagcagctgcccggcatcttccccaaggacgtgagaagcatcagagagctgcagatgcaggagacccacaccgagaccaagagaaccaccttcatccagaacagaaccatcgccaccctgcagtgcctgggcagcgacagcaaggtgaaggtgaacctggtgtacctggagagaagacccaaggtgaagcacatcctgaagaacctgagaatcatcgccgcccccagaagaaacagcagcgccagcagcagctgccacctgatccccaccagcaagttccagaccggcagcctgctgaagggcaaggccttcctgcccggcatcagccagtgcaaggtgctgggcgccagcagcgagaccttccccaccaccgcccccagcatcacccccggcaacaaggagggcgagaagaccaccagcaccgacaccgacgagaacctggagaagagacagaagtggagcatcgtggtgaagatcctgatcgccgtgaccctgctgctgagcggcgtggccatcatcgtgttcgtgatcttcgaggtgccctgcccctaccagtgcctgggcgccagaaagctgtgccagtgccagtggctgtggagatggcagaagaagggcggccagccccccggcaccgccgagagcaagcccgacagccagccccagaaggtgggccaggacgccgccaacagcagcaaccccaagaaggccgccgagatcaccgtgatccaccagacctacttctag

SEQ ID NO: 17220 - DNA, 480 bp, Artificial Sequence
  Description of Artificial Sequence: Synthetic coding sequence
atggacaccatcctggtgttcagcctgatcatcgccagctacgacgccaacaagaaggacctgagagacagcagctgcagactggagcagctgcccggcatcttccccaaggacgtgagaagcatcagagagctgcagatgcaggagacccacaccgagaccaagagaaccaccttcatccagaacagaaccatcgccaccctgcagtgcctgggcagcgacagcaaggtgaaggtgaacctggtgtacctggagagaagacccaaggtgaagcacatcctgaagaacctgagaatcatcgccgcccccagaagaaacagcagcgccagcagcagctgccacctgatccccaccagcaagttccagaccggcagcctgctgaagggcaaggtgagcatgcccagaagccaggaggccgtgcccatgcccgtggtggtggagatggccaaggagggcagacccgccacctgggacagctag

SEQ ID NO: 17221 - DNA, 1644 bp, Artificial Sequence
  Description of Artificial Sequence: Synthetic coding sequence
atgagcgacaacccccccagaatggaggtgtgcccctactgcaagaagcccttcaagagactgaagagccacctgccctactgcaagatgatcggccccaccatccccaccgaccagaaggtgtaccagagcaagcccgccaccctgcccagagccaagaagatgaagggccccatcaaggacctgatcaaggccaagggcaaggagctggagaccgagaacgaggagagaaacagcaagctggtggtggacaagcccgagcagaccgtgaagaccttccccctgcccgccgtgggcctggagagagccgccaccaccaaggccgacaaggacatcaagaaccccatccagcccagcttcaagatgctgaagaacaccaagcccatgaccaccttccaggaggagaccaaggcccagttctacgccagcgagaagaccagccccaagagagagctggccaaggacctgcccaagagcggcgagagcagatgcaaccccagcgaggccggcgccagcctgctggtgggcagcatcgagcccagcctgagcaaccaggacagaaagtacagcagcaccctgcccaacgacgtgcagaccaccagcggcgacctgaagctggacaagatcgacccccagagacaggagctgctggtgaagctgctggacgtgcccaccggcgactgccacatcagccccaagaacgtgagcgacggcgtgaagagagtgagaaccctgctgagcaacgagagagacagcaagggcagagaccacctgagcggcgtgcccaccgacgtgaccgtgaccgagacccccgagaagaacaccgagagcctgatcctgagcctgaagatgagcagcctgggcaagatccaggtgatggagaagcaggagaagggcctgaccctgggcgtggagacctgcggcagcaagggcaacgccgagaagagcatgagcgccaccgagaagcaggagagaaccgtgatgagccacggctgcgagaacttcaacaccagagacagcgtgaccggcaaggagagccagggcgagagaccccacctgagcctgttcatccccagagagaccacctaccagttccacagcgtgagccagagcagcagccagagcctggccagcctggccaccaccttcctgcaggagaagaaggccgaggcccagaaccaccactgcgtgcccgacgtgaaggccctgatggagagccccgagggccagctgagcctggagcccaagagcgacagccagttccaggccagccacaccggctgccagagccccctgtgcagcgcccagagacacaccccccagagccccttcaccaaccacgccgccgccgccggcagaaagaccctgagaagctgcatgggcctggagtggttccccgagctgtaccccggctacctgggcctgggcgtgctgcccggcaagccccagtgctggaacgccatgacccagaagccccagctgatcagcccccagggcgagagactgagccagggctggatcagatgcaacaccaccatcagaaagagcggcttcggcggcatcaccatgctgttcaccggctacttcgtgctgtgctgcagctggagcttcagaagactgaagctgcagagatggagaaagtag

SEQ ID NO: 17222 - DNA, 1722 bp, Artificial Sequence
  Description of Artificial Sequence: Synthetic coding sequence
atgagcgacaacccccccagaatggaggtgtgcccctactgcaagaagcccttcaagagactgaagagccacctgccctactgcaagatgatcggccccaccatccccaccgaccagaaggtgtaccagagcaagcccgccaccctgcccagagccaagaagatgaagggccccatcaaggacctgatcaaggccaagggcaaggagctggagaccgagaacgaggagagaaacagcaagctggtggtggacaagcccgagcagaccgtgaagaccttccccctgcccgccgtgggcctggagagagccgccaccaccaaggccgacaaggacatcaagaaccccatccagcccagcttcaagatgctgaagaacaccaagcccatgaccaccttccaggaggagaccaaggcccagttctacgccagcgagaagaccagccccaagagagagctggccaaggacctgcccaagagcggcgagagcagatgcaaccccagcgaggccggcgccagcctgctggtgggcagcatcgagcccagcctgagcaaccaggacagaaagtacagcagcaccctgcccaacgacgtgcagaccaccagcggcgacctgaagctggacaagatcgacccccagagacaggagctgctggtgaagctgctggacgtgcccaccggcgactgccacatcagccccaagaacgtgagcgacggcgtgaagagagtgagaaccctgctgagcaacgagagagacagcaagggcagagaccacctgagcggcgtgcccaccgacgtgaccgtgaccgagacccccgagaagaacaccgagagcctgatcctgagcctgaagatgagcagcctgggcaagatccaggtgatggagaagcaggagaagggcctgaccctgggcgtggagacctgcggcagcaagggcaacgccgagaagagcatgagcgccaccgagaagcaggagagaaccgtgatgagccacggctgcgagaacttcaacaccagagacagcgtgaccggcaaggagagccagggcgagagaccccacctgagcctgttcatccccagagagaccacctaccagttccacagcgtgagccagagcagcagccagagcctggccagcctggccaccaccttcctgcaggagaagaaggccgaggcccagaaccaccactgcgtgcccgacgtgaaggccctgatggagagccccgagggccagctgagcctggagcccaagagcgacagccagttccaggccagccacaccggctgccagagccccctgtgcagcgcccagagacacaccccccagagccccttcaccaaccacgccgccgccgccggcagaaagaccctgagaagctgcatgggcctggagtggttccccgagctgtaccccggctacctgggcctgggcgtgctgcccggcaagccccagtgctggaacgccatgacccagaagccccagctgatcagcccccagggcgagagactgagccagggctggatcagatgcaacaccaccatcagaaagagcggcttcggcggcatcaccatgctgttcaccggctacttcgtgctgtgctgcagctggagcttcagaagactgaagaagctgtgcagacccctgccctggaagagcaccgtgcccccctgcatcggcgtggccaagaccaccggcgactgcagaagcaagacctgcctggactag

SEQ ID NO: 17223 - DNA, 1830 bp, Artificial Sequence
  Description of Artificial Sequence: Synthetic coding sequence
atgagcgacaacccccccagaatggaggtgtgcccctactgcaagaagcccttcaagagactgaagagccacctgccctactgcaagatgatcggccccaccatccccaccgaccagaaggtgtaccagagcaagcccgccaccctgcccagagccaagaagatgaagggccccatcaaggacctgatcaaggccaagggcaaggagctggagaccgagaacgaggagagaaacagcaagctggtggtggacaagcccgagcagaccgtgaagaccttccccctgcccgccgtgggcctggagagagccgccaccaccaaggccgacaaggacatcaagaaccccatccagcccagcttcaagatgctgaagaacaccaagcccatgaccaccttccaggaggagaccaaggcccagttctacgccagcgagaagaccagccccaagagagagctggccaaggacctgcccaagagcggcgagagcagatgcaaccccagcgaggccggcgccagcctgctggtgggcagcatcgagcccagcctgagcaaccaggacagaaagtacagcagcaccctgcccaacgacgtgcagaccaccagcggcgacctgaagctggacaagatcgacccccagagacaggagctgctggtgaagctgctggacgtgcccaccggcgactgccacatcagccccaagaacgtgagcgacggcgtgaagagagtgagaaccctgctgagcaacgagagagacagcaagggcagagaccacctgagcggcgtgcccaccgacgtgaccgtgaccgagacccccgagaagaacaccgagagcctgatcctgagcctgaagatgagcagcctgggcaagatccaggtgatggagaagcaggagaagggcctgaccctgggcgtggagacctgcggcagcaagggcaacgccgagaagagcatgagcgccaccgagaagcaggagagaaccgtgatgagccacggctgcgagaacttcaacaccagagacagcgtgaccggcaaggagagccagggcgagagaccccacctgagcctgttcatccccagagagaccacctaccagttccacagcgtgagccagagcagcagccagagcctggccagcctggccaccaccttcctgcaggagaagaaggccgaggcccagaaccaccactgcgtgcccgacgtgaaggccctgatggagagccccgagggccagctgagcctggagcccaagagcgacagccagttccaggccagccacaccggctgccagagccccctgtgcagcgcccagagacacaccccccagagccccttcaccaaccacgccgccgccgccggcagaaagaccctgagaagctgcatgggcctggagtggttccccgagctgtaccccggctacctgggcctgggcgtgctgcccggcaagccccagtgctggaacgccatgacccagaagccccagctgatcagcccccagggcgagagactgagccaggtgagcctgctggagagaagcagcacccacatcagaagcctggagccccccgccggcctgaccaccagcaacttcagcctgatgagactgctgggcgccgtgcagaagggctggatcagatgcaacaccaccatcagaaagagcggcttcggcggcatcaccatgctgttcaccggctacttcgtgctgtgctgcagctggagcttcagaagactgaagaagctgtgcagacccctgccctggaagagcaccgtgcccccctgcatcggcgtggccaagaccaccggcgactgcagaagcaagacctgcctggactag

SEQ ID NO: 17224 - DNA, 1752 bp, Artificial Sequence
  Description of Artificial Sequence: Synthetic coding sequence
atgagcgacaacccccccagaatggaggtgtgcccctactgcaagaagcccttcaagagactgaagagccacctgccctactgcaagatgatcggccccaccatccccaccgaccagaaggtgtaccagagcaagcccgccaccctgcccagagccaagaagatgaagggccccatcaaggacctgatcaaggccaagggcaaggagctggagaccgagaacgaggagagaaacagcaagctggtggtggacaagcccgagcagaccgtgaagaccttccccctgcccgccgtgggcctggagagagccgccaccaccaaggccgacaaggacatcaagaaccccatccagcccagcttcaagatgctgaagaacaccaagcccatgaccaccttccaggaggagaccaaggcccagttctacgccagcgagaagaccagccccaagagagagctggccaaggacctgcccaagagcggcgagagcagatgcaaccccagcgaggccggcgccagcctgctggtgggcagcatcgagcccagcctgagcaaccaggacagaaagtacagcagcaccctgcccaacgacgtgcagaccaccagcggcgacctgaagctggacaagatcgacccccagagacaggagctgctggtgaagctgctggacgtgcccaccggcgactgccacatcagccccaagaacgtgagcgacggcgtgaagagagtgagaaccctgctgagcaacgagagagacagcaagggcagagaccacctgagcggcgtgcccaccgacgtgaccgtgaccgagacccccgagaagaacaccgagagcctgatcctgagcctgaagatgagcagcctgggcaagatccaggtgatggagaagcaggagaagggcctgaccctgggcgtggagacctgcggcagcaagggcaacgccgagaagagcatgagcgccaccgagaagcaggagagaaccgtgatgagccacggctgcgagaacttcaacaccagagacagcgtgaccggcaaggagagccagggcgagagaccccacctgagcctgttcatccccagagagaccacctaccagttccacagcgtgagccagagcagcagccagagcctggccagcctggccaccaccttcctgcaggagaagaaggccgaggcccagaaccaccactgcgtgcccgacgtgaaggccctgatggagagccccgagggccagctgagcctggagcccaagagcgacagccagttccaggccagccacaccggctgccagagccccctgtgcagcgcccagagacacaccccccagagccccttcaccaaccacgccgccgccgccggcagaaagaccctgagaagctgcatgggcctggagtggttccccgagctgtaccccggctacctgggcctgggcgtgctgcccggcaagccccagtgctggaacgccatgacccagaagccccagctgatcagcccccagggcgagagactgagccaggtgagcctgctggagagaagcagcacccacatcagaagcctggagccccccgccggcctgaccaccagcaacttcagcctgatgagactgctgggcgccgtgcagaagggctggatcagatgcaacaccaccatcagaaagagcggcttcggcggcatcaccatgctgttcaccggctacttcgtgctgtgctgcagctggagcttcagaagactgaagctgcagagatggagaaagtag

SEQ ID NO: 17225 - DNA, 1740 bp, Artificial Sequence
  Description of Artificial Sequence: Synthetic coding sequence
atgagcgacaacccccccagaatggaggtgtgcccctactgcaagaagcccttcaagagactgaagagccacctgccctactgcaagatgatcggccccaccatccccaccgaccagaaggtgtaccagagcaagcccgccaccctgcccagagccaagaagatgaagggccccatcaaggacctgatcaaggccaagggcaaggagctggagaccgagaacgaggagagaaacagcaagctggtggtggacaagcccgagcagaccgtgaagaccttccccctgcccgccgtgggcctggagagagccgccaccaccaaggccgacaaggacatcaagaaccccatccagcccagcttcaagatgctgaagaacaccaagcccatgaccaccttccaggaggagaccaaggcccagttctacgccagcgagaagaccagccccaagagagagctggccaaggacctgcccaagagcggcgagagcagatgcaaccccagcgaggccggcgccagcctgctggtgggcagcatcgagcccagcctgagcaaccaggacagaaagtacagcagcaccctgcccaacgacgtgcagaccaccagcggcgacctgaagctggacaagatcgacccccagagacaggagctgctggtgaagctgctggacgtgcccaccggcgactgccacatcagccccaagaacgtgagcgacggcgtgaagagagtgagaaccctgctgagcaacgagagagacagcaagggcagagaccacctgagcggcgtgcccaccgacgtgaccgtgaccgagacccccgagaagaacaccgagagcctgatcctgagcctgaagatgagcagcctgggcaagatccaggtgatggagaagcaggagaagggcctgaccctgggcgtggagacctgcggcagcaagggcaacgccgagaagagcatgagcgccaccgagaagcaggagagaaccgtgatgagccacggctgcgagaacttcaacaccagagacagcgtgaccggcaaggagagccagggcgagagaccccacctgagcctgttcatccccagagagaccacctaccagttccacagcgtgagccagagcagcagccagagcctggccagcctggccaccaccttcctgcaggagaagaaggccgaggcccagaaccaccactgcgtgcccgacgtgaaggccctgatggagagccccgagggccagctgagcctggagcccaagagcgacagccagttccaggccagccacaccggctgccagagccccctgtgcagcgcccagagacacaccccccagagccccttcaccaaccacgccgccgccgccggcagaaagaccctgagaagctgcatgggcctggagtggttccccgagctgtaccccggctacctgggcctgggcgtgctgcccggcaagccccagtgctggaacgccatgacccagaagccccagctgatcagcccccagggcgagagactgagccaggtgagcctgctggagagaagcagcacccacatcagaagcctggagccccccgccggcctgaccaccagcaacttcagcctgatgagactgctgggcgccgtgcagaagggctggatcagatgcaacaccaccatcagaaagagcggcttcggcggcatcaccatgctgttcaccggctacttcgtgctgtgctgcagctggagcttcagaagactgaccctgcagtag

SEQ ID NO: 17226 - DNA, 225 bp, Artificial Sequence
  Description of Artificial Sequence: Synthetic coding sequence
atgagcgccaacggcgccgtgtggggcagagtgagaagcagactgagagccttccccgagagactggccgcctgcggcgccgaggccgccgcctacggcagatgcgtgcaggccagcaccgcccccggcggcagactgagcaaggacttctgcgccagagagttcgaggccctgagaagctgcttcgccgccgccgccaagaagaccctggagggcggctgctag

SEQ ID NO: 17227 - DNA, 444 bp, Artificial Sequence
  Description of Artificial Sequence: Synthetic coding sequence
atgctgctgagaagagtggtggagggcggcagagccgtggccgccgccgtgagaggcagcggcgccagaagattcagcagccccgactgctgccagagactgcccggcggcggcagcttcctgcagagacaccaccccggcgcccaggcccccgacggcagaagaaagttcggcaccgaccacgtggaggtgggcagccaggccggcgccgacggcaccagaccccccaaggccagcctgccccccgagctgcagccccccaccaactgctgcatgagcggctgccccaactgcgtgtgggtggagtacgccgacagactgctgcagcacttccaggacggcggcgagagagccctggccgccctggaggagcacgtggccgacgagaacctgaaggccttcctgagaatggagatcagactgcacaccagatgcggcggctag

SEQ ID NO: 17228 - DNA, 633 bp, Artificial Sequence
  Description of Artificial Sequence: Synthetic coding sequence
atggtggccgacatcaagggcaacgagcagatcgagaagtacagctggagagaggcctgcgacaccggcagcagcagaatggacagaaagcacggcaagtacatcctgaacgtggagcacagcgagaaccagccccccatcacccaccccaacgaccaggaggcccacagcagcatctgctggtgcctgcccagcaacgacatcaccagcgacgtgagccccaacctgaccggcgtgtgcgtgaaccccggcatcctggcccacagcagatgcctgcagagcgagagctgcaacacccaggtgaaggagtactgcagaaacgactggagcatgtggaaggtgttcctggcctgcctgctggcctgcgtgatcatgaccgccatcggcgtgctgatcatctgcctggtgaacaacaagggcagcgccaacagcagcatcgtgatccagctgagcaccaacgacggcgagtgcgtgaccgtgaagcccggcacccccagccccgcctgcccccccaccatgaccaccaccagcaccgtgcccgccagcaccgccaccgagagcaccaccagcaccgccaccgccgccaccaccagcaccgagcccatcaccgtggcccccaccgaccacctgtag

SEQ ID NO: 17229 - DNA, 306 bp, Artificial Sequence
  Description of Artificial Sequence: Synthetic coding sequence
atggaccagtacgtgagcaccgccccccccagattccccatcgcccagctgggcaccttcaagcaggacagcgccggcatgggcagaatcttcaagggcaacctgctgcagaagaaggccctgaccaccttcgagaacgagcaccacatcagattcttcaccctgctggtgctgttccacgtgatggtgctgctgagaaaccacagcagaatccagggcgtgagcgaggactggaagagagccaacagcatcttcagaaacttcctgagactgaagagcagcagaaacaccgccgaggccgagtag

SEQ ID NO: 17230 - DNA, 306 bp, Artificial Sequence; identical to SEQ ID NO: 17229
  Description of Artificial Sequence: Synthetic coding sequence

SEQ ID NO: 17231 - DNA, 648 bp, Artificial Sequence
  Description of Artificial Sequence: Synthetic coding sequence
atggacaaggtgcagagcggcttcctgatcctgttcctgttcctgatggagtgccagctgcacctgtgcctgccctacgccgacggcctgcaccccaccggcaacatcaccggcctgcccggcagcaagagaagccagccccccagaaacatcaccaaggagcccaaggtgttcttccacaagacccagctgcccggcatccagggcgccgccagcagaagcaccgccgccagccccaccaaccccatgaagttcctgagaaacaaggccatcatcagacacagacccgccctggtgaaggtgatcctgatcagcagcgtggccttcagcatcgccctgatctgcggcatggccatcagctacatgatctacagactggcccaggccgaggagagacagcagctggagagcctgtacaagaacctgagaatccccctgctgggcgacgaggaggagggcagcgaggacgagggcgagagcacccacctgctgcccgagaacgagaacgagctggagaagttcatccacagcgtgatcatcagcaagagaagcaagaacatcaagaagaagctgaaggaggagcagaacagcgtgaccgagaacaagaccaagaacgccagccacaacggcaagatggaggacctgtag

SEQ ID NO: 17232 - DNA, 2178 bp, Artificial Sequence
  Description of Artificial Sequence: Synthetic coding sequence
atggccaccgccgccaccaccaccaccaccaccaccgccaccgtggccctgaccaccagctgggacaacgccaccggcagacccaccgccgagcccgaccccatcctggacaactacgtgctgctggtggtggtgatgagcctgttcgtgggcggcaccctggtggtgctgagcggcgtgctgctgctgtgcaagagatgctgggacgtgcaccagagactgaacagagccatggaggaggccgagaagaccaccaccacctacctggacaacggcacccaccccgcccaggaccccgacttcagaggcgaggaccccgagtgccaggacgccgagaccgagagattcctgagcaccagcagcaccggcagaagagtgagcttcaacgaggccgccctgttcgagcagagcagaaagacccaggacaagggcagacagggcggctggcagagcaccgccgccggcgccagcggcatgggcggcggcagagccctgatggccagatgctgcagaagatacaccctgaccgagggcgacttccaccacctgaagaacgccagactgacccacctgcacctgccccccctgaagatcgtgaccatccacgagtgcgacagcggcgaggccagcagcgccaccaccccccaccccgccaccagccccaaggccaccctggccatcttccagccccccggcaaggccctgaccggcagaagcgtgggccccagcagcgccctgcccggcgacccctacaacagcgccgccggcgccaccgacttcgccgagatcagccccagcgccagcagcgacagcggcgagggcaccagcctggacgccggcaccagaagcaccaaggccggcggccccggcgccgccgccggccccggcgaggccggccccggcagcggcgccggcaccgtgctgcagttcctgaccagactgagaagacacgccagcctggacggcgccagcccctacttcaaggtgaagaagtggaagctggagcccagccagagagccgccagcctggacaccagaggcagccccaagagacaccacttccagagacagagagccgccagcgagagcaccgagcaggaggagggcgacgccccccaggaggacttcatccagtacatcgccagagccggcgacgccgtggccttcccccaccccagacccttcctggccagccccccccccgccctgggcagactggaggccgccgaggccgccggcggcgccagccccgacagcccccccgagagaggcgccggcagcgccggccccgagcagcagcagccccccctggagcccgacgccgagagagacgccggccccgagcaggcccagaccagctacagagacctgtggagcctgagagccagcctggagctgcacgccgccgccagcgaccacagcagcagcggcaacgacagagacagcgtgagaagcggcgacagcagcggcagcggcagcggcggcgccgcccccgccttccccccccccagcccccccgcccccagacccaaggacggcgaggccagaagactgctgcagatggacagcggctacgccagcatcgagggcagaggcgccggcgacgacaccgagccccccgccgcccccgccagacccagaagccccagagcctggcccagaagacccagaagagactacagcatcgacgagaagaccgacgccctgttccacgagttcctgagacacgacccccacttcgacgacacccccgccgccgccagacacagagccagagcccacccccacgccagaaagcagtggcagagaggcagacagcacagcgaccccggcgccagagccgcccccgccctggccggcacccccgccccccccgccggcgccgccagacccgccagagcccccctgagaagaggcgacagcgtggacggcccccccgacggcagaaccctgggcggcgccggcgacgaccccgccatccccgtgatcgaggaggagcccggcggcggcggctgccccggcagcggcctgtgcgtgctgcccagcggcagcgtgctggacaagctggccgccggcctggacgagagactgttcccccccagactggccgagcccgtggtggccacccccgccctggtggccgccgcccccaccagccccgaccacagccccgcctag

SEQ ID NO: 17233 - DNA, 693 bp, Artificial Sequence
  Description of Artificial Sequence: Synthetic coding sequence
atgccctggaccatcctgctgttcgccgccggcagcctggccatccccgcccccagcatcagactggtgcccccctaccccagcagccaggaggaccccatccacatcgcctgcatggcccccggcaacttccccggcgccaacttcaccctgtacagaggcggccaggtggtgcagctgctgcaggcccccaccgaccagagaggcgtgaccttcaacctgagcggcggcagcagcaaggcccccggcggccccttccactgccagtacggcgtgctgggcgagctgaaccagagccagctgagcgacctgagcgagcccgtgaacgtgagcttccccgtgcccacctggatcctggtgctgagcctgagcctggccggcgccctgttcctgctggccggcctggtggccgtggccctggtggtgagaaaggtgaagctgagaaacctgcagaagaagagagacagagagagctgctgggcccagatcaacttcgacagcaccgacatgagcttcgacaacagcctgttcaccgtgagcgccaagaccatgcccgaggaggaccccgccaccctggacgaccacagcggcaccaccgccacccccagcaacagcagaaccagaaagagacccaccagcaccagcagcagccccgagacccccgagttcagcaccttcagagcctgccagtag

SEQ ID NO: 17234 - DNA, 1215 bp, Artificial Sequence
  Description of Artificial Sequence: Synthetic coding sequence
atggccctgagcctgcccctgggccccagactgggcagcgagcccctgaaccacccccccggcgcccccagagaggccgacatcgtgggctgcaccgtgtgccccgccagcggcgaggagagcaccagccccgagcaggcccagaccctgggccaggacagcctgggcccccccgagcacttccagggcggccccagaggcaacgagcccgccgcccacccccccagatggagcacccccagcagctacgaggaccccgccggcggcaagcactgcgagcaccccatcagcggcctggaggtgctggaggccgagcagaacagcctgcacctgtgcctgctgggcctgggcagaagactgcaggacctggagcagggcctgggccactgggccctggcccagagcggcatggtgcagctgcaggccctgcaggtggacctgagaggcgccgccgagagagtggaggccctgctggccttcggcgagggcctggcccagagaagcgagcccagagcctgggccgccctggagcagatcctgagagccctgggcgcctacagagacagcatcttcagaagactgtggcagctgcaggcccagctggtgagctacagcctggtgttcgaggaggccaacaccctggaccaggacctggaggtggagggcgacagcgactggcccggccccggcggcgtgtggggcccctgggcccccagcagcctgcccaccagcaccgagctggagtgggaccccgccggcgacatcggcggcctgggccccctgggccagaagaccgccagaaccctgggcgtgccctgcgagctgtgcggccagagaggcccccagggcagaggccagggcctggaggaggccgacaccagccacagcagacaggacatgctggagagcggcctgggccaccagaagagactggccagacaccagagacacagcctgctgagaaagccccaggacaagaagagacaggccagcccccacctgcaggacgtgagactggagggcaaccccggcgcccccgaccccgccagcagacagcccctgaccttcctgctgatcctgttcctgctgttcctgctgctggtgggcgccatgttcctgctgcccgccagcggcggcccctgctgcagccacgccagaatccccagaaccccctacctggtgctgagctacgtgaacggcctgccccccgtgtag

SEQ ID NO: 17235 - DNA, 876 bp, Artificial Sequence
  Description of Artificial Sequence: Synthetic coding sequence
atggccctgagcctgcccctgggccccagactgggcagcgagcccctgaaccacccccccggcgcccccagagaggccgacatcgtgggctgcaccgtgtgccccgccagcggcgaggagagcaccagccccgagcaggcccagaccctgggccaggacagcctgggcccccccgagcacttccagggcggccccagaggcaacgagcccgccgcccacccccccagatggagcacccccagcagctacgaggaccccgccggcggcaagcactgcgaggtgttcgaggaggccaacaccctggaccaggacctggaggtggagggcgacagcgactggcccggccccggcggcgtgtggggcccctgggcccccagcagcctgcccaccagcaccgagctggagtgggaccccgccggcgacatcggcggcctgggccccctgggccagaagaccgccagaaccctgggcgtgccctgcgagctgtgcggccagagaggcccccagggcagaggccagggcctggaggaggccgacaccagccacagcagacaggacatgctggagagcggcctgggccaccagaagagactggccagacaccagagacacagcctgctgagaaagccccaggacaagaagagacaggccagcccccacctgcaggacgtgagactggagggcaaccccggcgcccccgaccccgccagcagacagcccctgaccttcctgctgatcctgttcctgctgttcctgctgctggtgggcgccatgttcctgctgcccgccagcggcggcccctgctgcagccacgccagaatccccagaaccccctacctggtgctgagctacgtgaacggcctgccccccgtgtag

SEQ ID NO: 17236 - DNA, 564 bp, Artificial Sequence
  Description of Artificial Sequence: Synthetic coding sequence
atggaggtggaggagatctacaagcaccaggaggtgaagatgcaggcccccgccttcagagacaagaagcagggcgtgagcgccaagaaccagggcgcccacgaccccgactacgagaacatcaccctggccttcaagaaccaggaccacgccaagggcggccacagcagacccaccagccaggtgcccgcccagtgcagaccccccagcgacagcacccaggtgccctgctggctgtacagagccatcctgagcctgtacatcctgctggccctggccttcgtgctgtgcatcatcctgagcgccttcatcatggtgaagaacgccgagatgagcaaggagctgctgggcttcaagagagagctgtggaacgtgagcaacagcgtgcaggcctgcgaggagagacagaagagaggctgggacagcgtgcagcagagcatcaccatggtgagaagcaagatcgacagactggagaccaccctggccggcatcaagaacatcgacaccaaggtgcagaagatcctggaggtgctgcagaagatgccccagagcagcccccagtag

SEQ ID NO: 17237 - DNA, 357 bp, Artificial Sequence
  Description of Artificial Sequence: Synthetic coding sequence
atggtggccagagtgtggagcctgatgagattcctgatcaagggcagcgtggccggcggcgccgtgtacctggtgtacgaccaggagctgctgggccccagcgacaagagccaggccgccctgcagaaggccggcgaggtggtgccccccgccatgtaccagttcagccagtacgtgtgccagcagaccggcctgcagatcccccagctgcccgccccccccaagatctacttccccatcagagacagctggaacgccggcatcatgaccgtgatgagcgccctgagcgtggcccccagcaaggccagagagtacagcaaggagggctgggagtacgtgaaggccagaaccaagtag

SEQ ID NO: 17238 - DNA, 594 bp, Artificial Sequence
  Description of Artificial Sequence: Synthetic coding sequence
atgctgcccctgctgcagctggtgcccgccaagctgctgaacagcagctgcagcctggagaagaccctgcagtgcagctgcagcttccacggcatccccacccccagcgtgcagtggtggatgggcggcgtgcccgtgggcgtggacggcatggacggcagcctgcaggtgaccagcaccatgctgggcccctgggccaacagcaccatcagcctgaccgaggagcccgagatgggcatgagactgctgtgcgagggcaagaaccagaacggcacccacgccctgagcatcctgctgatgagcagaaagagcagcctggccgcccaggccttcgtgaagggcctgatccagggcgccatctacgccggcatcgtgatcgccctgctgttcctgtgcctgctgcccctgatcgtgaagcacatcagaaagaagcaggccaagaaggccgccgccatcagagccaagaagagcagcaaggtgagagccagccaggagctggagatgagcctgaagcccgaggagcccggcaagcccgtggtggccaccttcagcgagagcagaatcctggagaagcaggacaagagagccagctag

SEQ ID NO: 17239 - DNA, 513 bp, Artificial Sequence
  Description of Artificial Sequence: Synthetic coding sequence
atgagaagaagactgtggctgggcctggcctggctgctgctggccagagcccccgacgccgccggcacccccagcgccagcagaggccccagaagctacccccacctggagggcgacgtgagatggagaagactgttcagcagcacccacttcttcctgagagtggaccccggcggcagagtgcagggcaccagatggagacacggccaggacagcatcctggagatcagaagcgtgcacgtgggcgtggtggtgatcaaggccgtgagcagcggcttctacgtggccatgaacagaagaggcagactgtacggcagcagactgtacaccgtggactgcagattcagagagagaatcgaggagaacggccacaacacctacgccagccagagatggagaagaagaggccagcccatgttcctggccctggacagaagaggcggccccagacccggcggcagaaccagaagataccacctgagcgcccacttcctgcccgtgctggtgagctag

SEQ ID NO: 17240 - DNA, 1116 bp, Artificial Sequence
  Description of Artificial Sequence: Synthetic coding sequence
atggcctggaccaagtaccagctgttcctggccggcctgatgctggtgaccggcagcatcaacaccctgagcgccaagtgggccgacaacttcatggccgagggctgcggcggcagcaaggagcacagcttccagcaccccttcctgcaggccgtgggcatgttcctgggcgagttcagctgcctggccgccttctacctgctgagatgcagagccgccggccagagcgacagcagcgtggacccccagcagcccttcaaccccctgctgttcctgccccccgccctgtgcgacatgaccggcaccagcctgatgtacgtggccctgaacatgaccagcgccagcagcttccagatgctgagaggcgccgtgatcatcttcaccggcctgttcagcgtggccttcctgggcagaagactggtgctgagccagtggctgggcatcctggccaccatcgccggcctggtggtggtgggcctggccgacctgctgagcaagcacgacagccagcacaagctgagcgaggtgatcaccggcgacctgctgatcatcatggcccagatcatcgtggccatccagatggtgctggaggagaagttcgtgtacaagcacaacgtgcaccccctgagagccgtgggcaccgagggcctgttcggcttcgtgatcctgagcctgctgctggtgcccatgtactacatccccgccggcagcttcagcggcaaccccagaggcaccctggaggacgccctggacgccttctgccaggtgggccagcagcccctgatcgccgtggccctgctgggcaacatcagcagcatcgccttcttcaacttcgccggcatcagcgtgaccaaggagctgagcgccaccaccagaatggtgctggacagcctgagaaccgtggtgatctgggccctgagcctggccctgggctgggaggccttccacgccctgcagatcctgggcttcctgatcctgctgatcggcaccgccctgtacaacggcctgcacagacccctgctgggcagactgagcagaggcagacccctggccgaggagagcgagcaggagagactgctgggcggcaccagaacccccatcaacgacgccagctag

SEQ ID NO: 17241 - DNA, 867 bp, Artificial Sequence
  Description of Artificial Sequence: Synthetic coding sequence
atgggcggccagttccacggcagaggcctgtggagagagcagggcgcccagctgcccgccagcctgccccccgccctgaacatgaccagcgccagcagcttccagatgctgagaggcgccgtgatcatcttcaccggcctgttcagcgtggccttcctgggcagaagactggtgctgagccagtggctgggcatcctggccaccatcgccggcctggtggtggtgggcctggccgacctgctgagcaagcacgacagccagcacaagctgagcgaggtgatcaccggcgacctgctgatcatcatggcccagatcatcgtggccatccagatggtgctggaggagaagttcgtgtacaagcacaacgtgcaccccctgagagccgtgggcaccgagggcctgttcggcttcgtgatcctgagcctgctgctggtgcccatgtactacatccccgccggcagcttcagcggcaaccccagaggcaccctggaggacgccctggacgccttctgccaggtgggccagcagcccctgatcgccgtggccctgctgggcaacatcagcagcatcgccttcttcaacttcgccggcatcagcgtgaccaaggagctgagcgccaccaccagaatggtgctggacagcctgagaaccgtggtgatctgggccctgagcctggccctgggctgggaggccttccacgccctgcagatcctgggcttcctgatcctgctgatcggcaccgccctgtacaacggcctgcacagacccctgctgggcagactgagcagaggcagacccctggccgaggagagcgagcaggagagactgctgggcggcaccagaacccccatcaacgacgccagctag

SEQ ID NO: 17242 - DNA, 855 bp, Artificial Sequence
  Description of Artificial Sequence: Synthetic coding sequence
atgaagaccagcgccgagctgcacgagcaggagaagccccccagcagccccagagccaccggccccggcagactgggccacgccagaggcagaggccccgacgccctgagaggcggcgccgccggccccggcagagccagcagcggcgcccccagagagagaaagatggccccccacgaccccggcagcctgaccaccctggtgccctgggccgccgccctgctgctggccctgggcgtggagagagccctggccctgcccgagatctgcacccagtgccccggcagcgtgcagaacctgagcaaggtggccttctactgcaagaccaccagagagctgatgctgcacgccagatgctgcctgaaccagaagggcaccatcctgggcctggacctgcagaactgcagcctggaggaccccggccccaacttccaccaggcccacaccaccgtgatcatcgacctgcaggccaaccccctgaagggcgacctggccaacaccttcagaggcttcacccagctgcagaccctgatcctgccccagcacgtgaactgccccggcggcatcaacgcctggaacaccatcaccagctacatcgacaaccagatctgccagggccagaagaacctgtgcaacaacaccggcgaccccgagatgtgccccgagaacggcagctgcgtgcccgacggccccggcctgctgcagtgcgtgtgcgccgacggcttccacggctacaagtgcatgagacagggcagcttcagcctgctgatgttcttcggcatcctgggcgccaccaccctgagcgtgagcatcctgctgtgggccacccagagaagaaaggccaagaccagctag

SEQ ID NO: 17243 - DNA, 516 bp, Artificial Sequence
  Description of Artificial Sequence: Synthetic coding sequence
atgctgcacgccagatgctgcctgaaccagaagggcaccatcctgggcctggacctgcagaactgcagcctggaggaccccggccccaacttccaccaggcccacaccaccgtgatcatcgacctgcaggccaaccccctgaagggcgacctggccaacaccttcagaggcttcacccagctgcagaccctgatcctgccccagcacgtgaactgccccggcggcatcaacgcctggaacaccatcaccagctacatcgacaaccagatctgccagggccagaagaacctgtgcaacaacaccggcgaccccgagatgtgccccgagaacggcagctgcgtgcccgacggccccggcctgctgcagtgcgtgtgcgccgacggcttccacggctacaagtgcatgagacagggcagcttcagcctgctgatgttcttcggcatcctgggcgccaccaccctgagcgtgagcatcctgctgtgggccacccagagaagaaaggccaagaccagctag

SEQ ID NO: 17244 - DNA, 228 bp, Artificial Sequence
  Description of Artificial Sequence: Synthetic coding sequence
atgctgcacgccagatgctgcctgaaccagaagggcaccatcctgggcctggacctgcagaactgcagcctggaggaccccggccccaacttccaccaggcccacaccaccgtgatcatcgacctgcaggccaaccccctgaagggcgacctggccaacaccttcagaggcttcacccagctgcagaccctgatcctgccccagcacgtgaactgccccggcggctag

SEQ ID NO: 17245 - DNA, 876 bp, Artificial Sequence
  Description of Artificial Sequence: Synthetic coding sequence
atggccctggccgccagactgctgccccagttcctgcacagcagaagcctgccctgcggcgccgtgagactgagaacccccgccgtggccgaggtgagactgcccagcgccaccctgtgctacttctgcagatgcagactgggcctgggcgccgccctgttccccagaagcgccagagccctggccgccagcgccctgcccgcccagggcagcagatggcccgtgctgagcagccccggcctgcccgccgccttcgccagcttccccgcctgcccccagagaagctacagcaccgaggagaagccccagcagcaccagaagaccaagatgatcgtgctgggcttcagcaaccccatcaactgggtgagaaccagaatcaaggccttcctgatctgggcctacttcgacaaggagttcagcatcaccgagttcagcgagggcgccaagcaggccttcgcccacgtgagcaagctgctgagccagtgcaagttcgacctgctggaggagctggtggccaaggaggtgctgcacgccctgaaggagaaggtgaccagcctgcccgacaaccacaagaacgccctggccgccaacatcgacgagatcgtgttcaccagcaccggcgacatcagcatctactacgacgagaagggcagaaagttcgtgaacatcctgatgtgcttctggtacctgaccagcgccaacatccccagcgagaccctgagaggcgccagcgtgttccaggtgaagctgggcaaccagaacgtggagaccaagcagctgctgagcgccagctacgagttccagagagagttcacccagggcgtgaagcccgactggaccatcgccagaatcgagcacagcaagctgctggagtag

SEQ ID NO: 17246 - DNA, 876 bp, Artificial Sequence; identical to SEQ ID NO: 17245
  Description of Artificial Sequence: Synthetic coding sequence

SEQ ID NO: 17247 - DNA, 1326 bp, Artificial Sequence
  Description of Artificial Sequence: Synthetic coding sequence
atgagcgtgctgctgagaagcggcctgggccccctgtgcgccgtggccagagccgccatccccttcatctggagaggcaagtacttcagcagcggcaacgagcccgccgagaaccccgtgacccccatgctgagacacctgatgtacaagatcaagagcaccggccccatcaccgtggccgagtacatgaaggaggtgctgaccaaccccgccaagggctactacgtgtacagagacatgctgggcgagaagggcgacttcatcaccagccccgagatcagccagatcttcggcgagctgctgggcatctggttcatcagcgagtggatggccaccggcaagagcaccgccttccagctggtggagctgggccccggcagaggcaccctggtgggcgacatcctgagagtgttcacccagctgggcagcgtgctgaagaactgcgacatcagcgtgcacctggtggaggtgagccagaagctgagcgagatccaggccctgaccctgaccaaggagaaggtgcccctggagagaaacgccggcagccccgtgtacatgaagggcgtgaccaagagcggcatccccatcagctggtacagagacctgcacgacgtgcccaagggctacagcttctacctggcccacgagttcttcgacgtgctgcccgtgcacaagttccagaagaccccccagggctggagagaggtgttcgtggacatcgacccccaggtgagcgacaagctgagattcgtgctggcccccagcgccacccccgccgaggccttcatccagcacgacgagaccagagaccacgtggaggtgtgccccgacgccggcgtgatcatcgaggagctgagccagagaatcgccctgaccggcggcgccgccctggtggccgactacggccacgacggcaccaagaccgacaccttcagaggcttctgcgaccacaagctgcacgacgtgctgatcgcccccggcaccgccgacctgaccgccgacgtggacttcagctacctgagaagaatggcccagggcaaggtggccagcctgggccccatcaagcagcacaccttcctgaagaacatgggcatcgacgtgagactgaaggtgctgctggacaagagcaacgagcccagcgtgagacagcagctgctgcagggctacgacatgctgatgaaccccaagaagatgggcgagagattcaacttcttcgccctgctgccccaccagagactgcagggcggcagataccagagaaacgccagacagagcaagcccttcgccagcgtggtggccggcttcagcgagctggcctggcagtag

SEQ ID NO: 17248 - DNA, 1593 bp, Artificial Sequence
  Description of Artificial Sequence: Synthetic coding sequence
atgcaccccggcagaaccaccggcaagggccccagcacccacacccagatcgaccagcagccccccagactgctgatcgtgcacatcgccctgcccagctgggccgacatctgcaccaacctgtgcgaggccctgcagaacttcttcagcctggcctgcagcctgatgggccccagcagaatgagcctgttcagcctgtacatggtgcaggaccagcacgagtgcatcctgcccttcgtgcaggtgaagggcaacttcgccagactgcagacctgcatcagcgagctgagaatgctgcagagagagggctgcttcagaagccagggcgccagcctgagactggccgtggaggacggcctgcagcagttcaagcagtacagcagacacgtgaccaccagagccgccctgacctacaccagcctggagatcaccatcctgaccagccagcccggcaaggaggtggtgaagcagctggaggagggcctgaaggacaccgacctggccagagtgagaagattccaggtggtggaggtgaccaagggcatcctggagcacgtggacagcgccagccccgtggaggacaccagcaacgacgagagcagcatcctgggcaccgacatcgacctgcagaccatcgacaacgacatcgtgagcatggagatcttcttcaaggcctggctgcacaacagcggcaccgaccaggagcagatccacctgctgctgagcagccagtgcttcagcaacatcagcagacccagagacaaccccatgtgcctgaagtgcgacctgcaggagagactgctgtgccccagcctgctggccggcaccgccgacggcagcctgagaatggacgaccccaagggcgacttcatcaccctgtaccagatggccagccagagcagcgccagccactacaagctgcaggtgatcaaggccctgaagagcagcggcctgtgcgagagcctgacctacggcctgcccttcatcctgagacccaccagctgctggcagctggactgggacgagctggagaccaaccagcagcacttccacgccctgtgccacagcctgctgaagagagagtggctgctgctggccaagggcgagccccccggccccggccacagccagagaatccccgccagcaccttctacgtgatcatgcccagccacagcctgaccctgctggtgaaggccgtggccaccagagagctgatgctgcccagcaccttccccctgctgcccgaggacccccacgacgacagcctgaagaacgtggagagcatgctggacagcctggagctggagcccacctacaaccccctgcacgtgcagagccacctgtacagccacctgagcagcatctacgccaagccccagggcagactgcacccccactgggagagcagagcccccagaaagcacccctgcaagaccggccagctgcagaccaacagagccagagccaccgtggcccccctgcccatgacccccgtgcccggcagagccagcaagatgcccgccgccagcaagagcagcagcgacgccttcttcctgcccagcgagtgggagaaggaccccagcagaccctag

SEQ ID NO: 17249 - DNA, 540 bp, Artificial Sequence
  Description of Artificial Sequence: Synthetic coding sequence
atggacgaccccaagggcgacttcatcaccctgtaccagatggccagccagagcagcgccagccactacaagctgcaggtgatcaaggccctgaagagcagcggcctgtgcgagagcctgacctacggcctgcccttcatcctgagacccaccagctgctggcagctggactgggacgagctggagaccaaccagcagcacttccacgccctgtgccacagcctgctgagcatgctggacagcctggagctggagcccacctacaaccccctgcacgtgcagagccacctgtacagccacctgagcagcatctacgccaagccccagggcagactgcacccccactgggagagcagagcccccagaaagcacccctgcaagaccggccagctgcagaccaacagagccagagccaccgtggcccccctgcccatgacccccgtgcccggcagagccagcaagatgcccgccgccagcaagagcagcagcgacgccttcttcctgcccagcgagtgggagaaggaccccagcagaccctag

SEQ ID NO: 17250 - DNA, 429 bp, Artificial Sequence
  Description of Artificial Sequence: Synthetic coding sequence
atgcaccccggcagaaccaccggcaagggccccagcacccacacccagatcgaccagcagccccccagactgctgatcgtgcacatcgccctgcccagctgggccgacatctgcaccaacctgtgcgaggccctgcagaacttcttcagcctggcctgcagcctgatgggccccagcagaatgagcctgttcagcctgtacatggtgcaggaccagcacgagtgcatcctgcccttcgtgcaggtgaagggcaacttcgccagactgcagacctgcatcagcgagctgagaatgctgcagagagagggctgcttcagaagccagggcgccagcctgagactggccgtggaggacggcctgcagcagttcaagcagtacagcagacacgtgaccaccagagccgccctgacctacaccagcctggagtag

SEQ ID NO: 17251 - DNA, 1581 bp, Artificial Sequence
  Description of Artificial Sequence: Synthetic coding sequence
atgcaccccggcagaaccaccggcaagggccccagcacccacacccagatcgaccagcagccccccagactgctgatcgtgcacatcgccctgcccagctgggccgacatctgcaccaacctgtgcgaggccctgcagaacttcttcagcctggcctgcagcctgatgggccccagcagaatgagcctgttcagcctgtacatggtgcaggaccagcacgagtgcatcctgcccttcgtgcaggtgaagggcaacttcgccagactgcagacctgcatcagcgagctgagaatgctgcagagagagggctgcttcagaagccagggcgccagcctgagactggccgtggaggacggcctgcagcagttcaagcagtacagcagacacgtgaccaccagagccgccctgacctacaccagcctggagatcaccatcctgaccagccagcccggcaaggaggtggtgaagcagctggaggagggcctgaaggacaccgacctggccagagtgagaagattccaggtggtggaggtgaccaagggcatcctggagcacgtggacagcgccagccccgtggaggacaccagcaacgacgagagcagcatcctgggcaccgacatcgacctgcagaccatcgacaacgacatcgtgagcatggagatcttcttcaaggcctggctgcacaacagcggcaccgaccaggagcagatccacctgctgctgagcagccagtgcttcagcaacatcagcagacccagagacaaccccatgtgcctgaagtgcgacctgcaggagagactgctgtgccccagcctgctggccggcaccgccgacggcagcctgagaatggacgaccccaagggcgacttcatcaccctgtaccagatggccagccagagcagcgccagccactacaagctgcaggtgatcaaggccctgaagagcagcggcctgtgcgagagcctgacctacggcctgcccttcatcctgagacccaccagctgctggcagctggactgggacgagctggagaccaaccagcagcacttccacgccctgtgccacagcctgctgaagagagagtggctgctgctggccaagggcgagccccccggccccggccacagccagagaatccccgccagcaccttctacgtgatcatgcccagccacagcctgaccctgctggtgaaggccgtggccaccagagagctgatgctgcccagcaccttccccctgctgcccgaggacccccacgacgacagcctgaagaacgtggagagcatgctggacagcctggagctggagcccacctacaaccccctgcacgtgcagagccacctgtacagccacctgagcagcatctacgccaagccccagggcagactgcacccccactgggagagcagagcccccagaaagaccggccagctgcagaccaacagagccagagccaccgtggcccccctgcccatgacccccgtgcccggcagagccagcaagatgcccgccgccagcaagagcagcagcgacgccttcttcctgcccagcgagtgggagaaggaccccagcagaccctag

SEQ ID NO: 17252 - DNA, 864 bp, Artificial Sequence
  Description of Artificial Sequence: Synthetic coding sequence
atggaggagaaggaggacaagcaccagcagcacaagatcgaggacgccgccatcacctacgtgagcgagaacgaggagatcaagcacgaggagaagcccggcaagagcatccaccacagcaagagccacgtgggcagaggcagaatctactacgccaagttcatcaacaccaacgccagaacctacaacgagcccttcccctacatcgaccccaagaagggccccgagatccagggcgactggtggagccacggcaaggccctggagcccgtgttcctgcccccctacgacagcaagagcacccagagaagcgacttccagaagcccagctgccccctggtgctgcccgtgaagcacagcaagatgcagaagcccagctgcggcatcgtgcccctggccagccccggcaccagcgccgagctgcagaacaacttcatcgagtacatcagcttcatccaccagtacgacgccagaaagacccccaacgagcccctgcagggcaagagacacggcgccttcgtgcagagagagatcaagcccggcagcagacccaccgtgcccaagggcgccgaggtgctgctgaacacccccggcagcagaagcagcgagcagagcaagaagaccgagaagggcaacagcgccgagagcagaatgatcagccccggcctgtgccagcagaacagccaggagctgctggagcccaagacccacctgagcgagaccgacgtgagacaggccgccaaggcctgccccagcacccccgagagcagagagaagaccagcggcgccacccagaccaccgtgggcgacgccctgttcaccagacacaagcccctgaacccccccatcaagaagagcgagtag

SEQ ID NO: 17253 - DNA, 366 bp, Artificial Sequence
  Description of Artificial Sequence: Synthetic coding sequence
atggccagctgcctggccctgagaatggccctgctgctggtgagcggcgtgctggcccccgccgtgctgaccgacgacgtgccccaggagcccgtgcccaccctgtggaacgagcccgccgagctgcccagcggcgagggccccgtggagagcaccagccccggcagagagcccgtggacaccggcccccccgcccccaccgtggcccccggccccgaggacagcaccgcccaggagagactggaccagggcggcggcagcctgggccccggcgccatcgccgccatcgtgatcgccgccctgctggccacctgcgtggtgctggccctggtggtggtggccctgagaaagttcagcgccagctag

SEQ ID NO: 17254 - DNA, 366 bp, Artificial Sequence; identical to SEQ ID NO: 17253
  Description of Artificial Sequence: Synthetic coding sequence

SEQ ID NO: 17255 - DNA, 366 bp, Artificial Sequence; identical to SEQ ID NO: 17253
  Description of Artificial Sequence: Synthetic coding sequence

SEQ ID NO: 17256 - DNA, 1371 bp, Artificial Sequence
  Description of Artificial Sequence: Synthetic coding sequence
atgagcccctggagctggttcctgctgcagaccctgtgcctgctgcccaccggcgccgccagcagaagaggcgcccccggcaccgccaactgcgagctgaagccccagcagagcgagctgaacagcttcctgtggaccatcaagagagacccccccagctacttcttcggcaccatccacgtgccctacaccagagtgtgggacttcatccccgacaacagcaaggaggccttcctgcagagcagcatcgtgtacttcgagctggacctgaccgacccctacaccatcagcgccctgaccagctgccagatgctgccccagggcgagaacctgcaggacgtgctgcccagagacatctactgcagactgaagagacacctggagtacgtgaagctgatgatgcccctgtggatgacccccgaccagagaggcaagggcctgtacgccgactacctgttcaacgccatcgccggcaactgggagagaaagagacccgtgtgggtgatgctgatggtgaacagcctgaccgaggtggacatcaagagcagaggcgtgcccgtgctggacctgttcctggcccaggaggccgagagactgagaaagcagaccggcgccgtggagaaggtggaggagcagtgccaccccctgaacggcctgaacttcagccaggtgcccaacttcatcaacgccaccctgcccccccaggagagaatcaccgcccaggagatcgacagctacctgagaagagagctgatctacaagagaaacgagagaatcggcaagagagtgaaggccctgctggaggagttccccgacaagggcttcttcttcgccttcggcgccggccacttcatgggcaacaacaccgtgctggacgtgctgagaagagagggctacgaggtggagcacgcccccgccggcagacccatccacaagggcaagagcaagaagaccagcaccagacccaccctgagcaccatcttcgcccccaaggtgcccaccctggaggtgcccgcccccgaggccgtgagcagcggccacagcaccctgccccccctggtgagcagacccggcagcgccgacacccccagcgaggccgagcagagattcagaaagaagagaagaagaagccagagaagacccagactgagacagttcagcgacctgtgggtgagactggaggagagcgacatcgtgccccagctgcaggtgcccgtgctggacagacacatcagcaccgagctgagactgcccagaagaggccacagccaccacagccagatggtggccagcagcgcctgcctgagcctgtggacccccgtgttctgggtgctggtgctggccttccagaccgagacccccctgctgtag

SEQ ID NO: 17257 - DNA, 1518 bp, Artificial Sequence
  Description of Artificial Sequence: Synthetic coding sequence
atgagcccctggagctggttcctgctgcagaccctgtgcctgctgcccaccggcgccgccagcagaagaggcgcccccggcaccgccaactgcgagctgaagccccagcagagcgagctgaacagcttcctgtggaccatcaagagagacccccccagctacttcttcggcaccatccacgtgccctacaccagagtgtgggacttcatccccgacaacagcaaggaggccttcctgcagagcagcatcgtgtacttcgagctggacctgaccgacccctacaccatcagcgccctgaccagctgccagatgctgccccagggcgagaacctgcaggacgtgctgcccagagacatctactgcagactgaagagacacctggagtacgtgaagctgatgatgcccctgtggatgacccccgaccagagaggcaagggcctgtacgccgactacctgttcaacgccatcgccggcaactgggagagaaagagacccgtgtgggtgatgctgatggtgaacagcctgaccgaggtggacatcaagagcagaggcgtgcccgtgctggacctgttcctggcccaggaggccgagagactgagaaagcagaccggcgccgtggagaaggtggaggagcagtgccaccccctgaacggcctgaacttcagccaggtgatcttcgccctgaaccagaccctgctgcagcaggagagcctgagagccggcagcctgcagatcccctacaccaccgaggacctgatcaagcactacaactgcggcgacctgagcagcgtgatcctgagccacgacagcagccaggtgcccaacttcatcaacgccaccctgcccccccaggagagaatcaccgcccaggagatcgacagctacctgagaagagagctgatctacaagagaaacgagagaatcggcaagagagtgaaggccctgctggaggagttccccgacaagggcttcttcttcgccttcggcgccggccacttcatgggcaacaacaccgtgctggacgtgctgagaagagagggctacgaggtggagcacgcccccgccggcagacccatccacaagggcaagagcaagaagaccagcaccagacccaccctgagcaccatcttcgcccccaaggtgcccaccctggaggtgcccgcccccgaggccgtgagcagcggccacagcaccctgccccccctggtgagcagacccggcagcgccgacacccccagcgaggccgagcagagattcagaaagaagagaagaagaagccagagaagacccagactgagacagttcagcgacctgtgggtgagactggaggagagcgacatcgtgccccagctgcaggtgcccgtgctggacagacacatcagcaccgagctgagactgcccagaagaggccacagccaccacagccagatggtggccagcagcgcctgcctgagcctgtggacccccgtgttctgggtgctggtgctggccttccagaccgagacccccctgctgtag

SEQ ID NO: 17258 - DNA, 1878 bp, Artificial Sequence
  Description of Artificial Sequence: Synthetic coding sequence
atgtgcgagaccagcgccttctacgtgcccggcgtggcccccatcaacttccaccagaacgaccccgtggagatcaaggccgtgaagctgaccagcagcagaacccagctgccctacgagtactacagcctgcccttctgccagcccagcaagatcacctacaaggccgagaacctgggcgaggtgctgagaggcgacagaatcgtgaacacccccttccaggtgctgatgaacagcgagaagaagtgcgaggtgctgtgcagccagagcaacaagcccgtgaccctgaccgtggagcagagcagactggtggccgagagaatcaccgaggactactacgtgcacctgatcgccgacaacctgcccgtggccaccagactggagctgtacagcaacagagacagcgacgacaagaagaaggagaaggacgtgcagttcgagcacggctacagactgggcttcaccgacgtgaacaagatctacctgcacaaccacctgagcttcatcctgtactaccacagagaggacatggaggaggaccaggagcacacctacagagtggtgagattcgaggtgatcccccagagcatcagactggaggacctgaaggccgacgagaagagcagctgcaccctgcccgagggcaccaacagcagcccccaggagatcgaccccaccaaggagaaccagctgtacttcacctacagcgtgcactgggaggagagcgacatcaagtgggccagcagatgggacacctacctgaccatgagcgacgtgcagatccactggttcagcatcatcaacagcgtggtggtggtgttcttcctgagcggcatcctgagcatgatcatcatcagaaccctgagaaaggacatcgccaactacaacaaggaggacgacatcgaggacaccatggaggagagcggctggaagctggtgcacggcgacgtgttcagacccccccagtaccccatgatcctgagcagcctgctgggcagcggcatccagctgttctgcatgatcctgatcgtgatcttcgtggccatgctgggcatgctgagccccagcagcagaggcgccctgatgaccaccgcctgcttcctgttcatgttcatgggcgtgttcggcggcttcagcgccggcagactgtacagaaccctgaagggccacagatggaagaagggcgccttctgcaccgccaccctgtaccccggcgtggtgttcggcatctgcttcgtgctgaactgcttcatctggggcaagcacagcagcggcgccgtgcccttccccaccatggtggccctgctgtgcatgtggttcggcatcagcctgcccctggtgtacctgggctactacttcggcttcagaaagcagccctacgacaaccccgtgagaaccaaccagatccccagacagatccccgagcagagatggtacatgaacagattcgtgggcatcctgatggccggcatcctgcccttcggcgccatgttcatcgagctgttcttcatcttcagcgccatctgggagaaccagttctactacctgttcggcttcctgttcctggtgttcatcatcctggtggtgagctgcagccagatcagcatcgtgatggtgtacttccagctgtgcgccgaggactacagatggtggtggagaaacttcctggtgagcggcggcagcgccttctacgtgctggtgtacgccatcttctacttcgtgaacaagctggacatcgtggagttcatccccagcctgctgtacttcggctacaccgccctgatggtgctgagcttctggctgctgaccggcaccatcggcttctacgccgcctacatgttcgtgagaaagatctacgccgccgtgaagatcgactag

SEQ ID NO: 17259 - DNA, 1701 bp, Artificial Sequence
  Description of Artificial Sequence: Synthetic coding sequence
atgcccggccaccccggcgccgccgagcagctggtgaagaccggctggagaagctggcacctgggcttctggaaggccctggcccccctgcaggccgcctgggacgccttcagccagcccgtgcccgccagctgcggccagctgctgacccagctgctgctgtgcgccagcctggccgccgccgccgccggcctggtgtaccactggctggccagcctgctgctgtacccccccggccccagcgccatggtggccaccgtgtgcggcctgctggtgttcctgagcctgggcctggtgccccccgtgagatgcctgttcgccctgagcgtgcccaccctgggcatggagcagggcagaagactgctgctgagctacagcaccgccaccctggccatcgccgtggtgcccaacgtgctggccaacgtgggcgccgccggccaggtgctgagatgcgtgaccgagggcagcctggagagcctgctgaacaccacccaccagctgcacgccgccagcagagccctgggccccaccggccaggccggcagcagaggcctgaccttcgaggcccaggacaacggcagcgccttctacctgcacatgctgagagtgacccagcaggtgctggaggacttcagcggcctggagagcctggccagagccgccgccctgggcacccagagagtggtgaccggcctgttcatgctgggcctgctggtggagagcgcctggtacctgcactgctacctgaccgacctgagattcgacaacatctacgccacccagcagctgacccagagactggcccaggcccaggccacccacctgctggcccccccccccacctggctgctgcaggccgcccagctgagactgagccaggaggagctgctgagctgcctgctgagactgggcctgctggccctgctgctggtggccaccgccgtggccgtggccaccgaccacgtggccttcctgctggcccaggccaccgtggactgggcccagaagctgcccaccgtgcccatcaccctgaccgtgaagtacgacgtggcctacaccgtgctgggcttcatccccttcctgttcaaccagctggcccccgagagccccttcctgagcgtgcacagcagctaccagtgggagctgagactgaccagcgccagatgccccctgctgcccgccagaagacccagagccgccgcccccctggccgccggcgccctgcagctgctggccggcagcaccgtgctgctggaggcctacgccagaagactgagacacgccatcgccgccagcttcttcaccgcccaggaggccagaagagtgagacacctgcacgccagactgcagagaagacacgacagacaccagggccagcagctgcccctgggcgaccccagctgcgtgcccacccccagacccgcctgcaagccccccgcctggatcgactacagactggacgccctgagaaccgagagcagcgagggcgagggcaaggagctgtggagctgcagagacctgagctgcaacctgggccccgtgccccccccctgcgtgaccctgggcaagagcctgcacctgagcgagcccagattcctgcacctgcacaacgacagcatcttcaccatcgacgtgacctacttccccagaagagacgtggtgagaatggagggcaacaccggccacgacagacccggctag

SEQ ID NO: 17260 - DNA, 432 bp, Artificial Sequence
  Description of Artificial Sequence: Synthetic coding sequence
atgagcggcggcagaagaaaggaggagcccccccagccccagctggccaacggcgccctgaaggtgagcgtgtggagcaaggtgctgagaagcgacgccgcctgggaggacaaggacgagttcctggacgtgatctactggttcagacagatcatcgccgtggtgctgggcgtgatctggggcgtgctgcccctgagaggcttcctgggcatcgccggcagcttcggcagcagcttcaccctgcccagcatcatgaccgacggcgtgcagctgcccagcgccccctaccccgtgcagagaaccctgctgatcaccgcccaggagctggacagatggggcacccccgccccctggaacctggaggacccctgcttcctggacagagagagcgtgtgctgggccagcgtgttcagcgccagagtggtgacctag

SEQ ID NO: 17261 - DNA, 390 bp, Artificial Sequence
  Description of Artificial Sequence: Synthetic coding sequence
atgagcggcggcagaagaaaggaggagcccccccagccccagctggccaacggcgccctgaaggtgagcgtgtggagcaaggtgctgagaagcgacgccgcctgggaggacaaggacgagttcctggacgtgatctactggttcagacagatcatcgccgtggtgctgggcgtgatctggggcgtgctgcccctgagaggcttcctgggcatcgccggcttctgcctgatcaacgccggcgtgctgtacctgtacttcagcaactacctgcagatcgacgaggaggagtacggcggcacctgggagctgaccaaggagggcttcatgaccagcttcgccctgttcatggtgatctggatcatcttctacaccgccatccactacgactag

SEQ ID NO: 17262 - DNA, 414 bp, Artificial Sequence
  Description of Artificial Sequence: Synthetic coding sequence
atgagcggcggcagaagaaaggaggagcccccccagccccagctggccaacggcgccctgaaggtgagcgtgtggagcaaggtgctgagaagcgacgccgcctgggaggacaaggacgagttcctggacgtgatctactggttcagacagatcatcgccgtggtgctgggcgtgatctggggcgtgctgcccctgagaggcttcctgggcatcgccggcttctgcctgatcaacgccggcgtgctgtacctgtacttcagcaactacctgcagatcgacgaggaggagtacggcggcacctgggagctgaccaaggagggcttcatgaccagcttcgccctgttcatggtgtgcgtggccgacagcttcaccaccggccacctggaccacctgctgcactgccaccccctgtag

SEQ ID NO: 17263 - DNA, 960 bp, Artificial Sequence
  Description of Artificial Sequence: Synthetic coding sequence
atgagcagcccccaggcccccgaggacggccagggctgcggcgacagaggcgacccccccggcgacctgagaagcgtgctggtgaccaccgtgctgaacctggagcccctggacgaggacctgttcagaggcagacactactgggtgcccgccaagagactgttcggcggccagatcgtgggccaggccctggtggccgccgccaagagcgtgagcgaggacgtgcacgtgcacagcctgcactgctacttcgtgagagccggcgaccccaagctgcccgtgctgtaccaggtggagagaaccagaaccggcagcagcttcagcgtgagaagcgtgaaggccgtgcagcacggcaagcccatcttcatctgccaggccagcttccagcaggcccagcccagccccatgcagcaccagttcagcatgcccaccgtgcccccccccgaggagctgctggactgcgagaccctgatcgaccagtacctgagagaccccaacctgcagaagagataccccctggccctgaacagaatcgccgcccaggaggtgcccatcgagatcaagcccgtgaaccccagccccctgagccagctgcagagaatggagcccaagcagatgttctgggtgagagccagaggctacatcggcgagggcgacatgaagatgcactgctgcgtggccgcctacatcagcgactacgccttcctgggcaccgccctgctgccccaccagtggcagcacaaggtgcacttcatggtgagcctggaccacagcatgtggttccacgcccccttcagagccgaccactggatgctgtacgagtgcgagagcccctgggccggcggcagcagaggcctggtgcacggcagactgtggagacaggacggcgtgctggccgtgacctgcgcccaggagggcgtgatcagagtgaagccccaggtgagcgagagcaagctgtag

SEQ ID NO: 17264 - DNA, 870 bp, Artificial Sequence
  Description of Artificial Sequence: Synthetic coding sequence
atgagcgaggccgacggcctgagacagagaagacccctgagaccccaggtggtgaccgacgacgacggccaggcccccgaggccaaggacggcagcagcttcagcggcagagtgttcagagtgaccttcctgatgctggccgtgagcctgaccgtgcccctgctgggcgccatgatgctgctggagagccccatcgacccccagcccctgagcttcaaggagccccccctgctgctgggcgtgctgcaccccaacaccaagctgagacaggccgagagactgttcgagaaccagctggtgggccccgagagcatcgcccacatcggcgacgtgatgttcaccggcaccgccgacggcagagtggtgaagctggagaacggcgagatcgagaccatcgccagattcggcagcggcccctgcaagaccagagacgacgagcccgtgtgcggcagacccctgggcatcagagccggccccaacggcaccctgttcgtggccgacgcctacaagggcctgttcgaggtgaacccctggaagagagaggtgaagctgctgctgagcagcgagacccccatcgagggcaagaacatgagcttcgtgaacgacctgaccgtgacccaggacggcagaaagatctacttcaccgacagcagcagcaagtggcagagaagagactacctgctgctggtgatggagggcaccgacgacggcagactgctggagtacgacaccgtgaccagagaggtgaaggtgctgctggaccagctgagattccccaacggcgtgcagctgagccccgccgaggacttcgtgctggtggccgagaccaccatggccagaatcagaagcagcctggtgaagagaagatag

SEQ ID NO: 17265 - DNA, 1230 bp, Artificial Sequence
  Description of Artificial Sequence: Synthetic coding sequence
tgagtggtgaccgacgacgacggccaggcccccgaggccaaggacggcagcagcttcagcggcagagtgttcagagtgaccttcctgatgctggccgtgagcctgaccgtgcccctgctgggcgccatgatgctgctggagagccccatcgacccccagcccctgagcttcaaggagccccccctgctgctgggcgtgctgcaccccaacaccaagctgagacaggccgagagactgttcgagaaccagctggtgggccccgagagcatcgcccacatcggcgacgtgatgttcaccggcaccgccgacggcagagtggtgaagctggagaacggcgagatcgagaccatcgccagattcggcagcggcccctgcaagaccagagacgacgagcccgtgtgcggcagacccctgggcatcagagccggccccaacggcaccctgttcgtggccgacgcctacaagggcctgttcgaggtgaacccctggaagagagaggtgaagctgctgctgagcagcgagacccccatcgagggcaagaacatgagcttcgtgaacgacctgaccgtgacccaggacggcagaaagatctacttcaccgacagcagcagcaagtggcagagaagagactacctgctgctggtgatggagggcaccgacgacggcagactgctggagtacgacaccgtgaccagagaggtgaaggtgctgctggaccagctgagattccccaacggcgtgcagctgagccccgccgaggacttcgtgctggtggccgagaccaccatggccagaatcagaagagtgtacgtgagcggcctgatgaagggcggcgccgacctgttcgtggagaacatgcccggcttccccgacaacatcagacccagcagcagcggcggctactgggtgggcatgagcaccatcagacccaaccccggcttcagcatgctggacttcctgagcgagagaccctggatcaagagaatgatcttcaagggcagctgcgccggctgcgacctgctgttcagccaggagaccgtgatgaagttcgtgcccagatacagcctggtgctggagctgagcgacagcggcgccttcagaagaagcctgcacgaccccgacggcctggtggccacctacatcagcgaggtgcacgagcacgacggccacctgtacctgggcagcttcagaagccccttcctgtgcagactgagcctgcaggccgtgtag

SEQ ID NO: 17266 - DNA, 363 bp, Artificial Sequence
  Description of Artificial Sequence: Synthetic coding sequence
atgatgcccagcagaaccaacctggccaccggcatccccagcagcaaggtgaagtacagcagactgagcagcaccgacgacggctacatcgacctgcagttcaagaagaccccccccaagatcccctacaaggccatcgccctggccaccgtgctgttcctgatcggcgccttcctgatcatcatcggcagcctgctgctgagcggctacatcagcaagggcggcgccgacagagccgtgcccgtgctgatcatcggcatcctggtgttcctgcccggcttctaccacctgagaatcgcctactacgccagcaagggctacagaggctacagctacgacgacatccccgacttcgacgactag

SEQ ID NO: 17267 - DNA, 552 bp, Artificial Sequence
  Description of Artificial Sequence: Synthetic coding sequence
atgcagccctgggccctgcccaccgtgggcgagctgtgggtgtgcggcagacccggcgccgccctgagatggagcctggtgctgagccccagactggagcccagcggcgtgatcagcgcccactgcaacctgcacctgctggccagcagcgacagcagcgccagcgccagcagactgtgccagagagtgatgatgcccagcagaaccaacctggccaccggcatccccagcagcaaggtgaagtacagcagactgagcagcaccgacgacggctacatcgacctgcagttcaagaagaccccccccaagatcccctacaaggccatcgccctggccaccgtgctgttcctgatcggcgccttcctgatcatcatcggcagcctgctgctgagcggctacatcagcaagggcggcgccgacagagccgtgcccgtgctgatcatcggcatcctggtgttcctgcccggcttctaccacctgagaatcgcctactacgccagcaagggctacagaggctacagctacgacgacatccccgacttcgacgactag

SEQ ID NO: 17268 - DNA, 225 bp, Artificial Sequence
  Description of Artificial Sequence: Synthetic coding sequence
atgatgcccagcagaaccaacctggccaccggcatccccagcagcaaggtgaagtacagcagactgagcagcaccgacgacggctacatcgacctgcagttcaagaagaccccccccaagatcccctacaaggccatcgccctggccaccgtgctgttcctgatcggcgccttcctgatcatcatcggcagcctgctgctgagcggctacatcagcaagggctag

SEQ ID NO: 17269 - DNA, 363 bp, Artificial Sequence; identical to SEQ ID NO: 17266
  Description of Artificial Sequence: Synthetic coding sequence

SEQ ID NO: 17270 - DNA, 363 bp, Artificial Sequence; identical to SEQ ID NO: 17266
  Description of Artificial Sequence: Synthetic coding sequence

SEQ ID NO: 17271 - DNA, 363 bp, Artificial Sequence; identical to SEQ ID NO: 17266
  Description of Artificial Sequence: Synthetic coding sequence

SEQ ID NO: 17272 - DNA, 363 bp, Artificial Sequence; identical to SEQ ID NO: 17266
  Description of Artificial Sequence: Synthetic coding sequence

SEQ ID NO: 17273 - DNA, 363 bp, Artificial Sequence; identical to SEQ ID NO: 17266
  Description of Artificial Sequence: Synthetic coding sequence

SEQ ID NO: 17274 - DNA, 759 bp, Artificial Sequence
  Description of Artificial Sequence: Synthetic coding sequence
atgaagatgaagctgttccagaccatctgcagacagctgagaagcagcaagttcagcgtggagagcgccgccctggtggccttcagcaccagcagctacagctgcggcagaaagaagaaggtgaacccctacgaggaggtggaccaggagaagtacagcaacctggtgcagagcgtgctgagcagcagaggcgtggcccagacccccggcagcgtggaggaggacgccctgctgtgcggccccgtgagcaagcacaagctgcccaaccagggcgaggacagaagagtgccccagaactggttccccatcttcaaccccgagagaagcgacaagcccaacgccagcgaccccagcgtgcccctgaagatccccctgcagagaaacgtgatccccagcgtgaccagagtgctgcagcagaccatgaccaagcagcaggtgttcctgctggagagatggaagcagagaatgatcctggagctgggcgaggacggcttcaaggagtacaccagcagcagcatgtggctgaactgcggcggcctgcagagatggatcacctgcccccccaccttccacggctgcagagccctgttccccgtgctggaccaggtggccagcagcaccagaagaatctacggcaaggagaaggagcccgagtacagcgagaccagaatcttcagaatcggcagcaagctgctgttcggcaacatccagcacctgctgaccgtgtgggagcacatcctgctgttcacccccgtgtag

SEQ ID NO: 17275 - DNA, 795 bp, Artificial Sequence
  Description of Artificial Sequence: Synthetic coding sequence
atgaagatgaagctgttccagaccatctgcagacagctgagaagcagcaagttcagcgtggagagcgccgccctggtggccttcagcaccagcagctacagctgcggcagaaagaagaaggtgaacccctacgaggaggtggaccaggagaagtacagcaacctggtgcagagcgtgctgagcagcagaggcgtggcccagacccccggcagcgtggaggaggacgccctgctgtgcggccccgtgagcaagcacaagctgcccaaccaggacgtgttcctgcagggcaagagattccacgaggccctggagagcatcctgagcccccaggagaccctgaaggagagagacgagaacctgctgaagagcggctacatcgagagcgtgcagcacatcctgaaggacgtgagcggcgtgagagccctggagagcgccgtgcagcacgagaccctgaactacatcggcctgctggactgcgtggccgagtaccagggcaagctgtgcgtgatcgactggaagaccagcgagaagcccaagcccttcatccagagcaccttcgacaaccccctgcaggtggtggcctacatgggcgccatgaaccacgacaccaactacagcttccaggtgcagtgcggcctgatcgtggtggcctacaaggacggcagccccgcccacccccacttcatggacgccgagctgtgcagccagtactggaccaagtggctgctgagactggaggagtacaccgagaagaagaagaaccagaacatccagaagcccgagtacagcgagtag

SEQ ID NO: 17276 - DNA, 1035 bp, Artificial Sequence
  Description of Artificial Sequence: Synthetic coding sequence
atgaagatgaagctgttccagaccatctgcagacagctgagaagcagcaagttcagcgtggagagcgccgccctggtggccttcagcaccagcagctacagctgcggcagaaagaagaaggtgaacccctacgaggaggtggaccaggagaagtacagcaacctggtgcagagcgtgctgagcagcagaggcgtggcccagacccccggcagcgtggaggaggacgccctgctgtgcggccccgtgagcaagcacaagctgcccaaccagggcgaggacagaagagtgccccagaactggttccccatcttcaaccccgagagaagcgacaagcccaacgccagcgaccccagcgtgcccctgaagatccccctgcagagaaacgtgatccccagcgtgaccagagtgctgcagcagaccatgaccaagcagcaggtgttcctgctggagagatggaagcagagaatgatcctggagctgggcgaggacggcttcaaggagtacaccagcaacgtgttcctgcagggcaagagattccacgaggccctggagagcatcctgagcccccaggagaccctgaaggagagagacgagaacctgctgaagagcggctacatcgagagcgtgcagcacatcctgaaggacgtgagcggcgtgagagccctggagagcgccgtgcagcacgagaccctgaactacatcggcctgctggactgcgtggccgagtaccagggcaagctgtgcgtgatcgactggaagaccagcgagaagcccaagcccttcatccagagcaccttcgacaaccccctgcaggtggtggcctacatgggcgccatgaaccacgacaccaactacagcttccaggtgcagtgcggcctgatcgtggtggcctacaaggacggcagccccgcccacccccacttcatggacgccgagctgtgcagccagtactggaccaagtggctgctgagactggaggagtacaccgagaagaagaagaaccagaacatccagaagcccgagtacagcgagtag

SEQ ID NO: 17277 - DNA, 1326 bp, Artificial Sequence
  Description of Artificial Sequence: Synthetic coding sequence
atgctgctgcccggcagagccagacagccccccaccccccagcccgtgcagcaccccggcctgagaagacaggtggagccccccggccagctgctgagactgttctactgcaccgtgctggtgtgcagcaaggagatcagcgccctgaccgacttcagcggctacctgaccaagctgctgcagaaccacaccacctacgcctgcgacggcgactacctgaacctgcagtgccccagacacagcaccatcagcgtgcagagcgccttctacggccaggactaccagatgtgcagcagccagaagcccgccagccagagagaggacagcctgacctgcgtggccgccaccaccttccagaaggtgctggacgagtgccagaaccagagagcctgccacctgctggtgaacagcagagtgttcggccccgacctgtgccccggcagcagcaagtacctgctggtgagcttcaagtgccagcccaacgagctgaagaacaagaccgtgtgcgaggaccaggagctgaagctgcactgccacgagagcaagttcctgaacatctacagcgccacctacggcagaagaacccaggagagagacatctgcagcagcaaggccgagagactgccccccttcgactgcctgagctacagcgccctgcaggtgctgagcagaagatgctacggcaagcagagatgcaagatcatcgtgaacaaccaccacttcggcagcccctgcctgcccggcgtgaagaagtacctgaccgtgacctacgcctgcgtgcccaagaacatcctgaccgccatcgaccccgccatcgccaacctgaagcccagcctgaagcagaaggacggcgagtacggcatcaacttcgaccccagcggcagcaaggtgctgagaaaggacggcatcctggtgagcaacagcctggccgccttcgcctacatcagagcccaccccgagagagccgccctgctgttcgtgagcagcgtgtgcatcggcctggccctgaccctgtgcgccctggtgatcagagagagctgcgccaaggacttcagagacctgcagctgggcagagagcagctggtgcccggcagcgacaaggtggaggaggacagcgaggacgaggaggaggaggaggaccccagcgagagcgacttccccggcgagctgagcggcttctgcagaaccagctaccccatctacagcagcatcgaggccgccgagctggccgagagaatcgagagaagagagcagatcatccaggagatctggatgaacagcggcctggacaccagcctgcccagaaacatgggccagttctactag

SEQ ID NO: 17278 - DNA, 615 bp, Artificial Sequence
  Description of Artificial Sequence: Synthetic coding sequence
atgggctgggactgcagaagaaccaccgtggagaaccccagccccatcagaaactgcgtgaaccaggagtggcccgagggcagcagccccggcctgaccgagggcaacaccggcctggtgagagacctgagacccgcccaccaggacagaagcggcaccagagaggaccccgccggccaggagaccaccgccatcaccaaccccagccccagcctggccgccgacctggccggcgacgccctgcccggctgcctgggcgccgccgcccaccagggccccctgctggacagaagcagcgagagcaccctgggcccccaggccctggagctggagcactgccacgagagaggctgctgcagaggctgcgccagcttcagccccttccccgcccccagatgccccagcgagagactgggcgcccacagcagcagatgggccatcagaggcagaagcaagatcaacccccccccctgggcccccgcctgcctgcccggcggcttccccgcctgcctgcccgcccccaagagcagcaccgacagcgccagcagctgcttcaagggcggcagagagttcagcgaccccctggacatccccggcgccggcgccatgggctag

SEQ ID NO: 17279 - DNA, 249 bp, Artificial Sequence
  Description of Artificial Sequence: Synthetic coding sequence
atgggctgggactgcagaagaaccaccgtggagaaccccagccccatcagaaactgcgtgaaccaggagtggcccgagggcagcagccccggcctgaccgagggcaacaccggcctggtgagagacctgagacccgcccaccaggacagaagcggcaccagagaggaccccgccggccaggagaccaccgccatcaccaaccccagccccagctgcaccagcggcgccagcgccggccagaagctgtag

SEQ ID NO: 17280 - DNA, 483 bp, Artificial Sequence
  Description of Artificial Sequence: Synthetic coding sequence
atgaccacccaggaggacaccaccggcctgcaccagaagaccagcctgtggaccatgagcagacccggcgccaagaaggtgatgaacagctacttcatcgccggctgcggccccgccgtgtgctactacgccgtgagctggctgagacagggcttcagcatcaacctgaccagcttcggcagaatcccctggccccacgccggcgtgggcacctgccccagcccccagagctggatcagccccttcctgcagagccacagagagcaccactacgccaagaccagcagccacagccagcccagcccccagagcctggccctgtgcctggcctacagcagatgcagcatcaacatctgccagatgaccgagtgcatcagcctggccagcggctgccaccaggccctgagagagcccggcagaagcgaggagagcttctggatccccgccaccccctacatcagcaacatcttcagcgagagctag

SEQ ID NO: 17281 - DNA, 684 bp, Artificial Sequence
  Description of Artificial Sequence: Synthetic coding sequence
atggtgcccaccggctgggccggcctgggcggcgccgtggtgcacggccccggcaagctggagaaggccgtgcccagccccagagccctggacttcctgagcgtgaagtgggaggccgccatgatgaacggcaaggtgcccttcttcttcagcagcgagagcctgggctacttcgccaccggcagacccgccgacaacgtgatgaccacccaggaggacaccaccggcctgcaccagaagaccagcctgtggaccatgagcagacccggcgccaagaaggtgatgaacagctacttcatcgccggctgcggccccgccgtgtgctactacgccgtgagctggctgagacagggcttcagcatcaacctgaccagcttcggcagaatcccctggccccacgccggcgtgggcacctgccccagcccccagagctggatcagccccttcctgcagagccacagagagcaccactacgccaagaccagcagccacagccagcccagcccccagagcctggccctgtgcctggcctacagcagatgcagcatcaacatctgccagatgaccgagtgcatcagcctggccagcggctgccaccaggccctgagagagcccggcagaagcgaggagagcttctggatccccgccaccccctacatcagcaacatcttcagcgagagctag

SEQ ID NO: 17282 - DNA, 831 bp, Artificial Sequence
  Description of Artificial Sequence: Synthetic coding sequence
atgtgcatcatcttcttcaagttcgaccccagacccgtgagcaagaacgcctacagactgatcctggccgccaacagagacgagttctacagcagacccagcaagctggccgacttctggggcaacaacaacgagatcctgagcggcctggacatggaggagggcaaggagggcggcacctggctgggcatcagcaccagaggcaagctggccgccctgaccaactacctgcagccccagctggactggcaggccagaggcagaggcgagctggtgacccacttcctgaccaccgacgtggacagcctgagctacctgaagaaggtgagcatggagggccacctgtacaacggcttcaacctgatcgccgccgacctgagcaccgccaagggcgacgtgatctgctactacggcaacagaggcgagcccgaccccatcgtgctgacccccggcacctacggcctgagcaacgccctgctggagaccccctggagaaagctgtgcttcggcaagcagctgttcctggaggccgtggagagaagccaggccctgcccaaggacgtgctgatcgccagcctgctggacgtgctgaacaacgaggaggcccagctgcccgaccccgccatcgaggaccagggcggcgagtacgtgcagcccatgctgagcaagtacgccgccgtgtgcgtgagatgccccggctacggcaccagaaccaacaccatcatcctggtggacgccgacggccacgtgaccttcaccgagagaagcatgatggacaaggacctgagccactgggagaccagaacctacgagttcaccctgcagagctag

SEQ ID NO: 17283 - DNA, 645 bp, Artificial Sequence
  Description of Artificial Sequence: Synthetic coding sequence
atgtgcatcatcttcttcaagttcgaccccagacccgtgagcaagaacgcctacagactgatcctggccgccaacagagacgagttctacagcagacccagcaagctggccgacttctggggcaacaacaacgagatcctgagcggcctggacatggaggagggcaaggagggcggcacctggctgggcatcagcaccagaggcaagctggccgccctgaccaactacctgcagccccagctggactggcaggccagaggcagaggcacctacggcctgagcaacgccctgctggagaccccctggagaaagctgtgcttcggcaagcagctgttcctggaggccgtggagagaagccaggccctgcccaaggacgtgctgatcgccagcctgctggacgtgctgaacaacgaggaggcccagctgcccgaccccgccatcgaggaccagggcggcgagtacgtgcagcccatgctgagcaagtacgccgccgtgtgcgtgagatgccccggctacggcaccagaaccaacaccatcatcctggtggacgccgacggccacgtgaccttcaccgagagaagcatgatggacaaggacctgagccactgggagaccagaacctacgagttcaccctgcagagctag

SEQ ID NO: 17284 - DNA, 645 bp, Artificial Sequence; identical to SEQ ID NO: 17283
  Description of Artificial Sequence: Synthetic coding sequence

SEQ ID NO: 17285 - DNA, 537 bp, Artificial Sequence
  Description of Artificial Sequence: Synthetic coding sequence
atggccggccaccagcacacctggcaggccggcagcacccaccagctgcccgccgccgccgccggcctggccggccccagagccagcaccgccaagggcgacgtgatctgctactacggcaacagaggcgagcccgaccccatcgtgctgacccccggcacctacggcctgagcaacgccctgctggagaccccctggagaaagctgtgcttcggcaagcagctgttcctggaggccgtggagagaagccaggccctgcccaaggacgtgctgatcgccagcctgctggacgtgctgaacaacgaggaggcccagctgcccgaccccgccatcgaggaccagggcggcgagtacgtgcagcccatgctgagcaagtacgccgccgtgtgcgtgagatgccccggctacggcaccagaaccaacaccatcatcctggtggacgccgacggccacgtgaccttcaccgagagaagcatgatggacaaggacctgagccactgggagaccagaacctacgagttcaccctgcagagctag

SEQ ID NO: 17286 - DNA, 267 bp, Artificial Sequence
  Description of Artificial Sequence: Synthetic coding sequence
atgtgcatcatcttcttcaagttcgaccccagacccgtgagcaagaacgcctacagactgatcctggccgccaacagagacgagttctacagcagacccagcaagctggccgacttctggggcaacaacaacgagatcctgagcggcctggacatggaggagggcaaggagggcggcacctggctgggcatcagcaccagaggcaagctggccgccctgaccaactacctgcagccccagctggactggcaggccagaggcagatag

SEQ ID NO: 17287 - DNA, 645 bp, Artificial Sequence; identical to SEQ ID NO: 17283
  Description of Artificial Sequence: Synthetic coding sequence

SEQ ID NO: 17288 - DNA, 681 bp, Artificial Sequence
  Description of Artificial Sequence: Synthetic coding sequence
atgtgcatcatcttcttcaagttcgaccccagacccgtgagcaagaacgcctacagactgatcctggccgccaacagagacgagttctacagcagacccagcaagctggccgacttctggggcaacaacaacgagatcctgagcggcctggacatggaggagggcaaggagggcggcacctggctgggcatcagcaccagaggcaagctggccgccctgaccaactacctgcagccccagctggactggcaggccagaggcagaggcgagctggtgacccacttcctgaccaccgacgtggacagcctgagctacctgaagaaggtgagcatggagggccacctgtacaacggcttcaacctgatcgccgccgacctgagcaccgccaagggcgacgtgatctgctactacggcaacagaggcgagcccgaccccatcgtgctgacccccggcacctacggcctgagcaacgccctgctggagaccccctggagaaagctgtgcttcggcaagcagctgttcctggaggccgtggagagaagccaggccctgcccaaggacgtgctgatcgccagcctgctggacgtgctgaacaacgaggaggcccagctgcccgaccccgccatcgaggaccagggcggcgagtacgtgcagcccatgctgagcaagtacgccgcctag

SEQ ID NO: 17289 - DNA, 597 bp, Artificial Sequence
  Description of Artificial Sequence: Synthetic coding sequence
atgccccccaagctgctgtgcgccggcagatgcgtgggccaggacggcgccgcccaggcctggcactgcccccccggccagggccacagcgtgtgggacgccgtgagaatgcccctgggcgccggcacccccgtgaacgtgcagagaagagaggacagcgccaccgagggcagccacagactgatcctggccgccaacagagacgagttctacagcagacccagcaagctggccgacttctggggcaacaacaacgagatcctgagcggcctggacatggaggagggcaaggagggcggcacctggctgggcatcagcaccagaggcaagctggccgccctgaccaactacctgcagccccagctggactggcaggccagaggcagaggcgagctggtgacccacttcctgaccaccgacgtggacagcctgagctacctgaagaaggtgagcatggagggccacctgtacaacggcttcaacctgatcgccgccgacctgagcaccgccaagggcgacgtgatctgctactacggcaacagaggcgagcccgaccccatcgtgctgacccccgagcccaccctgagcagctggtag

SEQ ID NO: 17290 - DNA, 831 bp, Artificial Sequence; identical to SEQ ID NO: 17282
  Description of Artificial Sequence: Synthetic coding sequence

SEQ ID NO: 17291 - DNA, 498 bp, Artificial Sequence
  Description of Artificial Sequence: Synthetic coding sequence
atgtgcatcatcttcttcaagttcgaccccagacccgtgagcaagaacgcctacagactgatcctggccgccaacagagacgagttctacagcagacccagcaagctggccgacttctggggcaacaacaacgagatcctgagcggcctggacatggaggagggcaaggagggcggcacctggctgggcatcagcaccagaggcaagctggccgccctgaccaactacctgcagccccagctggactggcaggccagaggcagaggcgagctggtgacccacttcctgaccaccgacgtggacagcctgagctacctgaagaaggtgagcatggagggccacctgtacaacggcttcaacctgatcgccgccgacctgagcaccgccaagggcgacgtgatctgctactacggcaacagaggcgagcccgaccccatcgtgctgacccccggcacctacggcctgagcaacgccctgctggagaccccctggagatag

SEQ ID NO: 17292 - DNA, 846 bp, Artificial Sequence
  Description of Artificial Sequence: Synthetic coding sequence
atgcccctgggcgccggcacccccgtgaacgtgcagagaagagaggacagcgccaccgagggcagccacagactgatcctggccgccaacagagacgagttctacagcagacccagcaagctggccgacttctggggcaacaacaacgagatcctgagcggcctggacatggaggagggcaaggagggcggcacctggctgggcatcagcaccagaggcaagctggccgccctgaccaactacctgcagccccagctggactggcaggccagaggcagaggcgagctggtgacccacttcctgaccaccgacgtggacagcctgagctacctgaagaaggtgagcatggagggccacctgtacaacggcttcaacctgatcgccgccgacctgagcaccgccaagggcgacgtgatctgctactacggcaacagaggcgagcccgaccccatcgtgctgacccccggcacctacggcctgagcaacgccctgctggagaccccctggagaaagctgtgcttcggcaagcagctgttcctggaggccgtggagagaagccaggccctgcccaaggacgtgctgatcgccagcctgctggacgtgctgaacaacgaggaggcccagctgcccgaccccgccatcgaggaccagggcggcgagtacgtgcagcccatgctgagcaagtacgccgccgtgtgcgtgagatgccccggctacggcaccagaaccaacaccatcatcctggtggacgccgacggccacgtgaccttcaccgagagaagcatgatggacaaggacctgagccactgggagaccagaacctacgagttcaccctgcagagctag

SEQ ID NO: 17293 - DNA, 324 bp, Artificial Sequence
  Description of Artificial Sequence: Synthetic coding sequence
atggccagcggcgccgccagatggctggtgctggcccccgtgagaagcggcgccctgagaagcggccccagcctgagaaaggacggcgacgtgagcgccgcctggagcggcagcggcagaagcctggtgcccagcagaagcgtgatcgtgaccagaagcggcgccatcctgcccaagcccgtgaagatgagcttcggcctgctgagagtgttcagcatcgtgatccccttcctgtacgtgggcaccctgatcagcaagaacttcgccgccctgctggaggagcacgacatcttcgtgcccgaggacgacgacgacgacgactag

SEQ ID NO: 17294 - DNA, 1704 bp, Artificial Sequence
  Description of Artificial Sequence: Synthetic coding sequence
atgatggccgccgtgccccccggcctggagccctggaacagagtgagaatccccaaggccggcaacagaagcgccgtgaccgtgcagaaccccggcgccgccctggacctgtgcatcgccgccgtgatcaaggagtgccacctggtgatcctgagcctgaagagccagaccctggacgccgagaccgacgtgctgtgcgccgtgctgtacagcaaccacaacagaatgggcagacacaagccccacctggccctgaagcaggtggagcagtgcctgaagagactgaagaacatgaacctggagggcagcatccaggacctgttcgagctgttcagcagcaacgagaaccagcccctgaccaccaaggtgtgcgtggtgcccagccagcccgtggtggagctggtgctgatgaaggtgctgggcgcctgcaagctgctgctgagactgctggactgctgctgcaagaccttcctgctgaccgtgaagcacctgggcctgcaggagttcatcatcctgaacctggtgatggtgggcctggtgagcagactgtgggtgctgtacaagggcgtgctgaagagactgatcctgctgtacgagcccctgttcggcctgctgcaggaggtggccagaatccagcccatgccctacttcaaggacttcaccttccccagcgacatcaccgagttcctgggccagccctacttcgaggccttcaagaagaagatgcccatcgccttcgccgccaagggcatcaacaagctgctgaacaagctgttcctgatcaacgagcagagccccagagccagcgaggagaccctgctgggcatcagcaagaaggccaagcagatgaagatcaacgtgcagaacaacgtggacctgggccagcccgtgaagaacaagagagtgttcaaggaggagagcagcgagttcgacgtgagagccttctgcaaccagctgaagcacaaggccacccaggagaccagcttcgacttcaagtgcagccagagcagactgaagaccaccaagtacagcagccagaaggtgatcggcaccccccacgccaagagcttcgtgcagagattcagagaggccgagagcttcacccagctgagcgaggagatccagatggccgtggtgtggtgcagaagcaagaagctgaaggcccaggccatcttcctgggcaacaagctgctgaagagcaacagactgaagcacctggaggcccagggcaccagcctgcccaagaagctggagtgcatcaagaccagcatctgcaaccacctgctgagaggcagcggcatcaagaccagcaagcaccacctgagacagagaagaagccagaacaagttcctgagaagacagagaaagccccagagaaagctgcagagcaccctgctgagagagatccagcagttcagccagggcaccagaaagagcgccaccgacaccagcgccaagtggagactgagccactgcaccgtgcacagaaccgacctgtaccccaacagcaagcagctgctgaacagcggcgtgagcatgcccgtgatccagaccaaggagaagatgatccacgagaacctgagaggcatccacgagaacgagaccgacagctggaccgtgatgcagatcaacaagaacagcaccagcggcaccatcaaggagaccgacgacatcgacgacatcttcgccctgatgggcgtgtag

SEQ ID NO: 17295 - DNA, 1494 bp, Artificial Sequence
  Description of Artificial Sequence: Synthetic coding sequence
atgatggccgccgtgccccccggcctggagccctggaacagagtgagaatccccaaggccggcaacagaagcgccgtgaccgtgcagaaccccggcgccgccctggacctgtgcatcgccgccgtgatcaaggagtgccacctggtgatcctgagcctgaagagccagaccctggacgccgagaccgacgtgctgtgcgccgtgctgtacagcaaccacaacagaatgggcagacacaagccccacctggccctgaagcaggtggagcagtgcctgaagagactgaagaacatgaacctggagggcagcatccaggacctgttcgagctgttcagcagcaaggtgctgtacaagggcgtgctgaagagactgatcctgctgtacgagcccctgttcggcctgctgcaggaggtggccagaatccagcccatgccctacttcaaggacttcaccttccccagcgacatcaccgagttcctgggccagccctacttcgaggccttcaagaagaagatgcccatcgccttcgccgccaagggcatcaacaagctgctgaacaagctgttcctgatcaacgagcagagccccagagccagcgaggagaccctgctgggcatcagcaagaaggccaagcagatgaagatcaacgtgcagaacaacgtggacctgggccagcccgtgaagaacaagagagtgttcaaggaggagagcagcgagttcgacgtgagagccttctgcaaccagctgaagcacaaggccacccaggagaccagcttcgacttcaagtgcagccagagcagactgaagaccaccaagtacagcagccagaaggtgatcggcaccccccacgccaagagcttcgtgcagagattcagagaggccgagagcttcacccagctgagcgaggagatccagatggccgtggtgtggtgcagaagcaagaagctgaaggcccaggccatcttcctgggcaacaagctgctgaagagcaacagactgaagcacctggaggcccagggcaccagcctgcccaagaagctggagtgcatcaagaccagcatctgcaaccacctgctgagaggcagcggcatcaagaccagcaagcaccacctgagacagagaagaagccagaacaagttcctgagaagacagagaaagccccagagaaagctgcagagcaccctgctgagagagatccagcagttcagccagggcaccagaaagagcgccaccgacaccagcgccaagtggagactgagccactgcaccgtgcacagaaccgacctgtaccccaacagcaagcagctgctgaacagcggcgtgagcatgcccgtgatccagaccaaggagaagatgatccacgagaacctgagaggcatccacgagaacgagaccgacagctggaccgtgatgcagatcaacaagaacagcaccagcggcaccatcaaggagaccgacgacatcgacgacatcttcgccctgatgggcgtgtag

SEQ ID NO: 17296 - DNA, 1296 bp, Artificial Sequence
  Description of Artificial Sequence: Synthetic coding sequence
atgaaggtgctgggcgcctgcaagctgctgctgagactgctggactgctgctgcaagaccttcctgctgaccgtgaagcacctgggcctgcaggagttcatcatcctgaacctggtgatggtgggcctggtgagcagactgtgggtgctgtacaagggcgtgctgaagagactgatcctgctgtacgagcccctgttcggcctgctgcaggaggtggccagaatccagcccatgccctacttcaaggacttcaccttccccagcgacatcaccgagttcctgggccagccctacttcgaggccttcaagaagaagatgcccatcgccttcgccgccaagggcatcaacaagctgctgaacaagctgttcctgatcaacgagcagagccccagagccagcgaggagaccctgctgggcatcagcaagaaggccaagcagatgaagatcaacgtgcagaacaacgtggacctgggccagcccgtgaagaacaagagagtgttcaaggaggagagcagcgagttcgacgtgagagccttctgcaaccagctgaagcacaaggccacccaggagaccagcttcgacttcaagtgcagccagagcagactgaagaccaccaagtacagcagccagaaggtgatcggcaccccccacgccaagagcttcgtgcagagattcagagaggccgagagcttcacccagctgagcgaggagatccagatggccgtggtgtggtgcagaagcaagaagctgaaggcccaggccatcttcctgggcaacaagctgctgaagagcaacagactgaagcacctggaggcccagggcaccagcctgcccaagaagctggagtgcatcaagaccagcatctgcaaccacctgctgagaggcagcggcatcaagaccagcaagcaccacctgagacagagaagaagccagaacaagttcctgagaagacagagaaagccccagagaaagctgcagagcaccctgctgagagagatccagcagttcagccagggcaccagaaagagcgccaccgacaccagcgccaagtggagactgagccactgcaccgtgcacagaaccgacctgtaccccaacagcaagcagctgctgaacagcggcgtgagcatgcccgtgatccagaccaaggagaagatgatccacgagaacctgagaggcatccacgagaacgagaccgacagctggaccgtgatgcagatcaacaagaacagcaccagcggcaccatcaaggagaccgacgacatcgacgacatcttcgccctgatgggcgtgtag

SEQ ID NO: 17297 - DNA, 645 bp, Artificial Sequence
  Description of Artificial Sequence: Synthetic coding sequence
atgcccaaggtgctgtgcaaggacagcgagagactgagccccagccacaacttcctgaagaagagcagatggcagctgtacggcgccggcaagaagctgaaggcccaggccatcttcctgggcaacaagctgctgaagagcaacagactgaagcacctggaggcccagggcaccagcctgcccaagaagctggagtgcatcaagaccagcatctgcaaccacctgctgagaggcagcggcatcaagaccagcaagcaccacctgagacagagaagaagccagaacaagttcctgagaagacagagaaagccccagagaaagctgcagagcaccctgctgagagagatccagcagttcagccagggcaccagaaagagcgccaccgacaccagcgccaagtggagactgagccactgcaccgtgcacagaaccgacctgtaccccaacagcaagcagctgctgaacagcggcgtgagcatgcccgtgatccagaccaaggagaagatgatccacgagaacctgagaggcatccacgagaacgagaccgacagctggaccgtgatgcagatcaacaagaacagcaccagcggcaccatcaaggagaccgacgacatcgacgacatcttcgccctgatgggcgtgtag

SEQ ID NO: 17298 - DNA, 489 bp, Artificial Sequence
  Description of Artificial Sequence: Synthetic coding sequence
atgaacagcagaaccgccagcgccagaggctggttcagcagcagaccccccaccagcgagagcgacctggagcccgccaccgacggccccgccagcgagaccaccaccctgagccccgaggccaccaccttcaacgacaccagaatccccgacgccgccggcggcaccgccggcgtgggcaccatgctgctgagcttcggcatcatcaccgtgatcggcctggccgtggccctggtgctgtacatcagaaagaagaagagactggagaagctgagacaccagctgatgcccatgtacaacttcgaccccaccgaggagcaggacgagctggagcaggagctgctggagcacggcagagacgccgccagcgtgcaggccgccaccagcgtgcaggccatgcagggcaagaccaccctgcccagccagggccccctgcagagacccagcagactggtgttcaccgacgtggccaacgccatccacgcctag

SEQ ID NO: 17299 - DNA, 489 bp, Artificial Sequence; identical to SEQ ID NO: 17298
  Description of Artificial Sequence: Synthetic coding sequence

SEQ ID NO: 17300 - DNA, 429 bp, Artificial Sequence
  Description of Artificial Sequence: Synthetic coding sequence
atgaacagcagaaccgccagcgccagaggctggttcagcagcagaccccccaccagcgagagcgacctggagcccgccaccgacggccccgccagcgagaccaccaccctgagccccgaggccaccaccttcaacgacaccagaatccccgacgccgccggcggcaccgccggcgtgctgtacatcagaaagaagaagagactggagaagctgagacaccagctgatgcccatgtacaacttcgaccccaccgaggagcaggacgagctggagcaggagctgctggagcacggcagagacgccgccagcgtgcaggccgccaccagcgtgcaggccatgcagggcaagaccaccctgcccagccagggccccctgcagagacccagcagactggtgttcaccgacgtggccaacgccatccacgcctag

SEQ ID NO: 17301 - DNA, 489 bp, Artificial Sequence; identical to SEQ ID NO: 17298
  Description of Artificial Sequence: Synthetic coding sequence

SEQ ID NO: 17302 - DNA, 2715 bp, Artificial Sequence
  Description of Artificial Sequence: Synthetic coding sequence
atgagctacatcaagagcaacctggagctgtaccagcagtacaccgccatggcccccaagctgctggccagaatcagcaagctgctgatgatctgccagaacgccggcatcagcgtgcccaagggcatcagaaacatcttcgagttcacctgggaggagctgatcagcgaccccagcgtgcccacccccagcgacatcctgggcctggaggtgagcttcggcgcccccctggtggtgctgatggagcccaccttcgtgcaggtgcccaccctgaagaagcccctgcccccccccccccccgccccccccagacccgtgctgctggccaccaccggcgccgccaagagaagcaccctgagccccaccatggccagacaggtgagaacccaccaggagaccctgaacagattccagcagcagagcatccacctgctgaccgagctgctgagactgaagatgaaggccatggtggagagcatgagcgtgggcgccaaccccctggacatcaccagaagattcgtggaggccagccagctgctgcacctgaacgccaaggagatggccttcaactgcctgatcagcaccgccggcagaagcggctacagcagcggccagctgtggaaggagagcctggccaacatgagcgccatcggcgtgaacagcccctaccagctgatctaccacagcagcaccgcctgcctgagcttcagcctgagcgccggcaaggaggccaagaagaagatcggcaagagcagaaccaccgaggacgtgagcatgccccccctgcacagaggcgtgggcacccccgccaacagcctggagttcagcgacccctgccccgaggccagagagaagctgcaggagctgtgcagacacatcgaggccgagagagccacctggaagggcagaaacatcagctaccccatgatcctgagaaactacaaggccaagatgcccagccacctgatgctggccagaaagggcgacagccagacccccggcctgcactacccccccaccgccggcgcccagaccctgagccccaccagccaccccagcagcgccaaccaccacttcagccagcactgccaggagggcaaggcccccaagaaggccttcaagttccactacaccttctacgacggcagcagcttcgtgtactaccccagcggcaacgtggccgtgtgccagatccccacctgctgcagaggcagaaccatcacctgcctgttcaacgacatccccggcttcagcctgctggccctgttcaacaccgagggccagggctgcgtgcactacaacctgaagaccagctgcccctacgtgctgatcctggacgaggagggcggcaccaccaacgaccagcagggctacgtggtgcacaagtggagctggaccagcagaaccgagaccctgctgagcctggagtacaaggtgaacgaggagatgaagctgaaggtgctgggccaggacagcatcaccgtgaccttcaccagcctgaacgagaccgtgaccctgaccgtgagcgccaacaactgcccccacggcatggcctacgacaagagactgaacagaagaatcagcaacatggacgacaaggtgtacaagatgagcagagccctggccgagatcaagaagagattccagaagaccgtgacccagttcatcaacagcatcctgctggccgccggcctgttcaccatcgagtaccccaccaagaaggaggaggaggagttcgtgagattcaagatgagaagcagaacccaccccgagagactgcccaagctgagcctgtacagcggcgagagcctgctgagaagccagagcggccacctggagagcagcatcgccgagaccctgaaggacgagcccgagagcgcccccgtgagccccgtgagaaagaccaccaagatccacaccaaggccaaggtgaccagcagaggcaaggccagagagggcagaagccccaccagatgggccgccctgcccagcgactgccccctggtgctgagaaagctgatgctgaaggaggacaccagagccggctgcaagtgcctggtgaaggcccccctggtgagcgacgtggagctggagagattcctgctggcccccagagaccccagccaggtgctggtgttcggcatcatcagcagccagaactacaccagcaccggccagctgcagtggctgctgaacaccctgtacaaccaccagcagagaggcagaggcagcccctgcatccagtgcagatacgacagctacagactgctgcagtacgacctggacagccccctgcaggaggacccccccctgatggtgaagaagaacagcgtggtgcagggcatgatcctgatgttcgccggcggcaagctgatcttcggcggcagagtgctgaacggctacggcctgagcaagcagaacctgctgaagcagatcttcagaagccagcaggactacaagatgggctacttcctgcccgacgactacaagttcagcgtgcccaacagcgtgctgagcctggaggacagcgagagcgtgaagaaggccgagagcgaggacatccagggcagcagcagcagcctggccctggaggactacgtggagaaggagctgagcctggaggccgagaagaccagagagcccgaggtggagctgcaccccctgagcagagacagcaagatcaccagctggaagaagcaggccagcaagaagtag

SEQ ID NO: 17303 - DNA, 2349 bp, Artificial Sequence
  Description of Artificial Sequence: Synthetic coding sequence
atggccagacaggtgagaacccaccaggagaccctgaacagattccagcagcagagcatccacctgctgaccgagctgctgagactgaagatgaaggccatggtggagagcatgagcgtgggcgccaaccccctggacatcaccagaagattcgtggaggccagccagctgctgcacctgaacgccaaggagatggccttcaactgcctgatcagcaccgccggcagaagcggctacagcagcggccagctgtggaaggagagcctggccaacatgagcgccatcggcgtgaacagcccctaccagctgatctaccacagcagcaccgcctgcctgagcttcagcctgagcgccggcaaggaggccaagaagaagatcggcaagagcagaaccaccgaggacgtgagcatgccccccctgcacagaggcgtgggcacccccgccaacagcctggagttcagcgacccctgccccgaggccagagagaagctgcaggagctgtgcagacacatcgaggccgagagagccacctggaagggcagaaacatcagctaccccatgatcctgagaaactacaaggccaagatgcccagccacctgatgctggccagaaagggcgacagccagacccccggcctgcactacccccccaccgccggcgcccagaccctgagccccaccagccaccccagcagcgccaaccaccacttcagccagcactgccaggagggcaaggcccccaagaaggccttcaagttccactacaccttctacgacggcagcagcttcgtgtactaccccagcggcaacgtggccgtgtgccagatccccacctgctgcagaggcagaaccatcacctgcctgttcaacgacatccccggcttcagcctgctggccctgttcaacaccgagggccagggctgcgtgcactacaacctgaagaccagctgcccctacgtgctgatcctggacgaggagggcggcaccaccaacgaccagcagggctacgtggtgcacaagtggagctggaccagcagaaccgagaccctgctgagcctggagtacaaggtgaacgaggagatgaagctgaaggtgctgggccaggacagcatcaccgtgaccttcaccagcctgaacgagaccgtgaccctgaccgtgagcgccaacaactgcccccacggcatggcctacgacaagagactgaacagaagaatcagcaacatggacgacaaggtgtacaagatgagcagagccctggccgagatcaagaagagattccagaagaccgtgacccagttcatcaacagcatcctgctggccgccggcctgttcaccatcgagtaccccaccaagaaggaggaggaggagttcgtgagattcaagatgagaagcagaacccaccccgagagactgcccaagctgagcctgtacagcggcgagagcctgctgagaagccagagcggccacctggagagcagcatcgccgagaccctgaaggacgagcccgagagcgcccccgtgagccccgtgagaaagaccaccaagatccacaccaaggccaaggtgaccagcagaggcaaggccagagagggcagaagccccaccagatgggccgccctgcccagcgactgccccctggtgctgagaaagctgatgctgaaggaggacaccagagccggctgcaagtgcctggtgaaggcccccctggtgagcgacgtggagctggagagattcctgctggcccccagagaccccagccaggtgctggtgttcggcatcatcagcagccagaactacaccagcaccggccagctgcagtggctgctgaacaccctgtacaaccaccagcagagaggcagaggcagcccctgcatccagtgcagatacgacagctacagactgctgcagtacgacctggacagccccctgcaggaggacccccccctgatggtgaagaagaacagcgtggtgcagggcatgatcctgatgttcgccggcggcaagctgatcttcggcggcagagtgctgaacggctacggcctgagcaagcagaacctgctgaagcagatcttcagaagccagcaggactacaagatgggctacttcctgcccgacgactacaagttcagcgtgcccaacagcgtgctgagcctggaggacagcgagagcgtgaagaaggccgagagcgaggacatccagggcagcagcagcagcctggccctggaggactacgtggagaaggagctgagcctggaggccgagaagaccagagagcccgaggtggagctgcaccccctgagcagagacagcaagatcaccagctggaagaagcaggccagcaagaagtag

SEQ ID NO: 17304 - DNA, 2349 bp, Artificial Sequence; identical to SEQ ID NO: 17303
  Description of Artificial Sequence: Synthetic coding sequence

SEQ ID NO: 17305 - DNA, 1491 bp, Artificial Sequence
  Description of Artificial Sequence: Synthetic coding sequence
atgttctgccacctgagacccatgagaagactgtgcctggagaagatcttcccccactggttccccttcagcagagccctgagcggcgccgaggccgtgaacgccctgagacccttctacttcgccgtgcaccccgacttcttcggccagcaccccgtggagagagagatcaacgagaacagcctgaagagactgagcgtgtacctggagaacctgcagaagcccggcttcaagagcctgaagcccacccagctgaccttctacgtgagagagaccgaccagagcagcagcgacggccaggagcccttcagcaccagcggcttcagagccgtgaagttcaccctgcacaccagagacctgctgagcaccgtgctgtacatcctgaacagctgcagcctgagcgtggagcacatccagagcctgaacaccaacatgcacacccagcccctgaaggaggccaagagaatgcccgacagacccatcaagtgggacaagagctactacagcttcaccggcttcaaggaccccgacgaggacctggagcaggtgagcagagtggagaccaccctgaccagctggctggacaacaacggcaagagcgccgtgaagaagctgaagaacagcctgcccctgagaaaggagctggacagactgaaggacgagctgagccaccagctgcagctgagcgacatcagatggcagagaagctggggcatcgcccacagatgcagccagctgcacagcctgagcagactggcccagcagaacctggagaccctgaagaaggccaagggctgcaccatcatcttcaccgacagaagcggcatgagcgccgtgggccacgtgatgctgggcaccatggacgtgcaccaccactggaccaagctgttcgagagactgcccagctacttcgacctgcagagaagactgatgatcctggaggaccagatcagctacctgctgggcggcatccaggtggtgtacatcgaggagctgcagcccgtgctgaccctggaggagtactacagcctgctggacgtgttctacaacagactgctgaagagcagaatcctgttccaccccagaagcctgagaggcctgcagatgatcctgaacagcgacagatacgcccccagcctgcacgagctgggccacttcaacatccccaccctgtgcgaccccgccaacctgcagtggttcatcctgaccaaggcccagcaggccagagagaacatgaagagaaaggaggagctgaaggtgatcgagaacgagctgatccaggccagcaccaagaagttcagcctggagaagctgtacaaggagcccagcatcagcagcatccagatggtggactgctgcaagagactgctggagcagagcctgccctacctgcacggcatgcacctgtgcatcagccacttctacagcgtgatgcaggacggcgacctgtgcatcccctggaactggaagaacggcgaggccatcaagtag

SEQ ID NO: 17306 - DNA, 213 bp, Artificial Sequence
  Description of Artificial Sequence: Synthetic coding sequence
atgttctgccacctgagacccatgagaagactgtgcctggagaagatcttcccccactggttccccttcagcagagccctgagcggcgccgaggccgtgaacgccctgagacccttctacttcgccgtgcaccccgacttcttcggccagcaccccgtggagagagacgacacctggaagagcttccagtgccccagcgacttcagcctgtag

SEQ ID NO: 17307 - DNA, 213 bp, Artificial Sequence; identical to SEQ ID NO: 17306
  Description of Artificial Sequence: Synthetic coding sequence

SEQ ID NO: 17308 - DNA, 1491 bp, Artificial Sequence; identical to SEQ ID NO: 17305
  Description of Artificial Sequence: Synthetic coding sequence

SEQ ID NO: 17309 - DNA, 885 bp, Artificial Sequence
  Description of Artificial Sequence: Synthetic coding sequence
atggccggccagcccgccgccaccggcagccccagcgccgacaaggacggcatggagcccaacgtggtggccagaatcagccagtgggccgacgaccacctgagactggtgagaaacatcagcaccggcatggccatcgccggcatcatgctgctgctgagaagcatcagactgaccagcaagttcaccagcagcagcgacatccccgtggagttcatcagaagaaacgtgaagctgagaggcagactgagaagaatcaccgagaacggcctggagatcgagcacatccccatcaccctgcccatcatcgccagcctgagaaaggagcccagaggcgccctgctggtgaagctggccggcgtggagctggccgagaccggcaaggcctggctgcagaaggagctgaagcccagccagctgctgtggttccagctgctgggcaaggagaacagcgccctgttctgctacctgctggtgagcaagggcggctacttcagcgtgaacctgaacgaggagatcctgagaagaggcctgggcaagaccgtgctggtgaagggcctgaagtacgacagcaagatctactggaccgtgcacagaaacctgctgaaggccgagctgaccgccctgaagaagggcgagggcatctggaaggaggacagcgagaaggagagctacctggagaagttcaaggacagctggagagagatctggaagaaggacagcttcctgaagaccaccggcagcgacttcagcctgaagaaggagagctactacgagaagctgaagagaacctacgagatctggaaggacaacatgaacaactgcagcctgatcctgaagttcagagagctgatcagcagaatcaacttcagaagaaagggctag

SEQ ID NO: 17310 - DNA, 756 bp, Artificial Sequence
  Description of Artificial Sequence: Synthetic coding sequence
atggccatcgccggcatcatgctgctgctgagaagcatcagactgaccagcaagttcaccagcagcagcgacatccccgtggagttcatcagaagaaacgtgaagctgagaggcagactgagaagaatcaccgagaacggcctggagatcgagcacatccccatcaccctgcccatcatcgccagcctgagaaaggagcccagaggcgccctgctggtgaagctggccggcgtggagctggccgagaccggcaaggcctggctgcagaaggagctgaagcccagccagctgctgtggttccagctgctgggcaaggagaacagcgccctgttctgctacctgctggtgagcaagggcggctacttcagcgtgaacctgaacgaggagatcctgagaagaggcctgggcaagaccgtgctggtgaagggcctgaagtacgacagcaagatctactggaccgtgcacagaaacctgctgaaggccgagctgaccgccctgaagaagggcgagggcatctggaaggaggacagcgagaaggagagctacctggagaagttcaaggacagctggagagagatctggaagaaggacagcttcctgaagaccaccggcagcgacttcagcctgaagaaggagagctactacgagaagctgaagagaacctacgagatctggaaggacaacatgaacaactgcagcctgatcctgaagttcagagagctgatcagcagaatcaacttcagaagaaagggctag

SEQ ID NO: 17311 - DNA, 885 bp, Artificial Sequence; identical to SEQ ID NO: 17309
  Description of Artificial Sequence: Synthetic coding sequence

SEQ ID NO: 17312 - DNA, 513 bp, Artificial Sequence
  Description of Artificial Sequence: Synthetic coding sequence
atgaagaccatggccaccagaaagagatgcaagctgagcagaaccggccccgagttcgagaacgtgatcaagagactgctgtgcgccagaaccttccacaccagaatcggcggcgacctgacccacggcatcatcaacagaggcagaagagccaacgccgagcagatgggcctgcagggcagcgcccagcacttcaacatcttccccctggacctgtggacccagggcaagaagaccgaggtgcagaagagagagggcaccgacagcatccccgccgccggcagaagcggcaccgccaaccagcccagcatcgccccccacagatgcctgttcagcagaggcatcaccgccctggacggcctgaagagaggcagaggctgcaacggcgccgcccacctggtgagaggcgacgcctggaagaccaagctgggcgagccctgggtgagcatcgccctggccctggccggccccggcgccatcctgatcctggagctgagctggttcctgggctag

SEQ ID NO: 17313 - DNA, 360 bp, Artificial Sequence
  Description of Artificial Sequence: Synthetic coding sequence
atgaagaccatggccaccagaaagagatgcaagctgagcagaaccggccccgagttcgagaacgtgatcaagagactgctgtgcgccagaaccttccacaccagaatcggcggcgacctgacccacggcatcatcaacagaggcagaagagccaacgccgagcagatgggcctgcagggcagcgcccagcacttcaacatcttccccctggacctgtggacccagggcgactgcatgctggtgagcctggccaagaacaaggtgaacgtgttcggcgccatcatcaacatggccgccagcgtgagcggcgtgatcggcggcctgaagttcagcagaacctactacgtgaagggcatctag

SEQ ID NO: 17314 - DNA, 360 bp, Artificial Sequence; identical to SEQ ID NO: 17313
  Description of Artificial Sequence: Synthetic coding sequence

SEQ ID NO: 17315 - DNA, 360 bp, Artificial Sequence; identical to SEQ ID NO: 17313
  Description of Artificial Sequence: Synthetic coding sequence

SEQ ID NO: 17316 - DNA, 237 bp, Artificial Sequence
  Description of Artificial Sequence: Synthetic coding sequence
atgaagaccatggccaccagaaagagatgcaagctgagcagaaccggccccgagttcgagaacgtgatcaagagactgctgtgcgccagaaccttccacaccagaatcggcggcgacctgacccacggcatcatcaacagaggcagaagagccaacgccgagcagatgggcctgcagggcagcgcccagcacttcaacatcttccccctggacctgtggacccagggcaagaagtag

SEQ ID NO: 17317 - DNA, 645 bp, Artificial Sequence
  Description of Artificial Sequence: Synthetic coding sequence
atgaacaacgagaccaccaccctgatcagcctgaaggaggccatgaagagagtggaccacaagctgcaggccctggagacccagttcaaggagctggacttcaccaaggacaacctgatgcagaagttcgagcaccacagcaaggccctggccagccaggccgcccaggacgagatgtggaccgccgtgagagccctgcagctgaccagcatggagctgaacatcctgtacagctacgtgatcgaggtgctgatctgcctgcacaccagagtgctggagaagctgcccgacctggtgagaggcctgcccaccctggccagcgtgctgagaagaaaggtgaagaacaagagagtgagagtggtgtgggagagcatcctggaggagtgcggcctgcaggagggcgacatcaccgccctgtgcaccttcttcatcgccagaggcaacaaggccgagcactacaccgccaaggtgagacagatgtacatcagagacgtgaccttcctgatcaccaacatggtgaagaaccaggccctgcaggacagcctgctgagagccgtgcaggtgatcgagaagggcaaggccgtgagaacccccgagaagcagaagagcagcctggaggagctgatccccagcgtgaagaactag

SEQ ID NO: 17318 - DNA, 495 bp, Artificial Sequence
  Description of Artificial Sequence: Synthetic coding sequence
atgcccagcctggcccccgactgccccctgctggccatgcccgaggagacccaggaggacagcgtggcccccatgatgcccagccagagaagcagaggccccctggcccccaaccacgtgcacgaggtgtgcctgcaccaggtggagagcatcagcgacctgcacagcggcgccggcaccctgagaccctacctgaccgaggaggccagaccctgggacgagctgctgggcgtgctgccccccagcctgtgcgcccaggccggctgcagccccgtgtacagaagaggcggcttcctgctgctgctggccctgctggtgctgacctgcctggtgctggccctgctggccgtgtacctgagcgtgctgcagagcgagagcctgagaatcctggcccacaccctgagaacccaggaggagaccctgctgaagctgagactggccagcctgagccagctgagaagactgaacagcagcgaggcccaggcccccagctag

SEQ ID NO: 17319 - DNA, 219 bp, Artificial Sequence
  Description of Artificial Sequence: Synthetic coding sequence
atgaaggtggtgggcaactacagagtgaacaccgccaacagcagcaccgacaccagcggcgagcacctgacctgcctgagaagccagctgttcgtggcctacagaaacggcagagtggacgaggccgtgagcctgggcttcctggactgctggatcggcggcgacctgaccaacttcaagggctgctacctgaccaaccagctgcccatccagttctag

SEQ ID NO: 17320 - DNA, 873 bp, Artificial Sequence
  Description of Artificial Sequence: Synthetic coding sequence
atgctgggccagagagccggcgacggcgagagacccggcctgcccggcgacggcgagggcggcgtgcccgccagacccggcagaagagccgagagacccccccagagacccgccaaggtgaacaaggccgtgacctgcgccgcccacctgcccggcgccgccgccagcagacccctgagccccaacaagcccgacagagtgagacccggccagagagacagaatcggcgccaagagacagagaagaagaagagccgacgccggccaggccagagccgccagcagcagaagagtggtgcccaccgcccccgaggtgctgggcgccgtggccagcctgcccgacagaggcagacccaccgtggccagagtggccaccggcagcagactggagggcctgttcagcgccgccagcctgaagctgagcgccctgacccagagcctgaccagagtgagacaggcccccaccgccagcggcgccaccatcagactgcccgccagccccgtggagatgttcctgaccagcgccttcctgaccggcttcagcttccactgcctgtacagcggcatcggccacggcgaggacatcctggccagcgtggagcagatcaccatcgtgagcagacccctgagcggccagagaggcgccggccccggcaacagcgcctacacccccagaagaagccagggcggccccagagccgccaccacccccggcttcagattcccctgcagaggcctggtgagaagagccgtgctgagactgaccgtgaccgtgcaggactgcatcctgaccgccctgctggccgtgagcttccacagcatcggcgtggtgatcatgaccagcagctacctgctgggccccgtggtgaagtag

SEQ ID NO: 17321 - DNA, 213 bp, Artificial Sequence
  Description of Artificial Sequence: Synthetic coding sequence
atgttcaccagagcccaggtgagaagaatcctgcagagagtgcccggcaagcagagattcggcatctacagattcctgcccttcttcttcgtgctgggcggcaccatggagtggatcatgatcaaggtgagagtgggccaggagaccttctacgacgtgtacagaagaaaggccagcgagagacagtaccagagaagactggaggacgagtag

SEQ ID NO: 17322 - DNA, 3189 bp, Artificial Sequence
  Description of Artificial Sequence: Synthetic coding sequence
atggagagccaggagttcatcgtgctgtacacccaccagaagatgaagaagagcaaggtgtggcaggacggcatcctgaagatcacccacctgggcaacaaggccatcctgtacgacgacaagggcgcctgcctggagagcctgttcctgaagtgcctggaggtgaagcccggcgacgacctggagagcgacagatacctgatcaccgtggaggaggtgaaggtggccggcgccatcggcatcgtgaagcagaacgtgaacaaggaggcccccgagctgaacagcagaaccttcatcagcagcggcagaagcctgggctgccagcccagcggcctgaagagaaagttcaccggcttccagggccccagacaggtgcccaagaagatggtgatcatggagagcggcgagagcgccgccagccacgaggccaagaagaccggccccaccatcttcagccccttctgcagcatgccccccctgttccccaccgtgggcaagaaggacgtgaacaacatcctggccgaccccgagaacatcgtgacctacaagaacagagagagaaacgccatggacttcagcagcgtgttcagccccagcttccagatcaaccccgaggtgctgtgcgaggagaactacttctgcagccccgtgaacagcggcaacaagctgagcgacagcctgctgaccaacgagcccgtgaagagagacagcctggccagccactacagcggcgtgagccagaacatcagaagcaaggcccagatcctggccctgctgaagagcgagagcagcagcagctgcgaggagctgaacagcgagatgaccgagcacttcccccagaagcagccccagggcagcctgaagatcgccaccaagcccaagtacctgatccagcaggaggagtgcgccgagatgaagagcaccgagaacctgtactaccagcaccagagcgagaacaccatgagaaacaagagcagatgggccatgtacctgagcagccagagcagccccatccacagcagcaccgtggacggcaacgacaccgagagaaagcccaaggcccaggaggacgacgtgaacagcaacctgaaggacctgagcctgcagaagatcatccagttcgtggagacctacgccgaggagagaaagaagtacaacgtggaccagagcgtgggcaacaacgaccccagctggaaccaggaggtgaagctggagatccccagcttcaacgagagcagcagcctgcaggtgacctgcagcagcgccgagaacgacggcatcctgagcgagagcgacatccaggaggacaacaagatccccttcaaccagaacgacaagggctgcatcaagggcagcgtgctgatcaaggagaacgcccaggaggtgaacacctgcggcaccctggagaaggagtacgagcagagcgagagcagcctgcccgagctgaagcacctgcagatcgagagcagcaacaacagcagaatcagcgacgacatcaccgacatgatcagcgagagcaagatggacaacgagagcctgaacagcatccacgagagcctgagcaacgtgacccagcccttcctggaggtgaccttcaacctgaacaacttcgagaccagcgacaccgaggaggagagccaggagagcaacaagatcagccaggacagcgagagctgggtgaaggacatcctggtgaacgacggcaacagctgcttccagaagagaagcgagaacaccaactgcgaggagatcgagggcgagcacctgcccttcctgaccagcgtgagcgacaagcccaccgtgaccttccccgtgaaggagaccctgcccagccagttctgcgacaagacctacgtgggcttcgacatgggcatctgcaagaccgagaacaccggcaaggagatcgaggagtacagcgacaccctgagcaacttcgagagcttcaagtggaccgacgccgtgtacggcgacaacaaggaggacgccaacaagcccatccaggaggtgagaatcaactacgacttcgccctgccccccaacaagagcaagggcatcaacatgaacctgcacatcccccacatccagaaccagatcgccgagaacagcaacctgttcagcgaggacgcccagccccagcccttcatcctgggcagcgacctggacaagaacgacgagcacgtgctgcccagcaccagcagcagcgacaacagcgtgcagctgctgaacaccaaccagaaccactacgagtgcatcgccctggacaagagcaacacccacatcagcaacagcctgttctaccccctgggcaagaagcacctgatcagcaaggacaccgaggcccacatcagcgagcccgaggacctgggcaagatcagaagccccccccccgaccacgtggaggtggagaccgccagagagggcaagcagtactggaaccccagaaacagcagcgagctgagcggcctggtgaacaccatcagcatcctgaagagcctgtgcgagcacagcaccgccctggacagcctggagatcctgaagaagaagaacaccgtgttccagcagggcacccagcagacctacgagcccgacagcccccccgaggtgagaaagcccttcatcaccgtggtgagccccaagagcccccacctgcacaaggacagccagcagatcctgaaggaggacgaggtggagctgagcgagcccctgcagagcgtgcagttcagcagcagcggcagcaaggaggagaccgccttccaggccgtgatccccaagcagatcgagagaaagacctgcgaccccaagcccgtggagttccagggccaccaggtgaagggcagcgccaccagcggcgtgatggtgagaggccacagcagccagctgggctgcagccagttccccgacagcaccgagtacgagaacttcatgaccgagacccccgagctgcccagcacctgcatgcagatcgacttcctgcaggtgaccagccccgaggagaacatcagcaccctgagccccgtgagcaccttcagcctgaacagcagagacgaggacttcatggtggagttcagcgagaccagcctgaaggccagaaccctgcccgacgacctgcacttcctgaacctggagggcagcagataccacatcgccctgatcagcgtgtacagcttcaagatgaagttcttcatctag

SEQ ID NO: 17323 - DNA, 2748 bp, Artificial Sequence
  Description of Artificial Sequence: Synthetic coding sequence
atgttccaggccatcctgtacgacgacaagggcgcctgcctggagagcctgttcctgaagtgcctggaggtgaagcccggcgacgacctggagagcgacagatacctgatcaccgtggaggaggtgaaggtggccggcgccatcggcatcgtgaagcagaacgtgaacaaggaggcccccgagctgaacagcagaaccttcatcagcagcggcagaagcctgggctgccagcccagcggcctgaagagaaagttcaccggcttccagggccccagacaggtgcccaagaagatggtgatcatggagagcggcgagagcgccgccagccacgaggccaagaagaccggccccaccatcttcagccccttctgcagcatgccccccctgttccccaccgtgggcaagaaggacgtgaacaacatcctggccgaccccgagaacatcgtgacctacaagaacagagagagaaacgccatggacttcagcagcgtgttcagccccagcttccagatcaaccccgaggtgctgtgcgaggagaactacttctgcagccccgtgaacagcggcaacaagctgagcgacagcctgctgaccaacgagcccgtgaagagagacagcctggccagccactacagcggcgtgagccagaacatcagaagcaaggcccagatcctggccctgctgaagagcgagagcagcagcagctgcgaggagctgaacagcgagatgaccgagcacttcccccagaagcagccccagggcagcctgaagatcgccaccaagcccaagtacctgatccagcaggaggagtgcgccgagatgaagagcaccgagaacctgtactaccagcaccagagcgagaacaccatgagaaacaagagcagatgggccatgtacctgagcagccagagcagccccatccacagcagcaccgtggacggcaacgacaccgagagaaagcccaaggcccaggaggacgacgtgaacagcaacctgaaggacctgagcctgcagaagatcatccagttcgtggagacctacgccgaggagagaaagaagtacaacgtggaccagagcgtgggcaacaacgaccccagctggaaccaggaggtgaagctggagatccccagcttcaacgagagcagcagcctgcaggtgacctgcagcagcgccgagaacgacggcatcctgagcgagagcgacatccaggaggacaacaagatccccttcaaccagaacgacaagggctgcatcaagggcagcgtgctgatcaaggagaacgcccaggaggtgaacacctgcggcaccctggagaaggagtacgagcagagcgagagcagcctgcccgagctgaagcacctgcagatcgagagcagcaacaacagcagaatcagcgacgacatcaccgacatgatcagcgagagcaagatggacaacgagagcctgaacagcatccacgagagcctgagcaacgtgacccagcccttcctggaggtgaccttcaacctgaacaacttcgagaccagcgacaccgaggaggagagccaggagagcaacaagatcagccaggacagcgagagctgggtgaaggacatcctggtgaacgacggcaacagctgcttccagaagagaagcgagaacaccaactgcgaggagatcgagggcgagcacctgcccttcctgaccagcgtgagcgacaagcccaccgtgaccttccccgtgaaggagaccctgcccagccagttctgcgacaagacctacgtgggcttcgacatgggcatctgcaagaccgagaacaccggcaaggagatcgaggagtacagcgacaccctgagcaacttcgagagcttcaagtggaccgacgccgtgtacggcgacaacaaggaggacgccaacaagcccatccaggaggtgagaatcaactacgacttcgccctgccccccaacaagagcaagggcatcaacatgaacctgcacatcccccacatccagaaccagatcgccgagaacagcaacctgttcagcgaggacgcccagccccagcccttcatcctgggcagcgacctggacaagaacgacgagcacgtgctgcccagcaccagcagcagcgacaacagcgtgcagctgctgaacaccaaccagaaccactacgagtgcatcgccctggacaagagcaacacccacatcagcaacagcctgttctaccccctgggcaagaagcacctgatcagcaaggacaccgaggcccacatcagcgagcccgaggacctgggcaagatcagaagccccccccccgaccacgtggaggtggagaccgccagagagggcaagcagtactggaaccccagaaacagcagcgagctgagcggcctggtgaacaccatcagcatcctgaagagcctgtgcgagcacagcaccgccctggacagcctggagatcctgaagaagaagaacaccgtgttccagcagggcacccagcagacctacgagcccgacagcccccccgaggtgagaaagcccttcatcaccgtggtgagccccaagagcccccacctgcacaaggacagccagcagaagaccgtgaagaagaagatcaagcccaccctgcccctgagaatcttcatcaacgtgagcagattcttctgcgtgcagctgaagaagatggtgagactgatgtacatcaacagcttcatcagcttccccctgaacatcgtggtgctgagctacatcatcaacaacagcagctag

SEQ ID NO: 17324 - DNA, 525 bp, Artificial Sequence
  Description of Artificial Sequence: Synthetic coding sequence
atggagagccaggagttcatcgtgctgtacacccaccagaagatgaagaagagcaaggtgtggcaggacggcatcctgaagatcacccacctgggcaacaaggccatcctgtacgacgacaagggcgcctgcctggagagcctgttcctgaagtgcctggaggtgaagcccggcgacgacctggagagcgacagatacctgatcaccgtggaggaggtgaaggtggccggcgccatcggcatcgtgaagcagaacgtgaacaaggaggcccccgagctgaacagcagaaccttcatcagcagcggcagaagcctgggctgccagcccagcggcctgaagagaaagttcaccggcttccagggccccagacaggtgcccaagaagatggtgatcatggagagcggcgagagcgccgccagccacgaggccaagaagaccggccccaccatcttcagccccttctgcagcatgccccccctgttccccaccgtgggcaagaaggacgtgaacaacatcctggcctag

SEQ ID NO: 17325 - DNA, 600 bp, Artificial Sequence
  Description of Artificial Sequence: Synthetic coding sequence
atgaccagcctgatcaacagccccatcaacagaagacccctgcagaacgtggagggcaacaacagatgccagagaaaggccaagaactacggcaacaagtacttcatccactgcctggacctggagaagatcaccctgagccccagaagaaagcacgacatcgagggcggcgacaagctgaacgtgaagttcagccagctgagaagcagaagacagagaaaggccgagcccggcgcctgcgccctgggcagagtgggcagcgagtgcatccccgagcccggcgccagaagaaccgcccaggccgccggcctgagaagcgtgagcggcgccgccaacaccaaggtgagagagctgaagcacttcagattcctgggcctgctgagaagctgcagaagcgagatggaggtggacgcccccggcgtggacggcagagacggcctgagagagagaagaggcttcagcgagggcggcagacagaacttcgacgtgagaccccagagcggcgccaacggcctgcccaagcacagctactggctggacctgtggctgttcatcctgttcgacgtggtggtgttcctgttcgtgtacttcctgccctag

SEQ ID NO: 17326 - DNA, 201 bp, Artificial Sequence
  Description of Artificial Sequence: Synthetic coding sequence
atggaggtggacgcccccggcgtggacggcagagacggcctgagagagagaagaggcttcagcgagggcggcagacagaacttcgacgtgagaccccagagcggcgccaacggcctgcccaagcacagctactggctggacctgtggctgttcatcctgttcgacgtggtggtgttcctgttcgtgtacttcctgccctag

SEQ ID NO: 17327 - DNA, 399 bp, Artificial Sequence
  Description of Artificial Sequence: Synthetic coding sequence
atgtgcagcgccggcgagctgctgagaggcggcgacggcggcgagagagacgaggacggcgacgccctggccgagagagaggccgccggcaccggctgggaccccggcgccagccccagaagaagaggccagagacccaaggagagcgagcaggacgtggaggacagccagaaccacaccggcgagcccgtgggcgacgactacaagaagatgggcaccctgttcggcgagctgaacaagaacctgatcaacatgggcttcaccagaatgtacttcggcgagagaatcgtggagcccgtgatcgtgatcttcttctgggtgatgctgtggttcctgggcctgcaggccctgggcctggtggccgtgctgtgcctggtgatcatctacgtgcagcagtag

SEQ ID NO: 17328 - DNA, 300 bp, Artificial Sequence
  Description of Artificial Sequence: Synthetic coding sequence
atggccgagggcggcttcgacccctgcgagtgcgtgtgcagccacgagcacgccatgagaagactgatcaacctgctgagacagagccagagctactgcaccgacaccgagtgcctgcaggagctgcccggccccagcggcgacaacggcatcagcgtgaccatgatcctggtggcctggatggtgatcgccctgatcctgttcctgctgagaccccccaacctgagaggcagcagcctgcccggcaagcccaccagcccccacaacggccaggacccccccgccccccccgtggactag

SEQ ID NO: 17329 - DNA, 270 bp, Artificial Sequence
  Description of Artificial Sequence: Synthetic coding sequence
atggccgagggcggcttcgacccctgcgagtgcgtgtgcagccacgagcacgccatgagaagactgatcaacctgctgagacagagccagagctactgcaccgacaccgagtgcctgcaggagctgcccggccccagcggcgacaacggcatcagcgtgaccatgatcctggtggcctggatggtgatcgccctgatcctgttcctgctgagaccccccaacctgagaggcagcagcctgcccggcaagcccaccagcccccacaactag

SEQ ID NO: 17330 - DNA, 723 bp, Artificial Sequence
  Description of Artificial Sequence: Synthetic coding sequence
atgtacctgagaagagccgtgagcaagaccctggccctgcccctgagagccccccccaaccccgcccccctgggcaaggacgccagcctgagaagaatgagcagcaacagattccccggcagcagcggcagcaacatgatctactacctggtggtgggcgtgaccgtgagcgccggcggctactacgcctacaagaccgtgaccagcgaccaggccaagcacaccgagcacaagaccaacctgaaggagaagaccaaggccgagatccaccccttccagggcgagaaggagaacgtggccgagaccgagaaggccagcagcgaggcccccgaggagctgatcgtggaggccgaggtggtggacgccgaggagagccccagcgccaccgtggtggtgatcaaggaggccagcgcctgccccggccacgtggaggccgcccccgagaccaccgccgtgagcgccgagaccggccccgaggtgaccgacgccgccgccagagagaccaccgaggtgaaccccgagaccacccccgaggtgaccaacgccgccctggacgaggccgtgaccatcgacaacgacaaggacaccaccaagaacgagaccagcgacgagtacgccgagctggaggaggagaacagccccgccgagagcgagagcagcgccggcgacgacctgcaggaggaggccagcgtgggcagcgaggccgccagcgcccagggctag

SEQ ID NO: 17331 - DNA, 2337 bp, Artificial Sequence
  Description of Artificial Sequence: Synthetic coding sequence
atggacagcaaggagagcctgacccccggcagagaggagaaccccagcagcgtgctggcccaggagagaggcgacgtgatggacttctacaagaccctgagaggcggcgccaccgtgaaggtgagcgccagcagccccagcctggccgtggccagccagagcgacagcaagcagagaagactgctggtggacttccccaagggcagcgtgagcaacgcccagcagcccgacctgagcaaggccgtgagcctgagcatgggcctgtacatgggcgagaccgagaccaaggtgatgggcaacgacctgggcttcccccagcagggccagatcagcctgagcagcggcgagaccgacctgaagctgctggaggagagcatcgccaacctgaacagaagcaccagcgtgcccgagaaccccaagagcagcgccagcaccgccgtgagcgccgcccccaccgagaaggagttccccaagacccacagcgacgtgagcagcgagcagcagcacctgaagggccagaccggcaccaacggcggcaacgtgaagctgtacaccaccgaccagagcaccttcgacatcctgcaggacctggagttcagcagcggcagccccggcaaggagaccaacgagagcccctggagaagcgacctgctgatcgacgagaactgcctgctgagccccctggccggcgaggacgacagcttcctgctggagggcaacagcaacgaggactgcaagcccctgatcctgcccgacaccaagcccaagatcaaggacaacggcgacctggtgctgagcagccccagcaacgtgaccctgccccaggtgaagaccgagaaggaggacttcatcgagctgtgcacccccggcgtgatcaagcaggagaagctgggcaccgtgtactgccaggccagcttccccggcgccaacatcatcggcaacaagatgagcgccatcagcgtgcacggcgtgagcaccagcggcggccagatgtaccactacgacatgaacaccgccagcctgagccagcagcaggaccagaagcccatcttcaacgtgatcccccccatccccgtgggcagcgagaactggaacagatgccagggcagcggcgacgacaacctgaccagcctgggcaccctgaacttccccggcagaaccgtgttcagcaacggctacagcagccccagcatgagacccgacgtgagcagcccccccagcagcagcagcaccgccaccaccggccccccccccaagctgtgcctggtgtgcagcgacgaggccagcggctgccactacggcgtgctgacctgcggcagctgcaaggtgttcttcaagagagccgtggagggcagacagcacaactacctgtgcgccggcagaaacgactgcatcatcgacaagatcagaagaaagaactgccccgcctgcagatacagaaagtgcctgcaggccggcatgaacctggaggccagaaagaccaagaagaagatcaagggcatccagcaggccaccaccggcgtgagccaggagaccagcgagaaccccggcaacaagaccatcgtgcccgccaccctgccccagctgacccccaccctggtgagcctgctggaggtgatcgagcccgaggtgctgtacgccggctacgacagcagcgtgcccgacagcacctggagaatcatgaccaccctgaacatgctgggcggcagacaggtgatcgccgccgtgaagtgggccaaggccatccccggcttcagaaacctgcacctggacgaccagatgaccctgctgcagtacagctggatgttcctgatggccttcgccctgggctggagaagctacagacagagcagcgccaacctgctgtgcttcgcccccgacctgatcatcaacgagcagagaatgaccctgccctgcatgtacgaccagtgcaagcacatgctgtacgtgagcagcgagctgcacagactgcaggtgagctacgaggagtacctgtgcatgaagaccctgctgctgctgagcagcgtgcccaaggacggcctgaagagccaggagctgttcgacgagatcagaatgacctacatcaaggagctgggcaaggccatcgtgaagagagagggcaacagcagccagaactggcagagattctaccagctgaccaagctgctggacagcatgcacgaggtggtggagaacctgctgaactactgcttccagaccttcctggacaagaccatgagcatcgagttccccgagatgctggccgagatcatcaccaaccagatccccaagtacagcaacggcaacatcaagaagctgctgttccaccagaagtag

SEQ ID NO: 17332 - DNA, 498 bp, Artificial Sequence
  Description of Artificial Sequence: Synthetic coding sequence
atgaagaccaagcccaacctgctgttccccaagagcgccccccccagcctgcccagaagagtgcccagaaaggtggaggaggacctgctgatgctgaacagcagccccagcaccgccaaggacaccctggacaacggcgactacggcgagcccgactacgactggaccaccggccccagagacgacgacgagagcgacgacaccctggaggagaacagaggctacatggagatcgagcagagcgtgaagagcttcaagatgcccagcagcaacatcgaggaggaggacagccacttcttcttccacctgatcatcttcgccttctgcatcgccgtggtgtacatcacctaccacaacaagagaaagatcttcctgctggtgcagagcagaaagtggagagacggcctgtgcagcaagaccgtggagtaccacagactggaccagaacgtgaacgaggccatgcccagcctgaagatcaccaacgactacatcttctag

SEQ ID NO: 17333 - DNA, 648 bp, Artificial Sequence
  Description of Artificial Sequence: Synthetic coding sequence
atggccagcgagaccgagaagacccacgccctgctgcagacctgcagcaccgagagcctgatcagcagcctgggcctgggcgccttctgcctggtggccgacagactgctgcagttcagcaccatccagcagaacgactggctgagagccctgagcgacaacgccgtgcactgcgtgatcggcatgtggagctgggccgtggtgaccggcatcaagaagaagaccgacttcggcgagatcatcctggccggcttcctggccagcgtgatcgacgtggaccacttcttcctggccggcagcatgagcctgaaggccgccctgaccctgcccagaagacccttcctgcactgcagcaccgtgatccccgtggtggtgctgaccctgaagttcaccatgcacctgttcaagctgaaggacagctggtgcttcctgccctggatgctgttcatcagctggaccagccaccacatcagagacggcatcagacacggcctgtggatctgccccttcggcaagaccagccccctgcccttctggctgtacgtgatcatcaccagcagcctgccccacatctgcagcttcgtgatgtacctgaccggcaccagacagatgatgagcagcaagcacggcgtgagaatcgacgtgtag

SEQ ID NO: 17334 - DNA, 648 bp, Artificial Sequence; identical to SEQ ID NO: 17333
  Description of Artificial Sequence: Synthetic coding sequence

SEQ ID NO: 17335 - DNA, 531 bp, Artificial Sequence
  Description of Artificial Sequence: Synthetic coding sequence
atggccagcgagaccgagaagacccacgccctgctgcagacctgcagcaccgagagcctgatcagcagcctgggcctgggcgccttctgcctggtggccgacagactgctgcagttcagcaccatccagcagaacgactggctgagagccctgagcgacaacgccgtgcactgcgtgatcggcatgtggagctgggccgtggtgaccggcatcaagaagaagaccgacttcggcgagatcatcctggccggcttcctggccagcgtgatcgacgtggaccacttcttcctggccggcagcatgagcctgaaggccgccctgaccctgcccagaagacccttcctgcactgcagcaccgtgatccccgtggtggtgctgaccctgaagttcaccatgcacctgttcaagctgaaggacagctggtgcttcctgccctggatgctgttcatcagctggaccagccaccacatcagagacggcatcagacacggcctgtggatctgccccttcggcaagaccagccccctgtag

SEQ ID NO: 17336 - DNA, 648 bp, Artificial Sequence; identical to SEQ ID NO: 17333
  Description of Artificial Sequence: Synthetic coding sequence

SEQ ID NO: 17337 - DNA, 255 bp, Artificial Sequence
  Description of Artificial Sequence: Synthetic coding sequence
atgcacctgttcaagctgaaggacagctggtgcttcctgccctggatgctgttcatcagctggaccagccaccacatcagagacggcatcagacacggcctgtggatctgccccttcggcaagaccagccccctgcccttctggctgtacgtgatcatcaccagcagcctgccccacatctgcagcttcgtgatgtacctgaccggcaccagacagatgatgagcagcaagcacggcgtgagaatcgacgtgtag

SEQ ID NO: 17338 - DNA, 1002 bp, Artificial Sequence
  Description of Artificial Sequence: Synthetic coding sequence
atgaagggcgaggccggccacatgctgcacaacgagaagagcaagcaggagggccacatctggggcagcatgagaagaaccgccttcatcctgggcagcggcctgctgagcttcgtggccttctggaacagcgtgacctggcacctgcagagattctggggcgccagcggctacttctggcaggcccagtgggagagactgctgaccaccttcgagggcaaggagtggatcctgttcttcatcggcgccatccaggtgccctgcctgttcttctggagcttcaacggcctgctgctggtggtggacaccaccggcaagcccaacttcatcagcagatacagaatccaggtgggcaagaacgagcccgtggaccccgtgaagctgagacagagcatcagaaccgtgctgttcaaccagtgcatgatcagcttccccatggtggtgttcctgtaccccttcctgaagtggtggagagacccctgcagaagagagctgcccaccttccactggttcctgctggagctggccatcttcaccctgatcgaggaggtgctgttctactacagccacagactgctgcaccaccccaccttctacaagaagatccacaagaagcaccacgagtggaccgcccccatcggcgtgatcagcctgtacgcccaccccatcgagcacgccgtgagcaacatgctgcccgtgatcgtgggccccctggtgatgggcagccacctgagcagcatcaccatgtggttcagcctggccctgatcatcaccaccatcagccactgcggctaccacctgcccttcctgcccagccccgagttccacgactaccaccacctgaagttcaaccagtgctacggcgtgctgggcgtgctggaccacctgcacggcaccgacaccatgttcaagcagaccaaggcctacgagagacacgtgctgctgctgggcttcacccccctgagcgagagcatccccgacagccccaagagaatggagtag

SEQ ID NO: 17339 - DNA, 933 bp, Artificial Sequence
  Description of Artificial Sequence: Synthetic coding sequence
atgagaagaaccgccttcatcctgggcagcggcctgctgagcttcgtggccttctggaacagcgtgacctggcacctgcagagattctggggcgccagcggctacttctggcaggcccagtgggagagactgctgaccaccttcgagggcaaggagtggatcctgttcttcatcggcgccatccaggtgccctgcctgttcttctggagcttcaacggcctgctgctggtggtggacaccaccggcaagcccaacttcatcagcagatacagaatccaggtgggcaagaacgagcccgtggaccccgtgaagctgagacagagcatcagaaccgtgctgttcaaccagtgcatgatcagcttccccatggtggtgttcctgtaccccttcctgaagtggtggagagacccctgcagaagagagctgcccaccttccactggttcctgctggagctggccatcttcaccctgatcgaggaggtgctgttctactacagccacagactgctgcaccaccccaccttctacaagaagatccacaagaagcaccacgagtggaccgcccccatcggcgtgatcagcctgtacgcccaccccatcgagcacgccgtgagcaacatgctgcccgtgatcgtgggccccctggtgatgggcagccacctgagcagcatcaccatgtggttcagcctggccctgatcatcaccaccatcagccactgcggctaccacctgcccttcctgcccagccccgagttccacgactaccaccacctgaagttcaaccagtgctacggcgtgctgggcgtgctggaccacctgcacggcaccgacaccatgttcaagcagaccaaggcctacgagagacacgtgctgctgctgggcttcacccccctgagcgagagcatccccgacagccccaagagaatggagtag

SEQ ID NO: 17340 - DNA, 441 bp, Artificial Sequence
  Description of Artificial Sequence: Synthetic coding sequence
atgagaagaaccgccttcatcctgggcagcggcctgctgagcttcgtggccttctggaacagcgtgacctggcacctgcagagattctggggcgccagcggctacttctggcaggcccagtgggagagactgctgaccaccttcgagggcaaggagtggatcctgttcttcatcggcgccatccaggtgccctgcctgttcttctggagcttcaacggcctgctgctggtggtggacaccaccggcaagcccaacttcatcagcagatacagaatccaggtgggcaagaacgagcccgtggaccccgtgaagctgagacagagcatcagaaccgtgctgttcaaccagtgcatgatcagcttccccatggtggtgttcctgtaccccttcctgaagtggtggagagacccctgcagaagagagctgcccaccttccactag

SEQ ID NO: 17341 - DNA, 99 bp, Artificial Sequence
  Description of Artificial Sequence: Synthetic coding sequence
atgaagggcgaggccggccacatgctgcacaacgagaagagcaagcaggagggccacatctggggcagcatgagaagaaccgccttcatcctgggctag

SEQ ID NO: 17342 - DNA, 225 bp, Artificial Sequence
  Description of Artificial Sequence: Synthetic coding sequence
atgttcgacatcaaggcctgggccgagtacgtggtggagtgggccgccaaggacccctacggcttcctgaccaccgtgatcctggccctgacccccctgttcctggccagcgccgtgctgagctggaagctggccaagatgatcgaggccagagagaaggagcagaagaagaagcagaagagacaggagaacatcgccaaggccaagagactgaagaaggactag

SEQ ID NO: 17343 - DNA, 225 bp, Artificial Sequence; identical to SEQ ID NO: 17342
  Description of Artificial Sequence: Synthetic coding sequence

SEQ ID NO: 17344 - DNA, 183 bp, Artificial Sequence
  Description of Artificial Sequence: Synthetic coding sequence
atggacgccgtgagccaggtgcccatggaggtggtgctgcccaagcacatcctggacatctgggtgatcgtgctgatcatcctggccaccatcgtgatcatgaccagcctgctgctgtgccccgccaccgccgtgatcatctacagaatgagaacccaccccatcctgagcggcgccgtgtag

SEQ ID NO: 17345 - DNA, 1683 bp, Artificial Sequence
  Description of Artificial Sequence: Synthetic coding sequence
agcgtgctgaagatcaccctggccgtgatcctgaccctgctgggcctggccatcctggccatcctgctgaccagatgggccagatgcaagcagagcgagatgtacatcagcagatacagcagcgagcagagcgccagactgctggactacgaggacggcagaggcagcagacacgcctacagcacccagagcgacaccagctacgacaacagagccagatacgaggcccccttcagccccaagatcgagaagctggccatcagcaagagcagcctggccctgccccagggcagcatgagcagcatcaagtgcctgcagaccaccgaggagcccccctgcatcccctgcgtgatgatcctgatcttctacaacgtgcccgccaccagaggcatgggcaaggtggtgagaaagcacatcatgcagacccccggccccatcggcaagctgcccgtgttcagcgtgagaagccacccccacaccatcaccggcccccccagcgcccccagaggcaagcccgtgagcaccctgctgatcagcaacagcgtgtgcagctacctgacccagagcttccagttccccgaggtgagaaccatcgccaccaagaagagagccaccacccagggcagcgtgatcctgaccggctacatggacgaggagctggccaagaagagctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcatcccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 17346 - DNA, 1704 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagatgcaagcagagcgagatgtacatcagcagatacagcagcgagcagagcgccagactgctggactacgaggacggcagagtggagtgccaccacggccagcagaaggagaccagccacagaaagaccgagagaaagctgagaagagagagaaagagaatcaccaacgagagaagactgatcggcaccgagaagagcctgccccagggcagcatgagcagcatcaagtgcctgcagaccaccgaggagcccccctgcaagggcatgggcaaggtgatccaggccaagcagctgctgaacatcagctggcccctggccgtgagcctgagcaagcccctgtgcatcatccacgacgtgctggagagcttcaagaccatcaacctgcagagccccgccggcttccaggccgtgaccagccactgcaagaagggcagagacaagttcagaaagatcctggtgtacaagaagggcaccagcatcaagggcaagaagatcgagatcaagagaaagtacctgatcagcaagagcagacccttcgtggtgtgcagcgtgatcctgaccggctacatggacgaggagctggccaagaagagctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgacgagtacaccaccagaaccggcagccccaacaaggagaagtgcgtgagatgcaccaagagaaccggccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagaagacagatccaggagggcagcaccaccaagaagtggaagagcaaggacaagttcttcaagggcccctag

SEQ ID NO: 17347 - DNA, 1686 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagatgcaagcagagcgagatgtacatcagcagatacagcagcgagcagagcgccagactgctggactacgaggacggcagaggcagcagacacgcctacagcacccagagcggcaacctgtgcttccagagaagcaagagagactacacccccagcaccaacagcctggtgagcatggccagcaagttcagcctgggccagaccgagctgatcctgctgctgatgtgcttcatcctggccctgagcagaagcagcatcggcagcatcaagtgcctgcagaccaccgaggagccccccagcagaaccgccggcgccatgatgcagttcaccgcccccatccccggcgccaccggccccatcaagctgagccagaagaccatcgtgcagacccccggccccatcgtgcagtaccccggcagcaacgccggcccccccagcgcccccagaggcccccccatggcccccatcatcatcagccagagaaccgccagaatcccccaggtgcacaccatggacagcagcggcaagatcaccctgacccccgtggtgatcctgaccggctacatggacgaggagctggccaagaagagctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcatcccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 17348 - DNA, 1692 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagatgcaagcagagcgagatgtacatcagcagatacagcagcgagcagagcgccagactgctggactacgaggacggcagaggcagcagacacgcctacagcacccagagcgacaccagctacgacaacagagagagaagcaagagagactacacccccagcaccaacagcctggtgagcatggccagcaagttcagcctgggccagaccgagctgatcctgctgctgatgtgcttcatcctggccctgagcagaagcagcatcggcagcatcaagtgcctgcagaccaccgaggagccccccagcagaaccgccggcgccatgatgcagttcaccgcccccatccccggcgccaccggccccatcaagctgagccagaagaccatcgtgcagacccccggccccatcgtgcagtaccccggcagcaacgccggcccccccagcgcccccagaggcccccccatggcccccatcatcatcagccagagaaccgccagaatcccccaggtgcacaccatggacagcagcggcaagatcaccctgacccccgtggtgatcctgaccggctacatggacgaggagctggccaagaagagctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcatcccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 17349 - DNA, 1692 bp, Artificial Sequence; identical to SEQ ID NO: 17348
  Description of Artificial Sequence: Synthetic coding sequence

SEQ ID NO: 17350 - DNA, 1689 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagatgcaagcagagcgagatgtacatcagcagatacagcagcgagcagagcgccagactgctggactacgaggacggcagaggcagcagacacgcctacagcacccagagcgacaccagctacgacaacagagagagaagcaagagagactacacccccagcaccaacagcctggccctgagcagaagcagcatcgccctgccccagggcagcatgagcagcatcaagtgcctgcagaccaccgaggagccccccagcagaaccgccggcgccatgatgcagttcaccgcccccatccccggcgccaccggccccatcaagctgagccagaagaccatcgtgcagacccccggccccatcgtgcagtaccccggcagcaacgtgagaagccacccccacaccatcaccggcccccccagcgcccccagaggcccccccatggcccccatcatcatcagccagagaaccgccagccagctggccgcccccatcagaatcccccaggtgcacaccatggacagcagcggcaagatcaccctgacccccgtggtgatcctgaccggctacatggacgaggagctggccaagaagagctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcatcccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 17351 - DNA, 1686 bp, Artificial Sequence; identical to SEQ ID NO: 17347
  Description of Artificial Sequence: Synthetic coding sequence

SEQ ID NO: 17352 - DNA, 1683 bp, Artificial Sequence; identical to SEQ ID NO: 17345
  Description of Artificial Sequence: Synthetic coding sequence

SEQ ID NO: 17353 - DNA, 1704 bp, Artificial Sequence; identical to SEQ ID NO: 17346
  Description of Artificial Sequence: Synthetic coding sequence

SEQ ID NO: 17354 - DNA, 1644 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagatgcaagcagagcgagatgtacatcagcagatacagcagcgagcagagcgccagactgctggactacgaggacggcagaggcagcagacacgcctacagcacccagagcgagagaagcaagagagactacacccccagcaccaacagcctggccctgagcagaagcagcatcgccctgccccagggcagcatgagcagcatcaagtgcctgcagaccaccgaggagccccccagcagaaccgccggcgccatgatgcagttcaccgcccccatccccggcgccaccggccccatcaagctgagccagaagaccatcgtgcagacccccggccccatcgtgcagtaccccggcagcaacgccggcccccccagcgcccccagaggcccccccatggcccccatcatcatcagccagagaaccgccagccagctggccgcccccatcagaatcccccaggtgcacaccatggacagcagcggcaagatcaccctgacccccgtggtgatcctgaccggctacatggacgaggagctggccaagaagagctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcatcccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 17355 - DNA, 306 bp, Artificial Sequence
  Description of Artificial Sequence: Synthetic coding sequence
atggccgccagcagatacagaagattcctgaagctgtgcgaggagtggcccgtggacgagaccaagagaggcagagacctgggcgcctacctgagacagagagtggcccaggccttcagagagggcgagaacacccagtaccccagacccagagacaccagcttcagcggcctgagcctggaggagtacaagctgatcctgagcaccgacaccctggaggagctgaaggagatcgacaagggcatgtggaagaagctgcaggagaagttcgcccccaagggccccgaggaggaccacaaggcctag

SEQ ID NO: 17356 - DNA, 381 bp, Artificial Sequence
  Description of Artificial Sequence: Synthetic coding sequence
atggccgccagcagatacagaagattcctgaagctgtgcgaggagtggcccgtggacgagaccaagagaggcagagacctgggcgcctacctgagacagagagtggcccaggccttcagagagggcgagaacacccaggtggccgagcccgaggcctgcgaccagatgtacgagagcctggccagactgcacagcaactactacaagcacaagtaccccagacccagagacaccagcttcagcggcctgagcctggaggagtacaagctgatcctgagcaccgacaccctggaggagctgaaggagatcgacaagggcatgtggaagaagctgcaggagaagttcgcccccaagggccccgaggaggaccacaaggcctag

SEQ ID NO: 17357 - DNA, 1491 bp, Artificial Sequence
  Description of Artificial Sequence: Synthetic coding sequence
atgtaccagcccagcagaggcgccgccagaagactgggcccctgcctgagagcctaccaggccagaccccaggtgagcggcggcgaggagggcggcagaagaggcggcggcgagagacccagcagcaagcccgtgagaggcgccgagagagccctgggcagcgcccaggcccagagacaccccccccccctgcccacctgcgccctgcagagagtggacagactgggcgtggccggcgccggcggcagaagatgcagagcctgcagagccagaaccagcgtgctgcccggcctgagagccgtgagaagaggccagggccaggccgccggcagagtgtgcgtggcccccgacagccccagactgcccgtgcccagaggcgacctgaagggcagaggcagagagatcagaagccccgccgccgcccccagcagaagcagccccgcccagaccagacccgccggcagaccccagcagcccgccagactggccctgggcgagagaagctggcaggagggcagacccgtgtgcaccagattcggccccctgagacccggctggcaggacggccacgcccccagcagagacggcgccagcagaacccccagcggcaccgaggaccagctgtaccccggcaccctgcccttcccccccctgtggccccacagcaccaccaccaccagccccagcagccccctgttctggagccccctgccccccagactgcccacccagagactgccccaggtgccccccctgcccctgccccagatccaggccctgagcagcgcctgggtggtgctgccccccggcaagggcgaggagggccccggccccgagctgcacagcggctgcctggacggcctgagaagcctgttcgagggccccccctgcccctaccccggcgcctggatccccttccaggtgcccggcaccgcccaccccagccccgccacccccagcggcgaccccagcatggaggagcacctgagcgtgatgtacgagagactgagacaggagctgcccaagctgttcctgcagagccacgactacagcctgtacagcctggacgtggagttcatcaacgagatcctgaacatcagaaccaagggcagaacctggtacatcctgagcctgaccctgtgcagattcctggcctggaactacttcgcccacctgagactggaggtgctgcagctgaccagacaccccgagaactggaccctgcaggccagatggagactggtgggcctgcccgtgcacctgctgttcctgagattctacaagagagacaaggacgagcactacagaacctacgacgcctacagcaccttctacctgaacagcagcggcctgatctgcagacacagactggacaagctgatgcccagccacagcccccccacccccgtgaagaagctgctggtgggcgccctggtggccctgggcctgagcgagcccgagcccgacctgaacctgtgcagcaagccctag

SEQ ID NO: 17358 - DNA, 546 bp, Artificial Sequence
  Description of Artificial Sequence: Synthetic coding sequence
atgtaccagcccagcagaggcgccgccagaagactgggcccctgcctgagagcctaccaggccagaccccagctgcccaagctgttcctgcagagccacgactacagcctgtacagcctggacgtggagttcatcaacgagatcctgaacatcagaaccaagggcagaacctggtacatcctgagcctgaccctgtgcagattcctggcctggaactacttcgcccacctgagactggaggtgctgcagctgaccagacaccccgagaactggaccctgcaggccagatggagactggtgggcctgcccgtgcacctgctgttcctgagattctacaagagagacaaggacgagcactacagaacctacgacgcctacagcaccttctacctgaacagcagcggcctgatctgcagacacagactggacaagctgatgcccagccacagcccccccacccccgtgaagaagctgctggtgggcgccctggtggccctgggcctgagcgagcccgagcccgacctgaacctgtgcagcaagccctag

SEQ ID NO: 17359 - DNA, 948 bp, Artificial Sequence
  Description of Artificial Sequence: Synthetic coding sequence
atgtaccagcccagcagaggcgccgccagaagactgggcccctgcctgagagcctaccaggccagaccccaggaccagctgtaccccggcaccctgcccttcccccccctgtggccccacagcaccaccaccaccagccccagcagccccctgttctggagccccctgccccccagactgcccacccagagactgccccaggtgccccccctgcccctgccccagatccaggccctgagcagcgcctgggtggtgctgccccccggcaagggcgaggagggccccggccccgagctgcacagcggctgcctggacggcctgagaagcctgttcgagggccccccctgcccctaccccggcgcctggatccccttccaggtgcccggcaccgcccaccccagccccgccacccccagcggcgaccccagcatggaggagcacctgagcgtgatgtacgagagactgagacaggagctgcccaagctgttcctgcagagccacgactacagcctgtacagcctggacgtggagttcatcaacgagatcctgaacatcagaaccaagggcagaacctggtacatcctgagcctgaccctgtgcagattcctggcctggaactacttcgcccacctgagactggaggtgctgcagctgaccagacaccccgagaactggaccctgcaggccagatggagactggtgggcctgcccgtgcacctgctgttcctgagattctacaagagagacaaggacgagcactacagaacctacgacgcctacagcaccttctacctgaacagcagcggcctgatctgcagacacagactggacaagctgatgcccagccacagcccccccacccccgtgaagaagctgctggtgggcgccctggtggccctgggcctgagcgagcccgagcccgacctgaacctgtgcagcaagccctag

SEQ ID NO: 17360 - DNA, 519 bp, Artificial Sequence
  Description of Artificial Sequence: Synthetic coding sequence
atggaggagcacctgagcgtgatgtacgagagactgagacaggagctgcccaagctgttcctgcagagccacgactacagcctgtacagcctggacgtggagttcatcaacgagatcctgaacatcagaaccaagggcagaacctggtacatcctgagcctgaccctgtgcagattcctggcctggaactacttcgcccacctgagactggaggtgctgcagctgaccagacaccccgagaactggaccctgcaggccagatggagactggtgggcctgcccgtgcacctgctgttcctgagattctacaagagagacaaggacgagcactacagaacctacgacgcctacagcaccttctacctgaacagcagcggcctgatctgcagacacagactggacaagctgatgcccagccacagcccccccacccccgtgaagaagctgctggtgggcgccctggtggccctgggcctgagcgagcccgagcccgacctgaacctgtgcagcaagccctag

SEQ ID NO: 17361 - DNA, 2541 bp, Artificial Sequence
  Description of Artificial Sequence: Synthetic coding sequence
atgtgcttcctgagaagacccggcgcccccgccagctggatctggtggagaatgctgagacaggtgctgagaagaggcctgcagagcttctgccacagactgggcctgtgcgtgagcagacaccccgtgttcttcctgaccgtgcccgccgtgctgaccatcaccttcggcctgagcgccctgaacagattccagcccgagggcgacctggagagactggtggcccccagccacagcctggccaagatcgagagaagcctggccagcagcctgttccccctggaccagagcaagagccagctgtacagcgacctgcacacccccggcagatacggcagagtgatcctgctgagccccaccggcgacaacatcctgctgcaggccgagggcatcctgcagacccacagagccgtgctggagatgaaggacggcagaaacagcttcatcggccaccagctgggcggcgtggtggaggtgcccaacagcaaggaccagagagtgaagagcgccagagccatccagatcacctactacctgcagacctacggcagcgccacccaggacctgatcggcgagaagtgggagaacgagttctgcaagctgatcagaaagctgcaggaggagcaccaggagctgcagctgtacagcctggccagcttcagcctgtggagagacttccacaagaccagcatcctggccagaagcaaggtgctggtgagcctggtgctgatcctgaccaccgccaccctgagcagcagcatgaaggactgcctgagaagcaagcccttcctgggcctgctgggcgtgctgaccgtgtgcatcagcatcatcaccgccgccggcatcttcttcatcaccgacggcaagtacaacagcaccctgctgggcatccccttcttcgccatgggccacggcaccaagggcgtgttcgagctgctgagcggctggagaagaaccaaggagaacctgcccttcaaggacagaatcgccgacgcctacagcgacgtgatggtgacctacaccatgaccagcagcctgtacttcatcaccttcggcatgggcgccagccccttcaccaacatcgaggccgtgaaggtgttctgccagaacatgtgcgtgagcatcctgctgaactacttctacatcttcagcttcttcggcagctgcctggtgttcgccggccagctggagcagaacagataccacagcatcttctgctgcaagatccccagcgccgagtacctggacagaaagcccgtgtggttccagaccgtgatgagcgacggccaccagcagaccagccaccacgagaccaacccctaccagcaccacttcatccagcacttcctgagagagcactacaacgagtggatcaccaacatctacgtgaagcccttcgtggtgatcctgtacctgatctacgccagcttcagcttcatgggctgcctgcagatcagcgacggcgccaacatcatcaacctgctggccagcgacagccccagcgtgagctacgccatggtgcagcagaagtacttcagcaactacagccccgtgatcggcttctacgtgtacgagcccctggagtactggaacagcagcgtgcaggacgacctgagaagactgtgcagcggcttcaccgccgtgagctgggtggagcagtactaccagttcctgaaggtgagcaacgtgagcgccaacaacaagagcgacttcatcagcgtgctgcagagcagcttcctgaagaagcccgagttccagcacttcagaaacgacatcatcttcagcaaggccggcgacgagagcaacatcatcgccagcagactgtacctggtggccagaaccagcagagacaagcagaaggagatcaccgaggtgctggagaagctgagacccctgagcctgagcaagagcatcagattcatcgtgttcaaccccagcttcgtgttcatggaccactacagcctgagcgtgaccgtgcccgtgctgatcgccggcttcggcgtgctgctggtgctgatcctgaccttcttcctggtgatccaccccctgggcaacttctggctgatcctgagcgtgaccagcatcgagctgggcgtgctgggcctgatgaccctgtggaacgtggacatggactgcatcagcatcctgtgcctgatctacaccctgaacttcgccatcgaccactgcgcccccctgctgttcaccttcgtgctggccaccgagcacaccagaacccagtgcatcaagagcagcctgcaggaccacggcaccgccatcctgcagaacgtgaccagcttcctgatcggcctggtgcccctgctgttcgtgcccagcaacctgaccttcaccctgttcaagtgcctgctgctgaccggcggctgcaccctgctgcactgcttcgtgatcctgcccgtgttcctgaccttcttcccccccagcaagaagcaccacaagaagaagaagagagccaagagaaaggagagagaggagatcgagtgcatcgagatccaggagaaccccgaccacgtgaccaccgtgtag

SEQ ID NO: 17362 - DNA, 936 bp, Artificial Sequence
  Description of Artificial Sequence: Synthetic coding sequence
tgatgcttcctgagaagacccggcgcccccgccagctggatctggtggagaatgctgagacaggtgctgagaagaggcctgcagagcttctgccacagactgggcctgtgcgtgagcagacaccccgtgttcttcctgaccgtgcccgccgtgctgaccatcaccttcggcctgagcgccctgaacagattccagcccgagggcgacctggagagactggtggcccccagccacagcctggccaagatcgagagaagcctggccagcagcctgttccccctggaccagagcaagagccagctgtacagcgacctgcacacccccggcagatacggcagagtgatcctgctgagccccaccggcgacaacatcctgctgcaggccgagggcatcctgcagacccacagagccgtgctggagatgaaggacggcagaaacagcttcatcggccaccagctgggcggcgtggtggaggtgcccaacagcaaggaccagagagtgaagagcgccagagccatccagatcacctactacctgcagacctacggcagcgccacccaggacctgatcggcgagaagtgggagaacgagttctgcaagctgatcagaaagctgcaggaggagcaccaggagctgcagctgtacagcctggccagcttcagcctgtggagagacttccacaagaccagcatcctggccagaagcaaggtgctggtgagcctggtgctgatcctgaccaccgccaccctgagcagcagcatgaaggactgcctgagaagcaagcccttcctgggcctgctgggcgtgctgaccgtgtgcatcagcatcatcaccgccgccggcatcttcttcatcaccgacggcaagtacaacagcaccctgctgggcatccccttcttcgccatgggcatcagcaccgagttcaccagcagctag

SEQ ID NO: 17363 - DNA, 885 bp, Artificial Sequence
  Description of Artificial Sequence: Synthetic coding sequence
atgctgagacaggtgctgagaagaggcctgcagagcttctgccacagactgggcctgtgcgtgagcagacaccccgtgttcttcctgaccgtgcccgccgtgctgaccatcaccttcggcctgagcgccctgaacagattccagcccgagggcgacctggagagactggtggcccccagccacagcctggccaagatcgagagaagcctggccagcagcctgttccccctggaccagagcaagagccagctgtacagcgacctgcacacccccggcagatacggcagagtgatcctgctgagccccaccggcgacaacatcctgctgcaggccgagggcatcctgcagacccacagagccgtgctggagatgaaggacggcagaaacagcttcatcggccaccagctgggcggcgtggtggaggtgcccaacagcaaggaccagagagtgaagagcgccagagccatccagatcacctactacctgcagacctacggcagcgccacccaggacctgatcggcgagaagtgggagaacgagttctgcaagctgatcagaaagctgcaggaggagcaccaggagctgcagctgtacagcctggccagcttcagcctgtggagagacttccacaagaccagcatcctggccagaagcaaggtgctggtgagcctggtgctgatcctgaccaccgccaccctgagcagcagcatgaaggactgcctgagaagcaagcccttcctgggcctgctgggcgtgctgaccgtgtgcatcagcatcatcaccgccgccggcatcttcttcatcaccgacggcaagtacaacagcaccctgctgggcatccccttcttcgccatgggcatcagcaccgagttcaccagcagctag

SEQ ID NO: 17364 - DNA, 339 bp, Artificial Sequence
  Description of Artificial Sequence: Synthetic coding sequence
atgcaggacaccggcagcgtggtgcccctgcactggttcggcttcggctacgccgccctggtggccagcggcggcatcatcggctacgtgaaggccggcagcgtgcccagcctggccgccggcctgctgttcggcagcctggccggcctgggcgcctaccagctgagccaggaccccagaaacgtgtgggtgttcctggccaccagcggcaccctggccggcatcatgggcatgagattctaccacagcggcaagttcatgcccgccggcctgatcgccggcgccagcctgctgatggtggccaaggtgggcgtgagcatgttcaacagaccccactag

SEQ ID NO: 17365 - DNA, 294 bp, Artificial Sequence
  Description of Artificial Sequence: Synthetic coding sequence
atgagcagcgcccccgagccccccaccttcaagaaggagccccccaaggagaaggagttccagagccccggcctgagaggcgtgagaaccaccaccctgttcagagccgtgaaccccgagctgttcatcaagcccaacaagcccgtgatggccttcggcctggtgaccctgagcctgtgcgtggcctacatcggctacctgcacgccatccaggagaacaagaaggacctgtacgaggccatcgacagcgagggccacagctacatgagaagaaagaccagcaagtgggactag

SEQ ID NO: 17366 - DNA, 2844 bp, Artificial Sequence
  Description of Artificial Sequence: Synthetic coding sequence
atgagccagccccccatcggcggcgccgcccccgccaccgccgccgccagccccgccgccgccgccaccgaggccagactgcaccccgagggcagcagcagaaagcagcagagagcccagagccccgccagacccagagacagcagcctgagacagaccatcgccgccaccagaagccccgtgggcgccggcaccaagctgaacagcgtgagacagcagcagctgcagcagcagcagcagcagggcaacaagaccggcagcagaaccggcccccccgccagcatcagaggcggcggcggcggcgccgagaaggccacccccctggcccccaagggcgccgcccccggcgccgtgcagcccgtggccggcgccgaggccgcccccgccgccaccctggccgccctgggcggcagaagacccggcccccccgaggagccccccagagagctggagagcgtgcccagcaagctgggcgagcccccccccctgggcgagggcggcggcggcggcggcgagggcggcggcgccggcggcggcagcggcgagagagagggcggcgccccccagccccccccccccagaggctggagaggcaagggcgtgagagcccagcagagaggcggcagcggcggcgagggcgccagccccagccccagcagcagcagcgccggcaagacccccggcaccggcagcagaaacagcggcagcggcgtggccggcggcggcagcggcggcggcggcagctactggaaggagggctgcctgcagagcgagctgatccagttccacctgaagaaggagagagccgccgccgccgccgccgccgcccagatgcacgccaagaacggcggcggcagcagcagcagaagcagccccgtgagcggcccccccgccgtgtgcgagaccctggccgtggccagcgccagccccatggccgccgccgccgagggcccccagcagagcgccgagggcagcgccagcggcggcggcatgcaggccgccgccccccccagcagccagccccacccccagcagctgcaggagcaggaggagatgcaggaggagatggagaagctgagagaggagaacgagaccctgaagaacgagatcgacgagctgagaaccgagatggacgagatgagagacaccttcttcgaggaggacgcctgccagctgcaggagatgagacacgagctggagagagccaacaagaactgcagaatcctgcagtacagactgagaaaggccgagagaaagagactgagatacgcccagaccggcgagatcgacggcgagctgctgagaagcctggagcaggacctgaaggtggccaaggacgtgagcgtgagactgcaccacgagctggagaacgtggaggagaagagaaccaccaccgaggacgagaacgagaagctgagacagcagctgatcgaggtggagatcgccaagcaggccctgcagaacgagctggagaagatgaaggagctgagcctgaagagaagaggcagcaaggacctgcccaagagcgagaagaaggcccagcagacccccaccgaggaggacaacgaggacctgaagtgccagctgcagttcgtgaaggaggaggccgccctgatgagaaagaagatggccaagatcgacaaggagaaggacagattcgagcacgagctgcagaagtacagaagcttctacggcgacctggacagccccctgcccaagggcgaggccggcggcccccccagcaccagagaggccgagctgaagctgagactgagactggtggaggaggaggccaacatcctgggcagaaagatcgtggagctggaggtggagaacagaggcctgaaggccgagctggacgacctgagaggcgacgacttcaacggcagcgccaaccccctgatgagagagcagagcgagagcctgagcgagctgagacagcacctgcagctggtggaggacgagaccgagctgctgagaagaaacgtggccgacctggaggagcagaacaagagaatcaccgccgagctgaacaagtacaagtacaagagcggcggccacgacagcgccagacaccacgacaacgccaagaccgaggccctgcaggaggagctgaaggccgccagactgcagatcaacgagctgagcggcaaggtgatgcagctgcagtacgagaacagagtgctgatgagcaacatgcagagatacgacctggccagccacctgggcatcagaggcagccccagagacagcgacgccgagagcgacgccggcaagaaggagagcgacgacgacagcagacccccccacagaaagagagagggccccatcggcggcgagagcgacagcgaggaggtgagaaacatcagatgcctgacccccaccagaagcttctaccccgcccccggcccctggcccaagagcttcagcgacagacagcagatgaaggacatcagaagcgaggccgagagactgggcaagaccatcgacagactgatcgccgacaccagcaccatcatcaccgaggccagaatctacgtggccaacggcgacctgttcggcctgatggacgaggaggacgacggcagcagaatcagagagcacgagctgctgtacagaatcaacgcccagatgaaggccttcagaaaggagctgcagaccttcatcgacagactggaggtgcccaagagcgccgacgacagaggcgccgaggagcccatcagcgtgagccagatgttccagcccatcatcctgctgatcctgatcctggtgctgttcagcagcctgagctacaccaccatcttcaagctggtgttcctgttcaccctgttcttcgtgctgtag

SEQ ID NO: 17367 - DNA, 33 bp, Artificial Sequence
  Description of Artificial Sequence: Synthetic coding sequence
atgagccagccccccatcggcggcgccgcctag

SEQ ID NO: 17368 - DNA, 2844 bp, Artificial Sequence; identical to SEQ ID NO: 17366
  Description of Artificial Sequence: Synthetic coding sequence

SEQ ID NO: 17369 - DNA, 2844 bp, Artificial Sequence; identical to SEQ ID NO: 17366
  Description of Artificial Sequence: Synthetic coding sequence

SEQ ID NO: 17370 - DNA, 387 bp, Artificial Sequence
  Description of Artificial Sequence: Synthetic coding sequence
atggccctgcaggtgagagtggcccccagcaaggtggtgctgcagaagttcctgctgtgcgtgatcctgttctacaccgtgtactacgtgagcctgagcatgggctgcgtgatgttcgaggtgcacgagctgaacgtgctggcccccttcgacttcaagaccaaccccagctggctgaacatcaactacaaggtgctgctggtgagcaccgaggtgacctacttcgtgtgcggcctgttcttcgtgcccgtggtggaggagtgggtgtgggactacgccatcagcgtgaccatcctgcacgtggccatcaccagcaccgtgatgctggagttccccctgaccagccactggtgggccgccctgggcatcagcaagctgctggtgtag

SEQ ID NO: 17371 - DNA, 387 bp, Artificial Sequence; identical to SEQ ID NO: 17370
  Description of Artificial Sequence: Synthetic coding sequence

SEQ ID NO: 17372 - DNA, 723 bp, Artificial Sequence
  Description of Artificial Sequence: Synthetic coding sequence
atggccatggccagcgtgaagctgctggccggcgtgctgagaaagcccgacgcctggatcggcctgtggggcgtgctgagaggcacccccagcagctacaagctgtgcaccagctggaacagatacctgtacttcagcagcaccaagctgagagcccccaactacaagaccctgttctacaacatcttcagcctgagactgcccggcctgctgctgagccccgagtgcatcttccccttcagcgtgagactgaagagcaacatcagaagcaccaagagcaccaagaagagcctgcagaaggtggacgaggaggacagcgacgaggagagccaccacgacgagatgagcgagcaggaggaggagctggaggacgaccccaccgtggtgaagaactacaaggacctggagaaggccgtgcagagcttcagatacgacgtggtgctgaagaccggcctggacatcggcagaaacaaggtggaggacgccttctacaagggcgagctgagactgaacgaggagaagctgtggaagaagagcagaaccgtgaaggtgggcgacaccctggacctgctgatcggcgaggacaaggaggccggcaccgagaccgtgatgagaatcctgctgaagaaggtgttcgaggagaagaccgagagcgagaagtacagagtggtgctgagaagatggaagagcctgaagctgcccaagaagagaatgagcaagtag

SEQ ID NO: 17373 - DNA, 723 bp, Artificial Sequence; identical to SEQ ID NO: 17372
  Description of Artificial Sequence: Synthetic coding sequence

SEQ ID NO: 17374 - DNA, 738 bp, Artificial Sequence
  Description of Artificial Sequence: Synthetic coding sequence
atgatcatcagcgccatggccatggccagcgtgaagctgctggccggcgtgctgagaaagcccgacgcctggatcggcctgtggggcgtgctgagaggcacccccagcagctacaagctgtgcaccagctggaacagatacctgtacttcagcagcaccaagctgagagcccccaactacaagaccctgttctacaacatcttcagcctgagactgcccggcctgctgctgagccccgagtgcatcttccccttcagcgtgagactgaagagcaacatcagaagcaccaagagcaccaagaagagcctgcagaaggtggacgaggaggacagcgacgaggagagccaccacgacgagatgagcgagcaggaggaggagctggaggacgaccccaccgtggtgaagaactacaaggacctggagaaggccgtgcagagcttcagatacgacgtggtgctgaagaccggcctggacatcggcagaaacaaggtggaggacgccttctacaagggcgagctgagactgaacgaggagaagctgtggaagaagagcagaaccgtgaaggtgggcgacaccctggacctgctgatcggcgaggacaaggaggccggcaccgagaccgtgatgagaatcctgctgaagaaggtgttcgaggagaagaccgagagcgagaagtacagagtggtgctgagaagatggaagagcctgaagctgcccaagaagagaatgagcaagtag

SEQ ID NO: 17375 - DNA, 582 bp, Artificial Sequence
  Description of Artificial Sequence: Synthetic coding sequence
atggccgtgttcctgcagctgctgcccctgctgctgagcagagcccagggcaaccccggcgccagcctggacggcagacccggcgacagagtgaacctgagctgcggcggcgtgagccaccccatcagatgggtgtgggcccccagcttccccgcctgcaagggcctgagcaagggcagaagacccatcctgtgggccagcagcagcggcacccccaccgtgccccccctgcagcccttcgtgggcagactgagaagcctggacagcggcatcagaagactggagctgctgctgagcgccggcgacagcggcaccttcttctgcaagggcagacacgaggacgagagcagaaccgtgctgcacgtgctgggcgacagaacctactgcaaggcccccggccccacccacgccctgagccccccccacagcagcacctgcgagaacagagcccccgaggccagcaagggcggcagagcccaggacagcagaggccccggccccggcaccgagcccgccctgtgcggcagcggccccagcagcccccagcaggccccccccgccgtgcacagcggcccctgctag

SEQ ID NO: 17376 - DNA, 654 bp, Artificial Sequence
  Description of Artificial Sequence: Synthetic coding sequence
atggccgtgttcctgcagctgctgcccctgctgctgagcagagcccagggcaaccccggcgccagcctggacggcagacccggcgacagagtgaacctgagctgcggcggcgtgagccaccccatcagatgggtgtgggcccccagcttccccgcctgcaagggcctgagcaagggcagaagacccatcctgtgggccagcagcagcggcacccccaccgtgccccccctgcagcccttcgtgggcagactgagaagcctggacagcggcatcagaagactggagctgctgctgagcgccggcgacagcggcaccttcttctgcaagggcagacacgaggacgagagcagaaccgtgctgcacgtgctgggcgacagaacctactgcaaggcccccggccccacccacggcgcctgccccagaaacagattcgaccacagcctggacctgctgtgccccccccacatcgcccccctggtgaagaccgagccccagagacccgtgaaggaggaggagcccaagatccccggcgacctggaccaggagcccagcctgctgtacgccgacctggaccacctggccctgagcagacccagaagactgagcaccgccgaccccgccgacgccagcaccatctacgccgtggtggtgtag

SEQ ID NO: 17377 - DNA, 726 bp, Artificial Sequence
  Description of Artificial Sequence: Synthetic coding sequence
atggccgtgttcctgcagctgctgcccctgctgctgagcagagcccagggcaaccccggcgccagcctggacggcagacccggcgacagagtgaacctgagctgcggcggcgtgagccaccccatcagatgggtgtgggcccccagcttccccgcctgcaagggcctgagcaagggcagaagacccatcctgtgggccagcagcagcggcacccccaccgtgccccccctgcagcccttcgtgggcagactgagaagcctggacagcggcatcagaagactggagctgctgctgagcgccggcgacagcggcaccttcttctgcaagggcagacacgaggacgagagcagaaccgtgctgcacgtgctgggcgacagaacctactgcaaggcccccggccccacccacggcagcgtgtacccccagctgctgatccccctgctgggcgccggcctggtgctgggcctgggcgccctgggcctggtgtggtggctgcacagaagactgcccccccagcccatcagacccctgcccagattcgcccccctggtgaagaccgagccccagagacccgtgaaggaggaggagcccaagatccccggcgacctggaccaggagcccagcctgctgtacgccgacctggaccacctggccctgagcagacccagaagactgagcaccgccgaccccgccgacgccagcaccatctacgccgtggtggtgtag

SEQ ID NO: 17378 - DNA, 714 bp, Artificial Sequence
  Description of Artificial Sequence: Synthetic coding sequence
atggccgtgttcctgcagctgctgcccctgctgctgagcagagcccagggcaaccccggcgccagcctggacggcagacccggcgacagagtgaacctgagctgcggcggcgtgagccaccccatcagatgggtgtgggcccccagcttccccgcctgcaagggcctgagcaagggcagaagacccatcctgtgggccagcagcagcggcacccccaccgtgccccccctgcagcccttcgtgggcagactgagaagcctggacagcggcatcagaagactggagctgctgctgagcgccggcgacagcggcaccttcttctgcaagggcagacacgaggacgagagcagaaccgtgctgcacgtgctgggcgacagaacctactgcaaggcccccggccccacccacggcagcgtgtacccccagctgctgatccccctgctgggcgccggcctggtgctgggcctgggcgccctgggcctggtgtggtggctgcacagaagactgcccccccagcccatcagacccctgcccagattcgccctgagccccccccacagcagcacctgcgagaacagagcccccgaggccagcaagggcggcagagcccaggacagcagaggccccggccccggcaccgagcccgccctgtgcggcagcggccccagcagcccccagcaggccccccccgccgtgcacagcggcccctgctag

SEQ ID NO: 17379 - DNA, 669 bp, Artificial Sequence
  Description of Artificial Sequence: Synthetic coding sequence
atggccgtgttcctgcagctgctgcccctgctgctgagcagagcccagggcaaccccggcgccagcctggacggcagacccggcgacagagtgaacctgagctgcggcggcgtgagccaccccatcagatgggtgtgggcccccagcttccccgcctgcaagggcctgagcaagggcagaagacccatcctgtgggccagcagcagcggcacccccaccgtgccccccctgcagcccttcgtgggcagactgagaagcctggacagcggcatcagaagactggagctgctgctgagcgccggcgacagcggcaccttcttctgcaagggcagacacgaggacgagagcagaaccgtgctgcacgtgctgggcgacagaacctactgcaaggcccccggccccacccacggcagcgtgtacccccagctgctgatccccctgctgggcgccggcctggtgctgggcctgggcgccctgggcctggtgtggtggctgcacagaagactgcccccccagcccatcagacccctgcccagattcgccctgagccccccccacagcagcacctgcgagaacagagcccccgaggccagcaagggcggcagagcccaggacagcagaggccccggccccggcaccggcaagggcatgggcatgggcagaggctag

SEQ ID NO: 17380 - DNA, 594 bp, Artificial Sequence
  Description of Artificial Sequence: Synthetic coding sequence
atggccgtgttcctgcagctgctgcccctgctgctgagcagagcccagggcaaccccggcgccagcctggacggcagacccggcgacagagtgaacctgagctgcggcggcgtgagccaccccatcagatgggtgtgggcccccagcttccccgcctgcaagggcctgagcaagggcagaagacccatcctgtgggccagcagcagcggcacccccaccgtgccccccctgcagcccttcgtgggcagactgagaagcctggacagcggcatcagaagactggagctgctgctgagcgccggcgacagcggcaccttcttctgcaagggcagacacgaggacgagagcagaaccgtgctgcacgtgctgggcgacagaacctactgcaaggcccccggccccacccacgcccccctggtgaagaccgagccccagagacccgtgaaggaggaggagcccaagatccccggcgacctggaccaggagcccagcctgctgtacgccgacctggaccacctggccctgagcagacccagaagactgagcaccgccgaccccgccgacgccagcaccatctacgccgtggtggtgtag

SEQ ID NO: 17381 - DNA, 594 bp, Artificial Sequence; identical to SEQ ID NO: 17380
  Description of Artificial Sequence: Synthetic coding sequence

SEQ ID NO: 17382 - DNA, 654 bp, Artificial Sequence; identical to SEQ ID NO: 17376
  Description of Artificial Sequence: Synthetic coding sequence

SEQ ID NO: 17383 - DNA, 714 bp, Artificial Sequence; identical to SEQ ID NO: 17378
  Description of Artificial Sequence: Synthetic coding sequence

SEQ ID NO: 17384 - DNA, 582 bp, Artificial Sequence; identical to SEQ ID NO: 17375
  Description of Artificial Sequence: Synthetic coding sequence

SEQ ID NO: 17385 - DNA, 726 bp, Artificial Sequence; identical to SEQ ID NO: 17377
  Description of Artificial Sequence: Synthetic coding sequence

SEQ ID NO: 17386 - DNA, 726 bp, Artificial Sequence; identical to SEQ ID NO: 17377
  Description of Artificial Sequence: Synthetic coding sequence

SEQ ID NO: 17387 - DNA, 594 bp, Artificial Sequence; identical to SEQ ID NO: 17380
  Description of Artificial Sequence: Synthetic coding sequence

SEQ ID NO: 17388 - DNA, 582 bp, Artificial Sequence; identical to SEQ ID NO: 17375
  Description of Artificial Sequence: Synthetic coding sequence

SEQ ID NO: 17389 - DNA, 654 bp, Artificial Sequence; identical to SEQ ID NO: 17376
  Description of Artificial Sequence: Synthetic coding sequence

SEQ ID NO: 17390 - DNA, 582 bp, Artificial Sequence; identical to SEQ ID NO: 17375
  Description of Artificial Sequence: Synthetic coding sequence

SEQ ID NO: 17391 - DNA, 714 bp, Artificial Sequence; identical to SEQ ID NO: 17378
  Description of Artificial Sequence: Synthetic coding sequence

SEQ ID NO: 17392 - DNA, 714 bp, Artificial Sequence; identical to SEQ ID NO: 17378
  Description of Artificial Sequence: Synthetic coding sequence

SEQ ID NO: 17393 - DNA, 594 bp, Artificial Sequence; identical to SEQ ID NO: 17380
  Description of Artificial Sequence: Synthetic coding sequence

SEQ ID NO: 17394 - DNA, 654 bp, Artificial Sequence; identical to SEQ ID NO: 17376
  Description of Artificial Sequence: Synthetic coding sequence

SEQ ID NO: 17395 - DNA, 726 bp, Artificial Sequence; identical to SEQ ID NO: 17377
  Description of Artificial Sequence: Synthetic coding sequence

SEQ ID NO: 17396 - DNA, 582 bp, Artificial Sequence; identical to SEQ ID NO: 17375
  Description of Artificial Sequence: Synthetic coding sequence

SEQ ID NO: 17397 - DNA, 582 bp, Artificial Sequence; identical to SEQ ID NO: 17375
  Description of Artificial Sequence: Synthetic coding sequence

SEQ ID NO: 17398 - DNA, 714 bp, Artificial Sequence; identical to SEQ ID NO: 17378
  Description of Artificial Sequence: Synthetic coding sequence

SEQ ID NO: 17399 - DNA, 654 bp, Artificial Sequence; identical to SEQ ID NO: 17376
  Description of Artificial Sequence: Synthetic coding sequence

SEQ ID NO: 17400 - DNA, 726 bp, Artificial Sequence; identical to SEQ ID NO: 17377
  Description of Artificial Sequence: Synthetic coding sequence

SEQ ID NO: 17401 - DNA, 594 bp, Artificial Sequence; identical to SEQ ID NO: 17380
  Description of Artificial Sequence: Synthetic coding sequence

SEQ ID NO: 17402 - DNA, 714 bp, Artificial Sequence; identical to SEQ ID NO: 17378
  Description of Artificial Sequence: Synthetic coding sequence

SEQ ID NO: 17403 - DNA, 594 bp, Artificial Sequence; identical to SEQ ID NO: 17380
  Description of Artificial Sequence: Synthetic coding sequence

SEQ ID NO: 17404 - DNA, 654 bp, Artificial Sequence; identical to SEQ ID NO: 17376
  Description of Artificial Sequence: Synthetic coding sequence

SEQ ID NO: 17405 - DNA, 726 bp, Artificial Sequence; identical to SEQ ID NO: 17377
  Description of Artificial Sequence: Synthetic coding sequence

SEQ ID NO: 17406 - DNA, 981 bp, Artificial Sequence
  Description of Artificial Sequence: Synthetic coding sequence
atggagttcctgtgggacttcctgaaccaccaggagggccccagaatcagagaccacctgagccacggcgagatcaacctgcacgagttcagcaaggagaccaccaaccagctgctggccttcagcctggtgctgctgctgagattcgtggacgactgcctgctgagcgtgttcaaggagaagagcgccgtggagctgctgatcagcctggccgagggctacagcagcagatgccaccccgtgttccagctgaagaagcaggtgctgagctgcgaggagagcatcagagtgtgggccctgctgcccttccccgaggagctgaccagacaggccgtgagactggaggacaacagcgagaccaacgcctgccacagcctgatcaccaagatgaccgacgagctgtaccaccacatgcccgagaacagatgcgtgctgaaggacctggacagactgcccaccgagacctggccccagctgctgagagagctgtgcagcacccccgtgcccaccctgttctgccccagaatcgtgctggaggtgctggtggtgctgagaagcatcagcgagcagtgcagaagagtgagcagccaggtgaccgtggccagcgagctgagacacagacagtgggtggagagaaccctgagaagcagacagagacagaactacctgagaatgtggagcagcatcagactgctgagccccgtgctgagcctgatcctgctgctgatcgccctggagctggtgaacatccacgccgtgtgcggcaagaacgcccacgagtaccagcagtacctgaagttcgtgaagagcatcctgcagtacaccgagaacctggtggcctacaccagctacgagaagaacaagtggaacgagaccatcaacctgacccacaccgccctgctgaagatgtggaccttcagcgagaagaagcagatgctgatccacctggccaagaagagcaccagcaaggtgctgctgtag

SEQ ID NO: 17407 - DNA, 1896 bp, Artificial Sequence
  Description of Artificial Sequence: Synthetic coding sequence
atggaggtgctgatcggcgaccccatcaccacctgcctgagccccagcgtgtacgacatcatctgcaacctgggcttccagctgagagagaactgcgacatcaacagcatcgtgacccagaacggcgaggtgtgctggaagaccatcaccgactgcgtgagctacaccgagagcgagcagggcctggactactggggcagcgtgagactgctgggccccgtgtgcgaggccgtgcacagccacttcctgagcctgaccaagggccagttcgagatcagatacgccccctggttccagtggaccagcttccccgagctgttccccgagatcttcgacgccctggagagcctgcagagccccgccatcagcctgagcctgatgaagctgaccagctgcctggagagagccctgggcgacgtgttcctgctgatcggcaaggagtgccccttcctgctgagagacctgctgagcagcgaggagctggcccaggtgttcagccagagcgtgatgaacgtgctgaaggtgttcgtgggcagcccctgcggcctgaacctgagaaacgtgctgtggcacggcttcgccagccccgaggagatcccccccaagtactgcagcatgatgatcctgctgaccgccggcctgggccagctgctgaagagctacctgcagaacaccaagctgaccctggcccacagaagcttcatcagcctgaccaacctggaggacctgatcgtgttccccgacgtgacctacgaggtgctgagcgtgctggaggaggtgatgatgaagagcgccttcatcctgaagatcatgctgccctactgggaggtggccctggtgaagttcaagagccacagattcgccgactgcgccatcctgctgctgacccagctggagaccggcctgagaaacgtgttcgccaccctgaacagatgccccaagagactgctgaccgccgagagcaccgccctgtacaccaccttcgaccagatcctggccaagcacctgaacgacggcaagatcaaccagctgcccctgttcctgggcgagcccgccatggagttcctgtgggacttcctgaaccaccaggagggccccagaatcagagaccacctgagccacggcgagatcaacctgcacgagttcagcaaggagaccaccaaccagctgctggccttcagcctggtgctgctgctgagattcgtggacgactgcctgctgagcgtgttcaaggagaagagcgccgtggagctgctgatcagcctggccgagggctacagcagcagatgccaccccgtgttccagctgaagaagcaggtgctgagctgcgaggagagcatcagagtgtgggccctgctgcccttccccgaggagctgaccagacaggccgtgagactggaggacaacagcgagaccaacgcctgccacagcctgatcaccaagatgaccgacgagctgtaccaccacatgcccgagaacagatgcgtgctgaaggacctggacagactgcccaccgagacccccaccagcgacacccccctggccctggcccccagaaagccccagccctgcagatgcagaagaagagtgagacccagcatcagactgctgagccccgtgctgagcctgatcctgctgctgatcgccctggagctggtgaacatccacgccgtgtgcggcaagaacgcccacgagtaccagcagtacctgaagttcgtgaagagcatcctgcagtacaccgagaacctggtggcctacaccagctacgagaagaacaagtggaacgagaccatcaacctgacccacaccgccctgctgaagatgtggaccttcagcgagaagaagcagatgctgatccacctggccaagaagagcaccagcaaggtgctgctgtag

SEQ ID NO: 17408 - DNA, 2037 bp, Artificial Sequence
  Description of Artificial Sequence: Synthetic coding sequence
atggaggtgctgatcggcgaccccatcaccacctgcctgagccccagcgtgtacgacatcatctgcaacctgggcttccagctgagagagaactgcgacatcaacagcatcgtgacccagaacggcgaggtgtgctggaagaccatcaccgactgcgtgagctacaccgagagcgagcagggcctggactactggggcagcgtgagactgctgggccccgtgtgcgaggccgtgcacagccacttcctgagcctgaccaagggccagttcgagatcagatacgccccctggttccagtggaccagcttccccgagctgttccccgagatcttcgacgccctggagagcctgcagagccccgccatcagcctgagcctgatgaagctgaccagctgcctggagagagccctgggcgacgtgttcctgctgatcggcaaggagtgccccttcctgctgagagacctgctgagcagcgaggagctggcccaggtgttcagccagagcgtgatgaacgtgctgaaggtgttcgtgggcagcccctgcggcctgaacctgagaaacgtgctgtggcacggcttcgccagccccgaggagatcccccccaagtactgcagcatgatgatcctgctgaccgccggcctgggccagctgctgaagagctacctgcagaacaccaagctgaccctggcccacagaagcttcatcagcctgaccaacctggaggacctgatcgtgttccccgacgtgacctacgaggtgctgagcgtgctggaggaggtgatgatgaagagcgccttcatcctgaagatcatgctgccctactgggaggtggccctggtgaagttcaagagccacagattcgccgactgcgccatcctgctgctgacccagctggagaccggcctgagaaacgtgttcgccaccctgaacagatgccccaagagactgctgaccgccgagagcaccgccctgtacaccaccttcgaccagatcctggccaagcacctgaacgacggcaagatcaaccagctgcccctgttcctgggcgagcccgccatggagttcctgtgggacttcctgaaccaccaggagggccccagaatcagagaccacctgagccacggcgagatcaacctgcacgagttcagcaaggagaccaccaaccagctgctggccttcagcctggtgctgctgctgagattcgtggacgactgcctgctgagcgtgttcaaggagaagagcgccgtggagctgctgatcagcctggccgagggctacagcagcagatgccaccccgtgttccagctgaagaagcaggtgctgagctgcgaggagagcatcagagtgtgggccctgctgcccttccccgaggagctgaccagacaggccgtgagactggaggacaacagcgagaccaacgcctgccacagcctgatcaccaagatgaccgacgagctgtaccaccacatgcccgagaacagatgcgtgctgaaggacctggacagactgcccaccgagacctggccccagctgctgagagagctgtgcagcacccccgtgcccaccctgttctgccccagaatcgtgctggaggtgctggtggtgctgagaagcatcagcgagcagtgcagaagagtgagcagccaggtgaccgtggccagcgagctgagacacagacagtgggtggagagaaccctgagaagcagacagagacagaactacctgagaatgtggagcagcatcagactgctgagccccgtgctgagcctgatcctgctgctgatcgccctggagctggtgaacatccacgccgtgtgcggcaagaacgcccacgagtaccagcagtacctgaagttcgtgaagagcatcctgcagtacaccgagaacctggtggcctacaccagctacgagaagaacaagtggaacgagaccatcaacctgacccacaccgccctgctgaagatgtggaccttcagcgagaagaagcagatgctgatccacctggccaagaagagcaccagcaaggtgctgctgtag

SEQ ID NO: 17409 - DNA, 1659 bp, Artificial Sequence
  Description of Artificial Sequence: Synthetic coding sequence
atgaagctgaccagctgcctggagagagccctgggcgacgtgttcctgctgatcggcaaggagtgccccttcctgctgagagacctgctgagcagcgaggagctggcccaggtgttcagccagagcgtgatgaacgtgctgaaggtgttcgtgggcagcccctgcggcctgaacctgagaaacgtgctgtggcacggcttcgccagccccgaggagatcccccccaagtactgcagcatgatgatcctgctgaccgccggcctgggccagctgctgaagagctacctgcagaacaccaagctgaccctggcccacagaagcttcatcagcctgaccaacctggaggacctgatcgtgttccccgacgtgacctacgaggtgctgagcgtgctggaggaggtgatgatgaagagcgccttcatcctgaagatcatgctgccctactgggaggtggccctggtgaagttcaagagccacagattcgccgactgcgccatcctgctgctgacccagctggagaccggcctgagaaacgtgttcgccaccctgaacagatgccccaagagactgctgaccgccgagagcaccgccctgtacaccaccttcgaccagatcctggccaagcacctgaacgacggcaagatcaaccagctgcccctgttcctgggcgagcccgccatggagttcctgtgggacttcctgaaccaccaggagggccccagaatcagagaccacctgagccacggcgagatcaacctgcacgagttcagcaaggagaccaccaaccagctgctggccttcagcctggtgctgctgctgagattcgtggacgactgcctgctgagcgtgttcaaggagaagagcgccgtggagctgctgatcagcctggccgagggctacagcagcagatgccaccccgtgttccagctgaagaagcaggtgctgagctgcgaggagagcatcagagtgtgggccctgctgcccttccccgaggagctgaccagacaggccgtgagactggaggacaacagcgagaccaacgcctgccacagcctgatcaccaagatgaccgacgagctgtaccaccacatgcccgagaacagatgcgtgctgaaggacctggacagactgcccaccgagacctggccccagctgctgagagagctgtgcagcacccccgtgcccaccctgttctgccccagaatcgtgctggaggtgctggtggtgctgagaagcatcagcgagcagtgcagaagagtgagcagccaggtgaccgtggccagcgagctgagacacagacagtgggtggagagaaccctgagaagcagacagagacagaactacctgagaatgtggagcagcatcagactgctgagccccgtgctgagcctgatcctgctgctgatcgccctggagctggtgaacatccacgccgtgtgcggcaagaacgcccacgagtaccagcagtacctgaagttcgtgaagagcatcctgcagtacaccgagaacctggtggcctacaccagctacgagaagaacaagtggaacgagaccatcaacctgacccacaccgccctgctgaagatgtggaccttcagcgagaagaagcagatgctgatccacctggccaagaagagcaccagcaaggtgctgctgtag

SEQ ID NO: 17410 - DNA, 1818 bp, Artificial Sequence
  Description of Artificial Sequence: Synthetic coding sequence
atggaggtgctgatcggcgaccccatcaccacctgcctgagccccagcgtgtacgacatcatctgcaacctgggcttccagctgagagagaactgcgacatcaacagcatcgtgacccagaacggcgaggtgtgctggaagaccatcaccgactgcgtgagctacaccgagagcgagcagggcctggactactggggcagcgtgagactgctgggccccgtgtgcgaggccgtgcacagccacttcctgagcctgaccaagggccagttcgagatcagatacgccccctggttccagtggaccagcttccccgagctgttccccgagatcttcgacgccctggagagcctgcagagccccgccatcagcctgagcctgatgaagctgaccagctgcctggagagagccctgggcgacgtgttcctgctgatcggcaaggagtgccccttcctgctgagagacctgctgagcagcgaggagctggcccaggtgttcagccagagcgtgatgaacgtgctgaaggtgttcgtgggcagcccctgcggcctgaacctgagaaacgtgctgtggcacggcttcgccagccccgaggagatcccccccaagtactgcagcatgatgatcctgctgaccgccggcctgggccagctgctgaagagctacctgcagaacaccaagctgaccctggcccacagaagcttcatcagcctgaccaacctggaggacctgatcgtgttccccgacgtgacctacgaggtgctgagcgtgctggaggaggtgatgatgaagagcgccttcatcctgaagatcatgctgccctactgggaggtggccctggtgaagttcaagagccacagattcgccgactgcgccatcctgctgctgacccagctggagaccggcctgagaaacgtgttcgccaccctgaacagatgccccaagagactgctgaccgccgagagcaccgccctgtacaccaccttcgaccagatcctggccaagcacctgaacgacggcaagatcaaccagctgcccctgttcctgggcgagcccgccatggagttcctgtgggacttcctgaaccaccaggagggccccagaatcagagaccacctgagccacggcgagatcaacctgcacgagttcagcaaggagaccaccaaccagctgctggccttcagcctggtgctgctgctgagattcgtggacgactgcctgctgagcgtgttcaaggagaagagcgccgtggagctgctgatcagcctggccgagggctacagcagcagatgccaccccgtgttccagctgaagaagcaggtgctgagctgcgaggagagcatcagagtgtgggccctgctgcccttccccgaggagctgaccagacaggccgtgagactggaggacaacagcgagaccaacgcctgccacagcctgatcaccaagatgaccgacgagctgtaccaccacatgcccgagaacagatgcgtgctgaaggacctggacagactgcccaccgagaccatcagactgctgagccccgtgctgagcctgatcctgctgctgatcgccctggagctggtgaacatccacgccgtgtgcggcaagaacgcccacgagtaccagcagtacctgaagttcgtgaagagcatcctgcagtacaccgagaacctggtggcctacaccagctacgagaagaacaagtggaacgagaccatcaacctgacccacaccgccctgctgaagatgtggaccttcagcgagaagaagcagatgctgatccacctggccaagaagagcaccagcaaggtgctgctgtag

SEQ ID NO: 17411 - DNA, 993 bp, Artificial Sequence
  Description of Artificial Sequence: Synthetic coding sequence
atggagggcgccccccccggcagcctggccctgagactgctgctgttcgtggccctgcccgccagcggctggctgaccaccggcgcccccgagcccccccccctgagcggcgccccccaggacggcatcagaatcaacgtgaccaccctgaaggacgacggcgacatcagcaagcagcaggtggtgctgaacatcacctacgagagcggccaggtgtacgtgaacgacctgcccgtgaacagcggcgtgaccagaatcagctgccagaccctgatcgtgaagaacgagaacctggagaacctggaggagaaggagtacttcggcatcgtgagcgtgagaatcctggtgcacgagtggcccatgaccagcggcagcagcctgcagctgatcgtgatccaggaggaggtggtggagatcgacggcaagcaggtgcagcagaaggacgtgaccgagatcgacatcctggtgaagaacagaggcgtgctgagacacagcaactacaccctgcccctggaggagagcatgctgtacagcatcagcagagacagcgacatcctgttcaccctgcccaacctgagcaagaaggagagcgtgagcagcctgcagaccaccagccagtacctgatcagaaacgtggagaccaccgtggacgaggacgtgctgcccggcaagctgcccgagacccccctgagagccgagccccccagcagctacaaggtgatgtgccagtggatggagaagttcagaaaggacctgtgcagattctggagcaacgtgttccccgtgttcttccagttcctgaacatcatggtggtgggcatcaccggcgccgccgtggtgatcaccatcctgaaggtgttcttccccgtgagcgagtacaagggcatcctgcagctggacaaggtggacgtgatccccgtgaccgccatcaacctgtaccccgacggccccgagaagagagccgagaacctggaggacaagacctgcatctag

SEQ ID NO: 17412 - DNA, 396 bp, Artificial Sequence
  Description of Artificial Sequence: Synthetic coding sequence
atgaccagcggcagcagcctgcagctgatcgtgatccaggaggaggtggtggagatcgacggcaagcaggtgcagcagaaggacgtgaccgagatcgacatcctggtgaagaacagaggcgtgctgagacacagcaactacaccctgcccctggaggagagcatgctgtacagcatcagcagagacagcgacatcctgttcaccctgcccaacctgagcaagaaggagagcgtgagcagcctgcagaccaccagccagtacctgatcagaaacgtggagaccaccgtggacgaggacgtgctgcccggcaagctgcccgagacccccctgagagccgagccccccagcagctacaaggtgctggagaccgtggacagcgcccccttcagactgtag

SEQ ID NO: 17413 - DNA, 378 bp, Artificial Sequence
  Description of Artificial Sequence: Synthetic coding sequence
ctgcagctgatcgtgatccaggaggaggtggtggagatcgacggcaagcaggtgcagcagaaggacgtgaccgagatcgacatcctggtgaagaacagaggcgtgctgagacacagcaactacaccctgcccctggaggagagcatgctgtacagcatcagcagagacagcgacatcctgttcaccctgcccaacctgagcaagaaggagagcgtgagcagcctgcagaccaccagccagtacctgatcagaaacgtggagaccaccgtggacgaggacgtgctgcccggcaagctgcccgagacccccctgagagccgagccccccagcagctacaaggtgctggagaccgtggacagcgcccccttcagactgtag

SEQ ID NO: 17414 - DNA, 1065 bp, Artificial Sequence
  Description of Artificial Sequence: Synthetic coding sequence
atggacttcatcctggaggacatggacctggccgccaacgagatcagcatctacgacaagctgagcgagaccgtggacctggtgagacagaccggccaccagtgcggcatgagcgagaaggccatcgagaagttcatcagacagctgctggagaagaacgagccccagagaccccccccccagtaccccctgctgatcgtggtgtacaaggtgctggccaccctgggcctgatcctgctgaccgcctacttcgtgatccagcccttcagccccctggcccccgagcccgtgctgagcggcgcccacacctggagaagcctgatccaccacatcagactgatgagcctgcccatcgccaagaagtacatgagcgagaacaagggcgtgcccctgcacggcggcgacgaggacagacccttccccgacttcgacccctggtggaccaacgactgcgagcagaacgagagcgagcccatccccgccaactgcaccggctgcgcccagaagcacctgaaggtgatgctgctggaggacgcccccagaaagttcgagagactgcaccccctggtgatcaagaccggcaagcccctgctggaggaggagatccagcacttcctgtgccagtaccccgaggccaccgagggcttcagcgagggcttcttcgccaagtggtggagatgcttccccgagagatggttccccttcccctacccctggagaagacccctgaacagaagccagatgctgagagagctgttccccgtgttcacccacctgcccttccccaaggacgccagcctgaacaagtgcagcttcctgcaccccgagcccgtggtgggcagcaagatgcacaagatgcccgacctgttcatcatcggcagcggcgaggccatgctgcagctgatcccccccttccagtgcagaagacactgccagagcgtggccatgcccatcgagcccggcgacatcggctacgtggacaccacccactggaaggtgtacgtgatcgccagaggcgtgcagcccctggtgatctgcgacggcaccgccttcagcgagctgtag

SEQ ID NO: 17415 - DNA, 726 bp, Artificial Sequence
  Description of Artificial Sequence: Synthetic coding sequence
atgagcctgcccatcgccaagaagtacatgagcgagaacaagggcgtgcccctgcacggcggcgacgaggacagacccttccccgacttcgacccctggtggaccaacgactgcgagcagaacgagagcgagcccatccccgccaactgcaccggctgcgcccagaagcacctgaaggtgatgctgctggaggacgcccccagaaagttcgagagactgcaccccctggtgatcaagaccggcaagcccctgctggaggaggagatccagcacttcctgtgccagtaccccgaggccaccgagggcttcagcgagggcttcttcgccaagtggtggagatgcttccccgagagatggttccccttcccctacccctggagaagacccctgaacagaagccagatgctgagagagctgttccccgtgttcacccacctgcccttccccaaggacgccagcctgaacaagtgcagcttcctgcaccccgagcccgtggtgggcagcaagatgcacaagatgcccgacctgttcatcatcggcagcggcgaggccatgctgcagctgatcccccccttccagtgcagaagacactgccagagcgtggccatgcccatcgagcccggcgacatcggctacgtggacaccacccactggaaggtgtacgtgatcgccagaggcgtgcagcccctggtgatctgcgacggcaccgccttcagcgagctgtag

SEQ ID NO: 17416 - DNA, 1044 bp, Artificial Sequence
  Description of Artificial Sequence: Synthetic coding sequence
atggacctggccgccaacgagatcagcatctacgacaagctgagcgagaccgtggacctggtgagacagaccggccaccagtgcggcatgagcgagaaggccatcgagaagttcatcagacagctgctggagaagaacgagccccagagaccccccccccagtaccccctgctgatcgtggtgtacaaggtgctggccaccctgggcctgatcctgctgaccgcctacttcgtgatccagcccttcagccccctggcccccgagcccgtgctgagcggcgcccacacctggagaagcctgatccaccacatcagactgatgagcctgcccatcgccaagaagtacatgagcgagaacaagggcgtgcccctgcacggcggcgacgaggacagacccttccccgacttcgacccctggtggaccaacgactgcgagcagaacgagagcgagcccatccccgccaactgcaccggctgcgcccagaagcacctgaaggtgatgctgctggaggacgcccccagaaagttcgagagactgcaccccctggtgatcaagaccggcaagcccctgctggaggaggagatccagcacttcctgtgccagtaccccgaggccaccgagggcttcagcgagggcttcttcgccaagtggtggagatgcttccccgagagatggttccccttcccctacccctggagaagacccctgaacagaagccagatgctgagagagctgttccccgtgttcacccacctgcccttccccaaggacgccagcctgaacaagtgcagcttcctgcaccccgagcccgtggtgggcagcaagatgcacaagatgcccgacctgttcatcatcggcagcggcgaggccatgctgcagctgatcccccccttccagtgcagaagacactgccagagcgtggccatgcccatcgagcccggcgacatcggctacgtggacaccacccactggaaggtgtacgtgatcgccagaggcgtgcagcccctggtgatctgcgacggcaccgccttcagcgagctgtag

SEQ ID NO: 17417 - DNA, 708 bp, Artificial Sequence
  Description of Artificial Sequence: Synthetic coding sequence
atggacttcatcctggaggacatggacctggccgccaacgagatcagcatctacgacaagctgagcgagaccgtggacctggtgagacagaccggccaccagtgcggcatgagcgagaaggccatcgagaagttcatcagacagctgctggagaagaacgagccccagagaccccccccccagtaccccctgctgatcgtggtgtacaaggtgctggccaccctgggcctgatcctgctgaccgcctacttcgtgatccagcccttcagccccctggcccccgagcccgtgctgagcggcgcccacacctggagaagcctgatccaccacatcagactgatgagcctgcccatcgccaagaagtacatgagcgagaacaagggcgtgcccctgcacggcggcgacgaggacagacccttccccgacttcgacccctggtggaccaacgactgcgagcagaacgagagcgagcccatccccgccaactgcaccggctgcgcccagaagcacctgaaggtgatgctgctggaggacgcccccagaaagttcgagagactgcaccccctggtgatcaaggagatcgagctgtgcaccggcaccgccagcagagccgagaaccaggtggagagaggcaagatcaagaccaagaccatgaagctgctgagcggcggctggctgctgagctacctgcccttcgcctgcatgtag

SEQ ID NO: 17418 - DNA, 726 bp, Artificial Sequence; identical to SEQ ID NO: 17415
  Description of Artificial Sequence: Synthetic coding sequence

SEQ ID NO: 17419 - DNA, 705 bp, Artificial Sequence
  Description of Artificial Sequence: Synthetic coding sequence
gacttcatcctggaggacatggacctggccgccaacgagatcagcatctacgacaagctgagcgagaccgtggacctggtgagacagaccggccaccagtgcggcatgagcgagaaggccatcgagaagttcatcagacagctgctggagaagaacgagccccagagaccccccccccagtaccccctgctgatcgtggtgtacaaggtgctggccaccctgggcctgatcctgctgaccgcctacttcgtgatccagcccttcagccccctggcccccgagcccgtgctgagcggcgcccacacctggagaagcctgatccaccacatcagactgatgagcctgcccatcgccaagaagtacatgagcgagaacaagggcgtgcccctgcacggcggcgacgaggacagacccttccccgacttcgacccctggtggaccaacgactgcgagcagaacgagagcgagcccatccccgccaactgcaccggctgcgcccagaagcacctgaaggtgatgctgctggaggacgcccccagaaagttcgagagactgcaccccctggtgatcaaggagatcgagctgtgcaccggcaccgccagcagagccgagaaccaggtggagagaggcaagatcaagaccaagaccatgaagctgctgagcggcggctggctgctgagctacctgcccttcgcctgcatgtag

SEQ ID NO: 17420 - DNA, 651 bp, Artificial Sequence
  Description of Artificial Sequence: Synthetic coding sequence
atgctggccagccccgccagacccaccctgagaatgctggccaaccacgccctgagcaccccccactgcgcctgcagccccgcccccgcccccagaaccgccagcgccagcagaagaagatgcgtgcccgtggaggccagagccgccggcgtgttcggcgacagactggccggcgtgttcggcagcagaggcctgaagcacggcggcgtgcaggcccccagacccagagtggtgagagccgagcccagagccggcttcgccgtggtgagaagccccagaagactgtgcggcagaagccacgccccccagccccccgcccacctgggcctgggccccggctgcttccccgccgtggccgtggtggtgcccgtgcccggcagcagagcccacagacccttcgccgccctgctggtggagggcagcttcctgggcgacccccccatcccccccagaagaagcggcgtgctggccagaggcagcgccggcgccgactgcctggccagcagcgtgacccccggccccagcctgtggatccccctgctgctggtggccggctgcgtgagctgcttcgtgggcctggccgtgtgcgtgtggatgcaggccagagtgagccccgcctggcccgccggcctgttcctgctgcccagatag

SEQ ID NO: 17421 - DNA, 357 bp, Artificial Sequence
  Description of Artificial Sequence: Synthetic coding sequence
atggaggacttcgccaccagaacctacggcaccagcggcctggacaacagacccctgttcggcgagaccagcgccaaggacagaatcatcaacctggtggtgggcagcctgaccagcctgctgatcctggtgaccctgatcagcgccttcgtgttcccccagctgccccccaagcccctgaacatcttcttcgccgtgtgcatcagcctgagcagcatcaccgcctgcatcctgatctactggtacagacagggcgacctggagcccaagttcagaaagctgatctactacatcatcttcagcatcatcatgctgtgcatctgcgccaacctgtacttccacgacgtgggcagatag

SEQ ID NO: 17422 - DNA, 357 bp, Artificial Sequence; identical to SEQ ID NO: 17421
  Description of Artificial Sequence: Synthetic coding sequence

SEQ ID NO: 17423 - DNA, 18 bp, Artificial Sequence
  Description of Artificial Sequence: Synthetic coding sequence
atggaggacttcgcctag

SEQ ID NO: 17424 - DNA, 705 bp, Artificial Sequence
  Description of Artificial Sequence: Synthetic coding sequence
atgggccccggcggcagagtggccagactgctggcccccctgatgtggagaagagccgtgagcagcgtggccggcagcgccgtgggcgccgagcccggcctgagactgctggccgtgcagagactgcccgtgggcgccgccttctgcagagcctgccagacccccaacttcgtgagaggcctgcacagcgagcccggcctggaggagagagccgagggcaccgtgaacgagggcagacccgagagcgacgccgccgaccacaccggccccaagttcgacatcgacatgatggtgagcctgctgagacaggagaacgccagagacatctgcgtgatccaggtgccccccgagatgagatacaccgactacttcgtgatcgtgagcggcaccagcaccagacacctgcacgccatggccttctacgtggtgaagatgtacaagcacctgaagtgcaagagagacccccacgtgaagatcgagggcaaggacaccgacgactggctgtgcgtggacttcggcagcatggtgatccacctgatgctgcccgagaccagagagatctacgagctggagaagctgtggaccctgagaagctacgacgaccagctggcccagatcgcccccgagaccgtgcccgaggacttcatcctgggcatcgaggacgacaccagcagcgtgacccccgtggagctgaagtgcgagtag

SEQ ID NO: 17425 - DNA, 945 bp, Artificial Sequence
  Description of Artificial Sequence: Synthetic coding sequence
atgttcagcatcaaccccctggagaacctgaaggtgtacatcagcagcagaccccccctggtggtgttcatgatcagcgtgagcgccatggccatcgccttcctgaccctgggctacttcttcaagatcaaggagatcaagagccccgagatggccgaggactggaacaccttcctgctgagattcaacgacctggacctgtgcgtgagcgagaacgagaccctgaagcacctgaccaacgacaccaccacccccgagagcaccatgaccagcggccaggccagagccagcacccagagcccccaggccctggaggacagcggccccgtgaacatcagcgtgagcatcaccctgaccctggaccccctgaagcccttcggcggctacagcagaaacgtgacccacctgtacagcaccatcctgggccaccagatcggcctgagcggcagagaggcccacgaggagatcaacatcaccttcaccctgcccaccgcctggagcagcgacgactgcgccctgcacggccactgcgagcaggtggtgttcaccgcctgcatgaccctgaccgccagccccggcgtgttccccgtgaccgtgcagcccccccactgcgtgcccgacacctacagcaacgccaccctgtggtacaagatcttcaccaccgccagagacgccaacaccaagtacgcccaggactacaaccccttctggtgctacaagggcgccatcggcaaggtgtaccacgccctgaaccccaagctgaccgtgatcgtgcccgacgacgacagaagcctgatcaacctgcacctgatgcacaccagctacttcctgttcgtgatggtgatcaccatgttctgctacgccgtgatcaagggcagacccagcaagctgagacagagcaaccccgagttctgccccgagaaggtggccctggccgaggcctag

SEQ ID NO: 17426 - DNA, 219 bp, Artificial Sequence
  Description of Artificial Sequence: Synthetic coding sequence
atgttcagcatcaaccccctggagaacctgaaggtgtacatcagcagcagaccccccctggtggtgttcatgatcagcgtgagcgccatggccatcgccttcctgaccctgggctacttcttcaagatcaaggagatcaagagccccgagatggccgaggactggaacaccttcctgctgagattcaacgacctggacctgtgcgtgagcgagaactag

SEQ ID NO: 17427 - DNA, 285 bp, Artificial Sequence
  Description of Artificial Sequence: Synthetic coding sequence
atgttcagcatcaaccccctggagaacctgaaggtgtacatcagcagcagaccccccctggtggtgttcatgatcagcgtgagcgccatggccatcgccttcctgaccctgggctacttcttcaagatcaaggagatcaagagccccgagatggccgaggactggaacaccttcctgctgagattcaacgacctggacctgtgcgtgagcgagaacgagaccctgaagcacctgaccaacgacaccaccacccccgagagcaccatgaccagcggccaggcctag

SEQ ID NO: 17428 - DNA, 420 bp, Artificial Sequence
  Description of Artificial Sequence: Synthetic coding sequence
atgttcagcatcaaccccctggagaacctgaaggtgtacatcagcagcagaccccccctggtggtgttcatgatcagcgtgagcgccatggccatcgccttcctgaccctgggctacttcttcaagatcaaggagatcaagagccccgagatggccgaggactggaacaccttcctgctgagattcaacgacctggacctgtgcgtgagcgagaacgagaccctgaagcacctgaccaacgacaccaccacccccgagagcaccatgaccagcggccaggccagagccagcacccagagcccccaggccctggaggacagcggccccgtgaacatcagcgtgagcatcaccctgaccctggaccccctgaagcccttcggcggctacagcagaaacgtgacccacctgtacagcacctag

SEQ ID NO: 17429 - DNA, 567 bp, Artificial Sequence
  Description of Artificial Sequence: Synthetic coding sequence
atggccctggccatgctggtgctggtggtgagcccctggagcgccgccagaggcgtgctgagaaactactgggagagactgctgagaaagctgccccagagcagacccggcttccccagccccccctggggccccgccctggccgtgcagggccccgccatgttcaccgagcccgccaacgacaccagcggcagcaaggagaacagcagcctgctggacagcatcttctggatggccgcccccaagaacagaagaaccatcgaggtgaacagatgcagaagaagaaacccccagaagctgatcaaggtgaagaacaacatcgacgtgtgccccgagtgcggccacctgaagcagaagcacgtgctgtgcgcctactgctacgagaaggtgtgcaaggagaccgccgagatcagaagacagatcggcaagcaggagggcggccccttcaaggcccccaccatcgagaccgtggtgctgtacaccggcgagacccccagcgagcaggaccagggcaagagaatcatcgagagagacagaaagagacccagctggttcacccagaactag

SEQ ID NO: 17430 - DNA, 441 bp, Artificial Sequence
  Description of Artificial Sequence: Synthetic coding sequence
atgatgtggcagaagtacgccggcagcagaagaagcatgcccctgggcgccagaatcctgttccacggcgtgttctacgccggcggcttcgccatcgtgtactacctgatccagaagttccacagcagagccctgtactacaagctggccgtggagcagctgcagagccaccccgaggcccaggaggccctgggcccccccctgaacatccactacctgaagctgatcgacagagagaacttcgtggacatcgtggacgccaagctgaagatccccgtgagcggcagcaagagcgagggcctgctgtacgtgcacagcagcagaggcggccccttccagagatggcacctggacgaggtgttcctggagctgaaggacggccagcagatccccgtgttcaagctgagcggcgagaacggcgacgaggtgaagaaggagtag

SEQ ID NO: 17431 - DNA, 441 bp, Artificial Sequence; identical to SEQ ID NO: 17430
  Description of Artificial Sequence: Synthetic coding sequence

SEQ ID NO: 17432 - DNA, 441 bp, Artificial Sequence; identical to SEQ ID NO: 17430
  Description of Artificial Sequence: Synthetic coding sequence

SEQ ID NO: 17433 - DNA, 441 bp, Artificial Sequence; identical to SEQ ID NO: 17430
  Description of Artificial Sequence: Synthetic coding sequence

SEQ ID NO: 17434 - DNA, 342 bp, Artificial Sequence
  Description of Artificial Sequence: Synthetic coding sequence
atgatgtggcagaagtacgccggcagcagaagaagcatgcccctgggcgccagaatcctgttccacggcgtgttctacgccggcggcttcgccatcgtgtactacctgatccagaagttccacagcagagccctgtactacaagctggccgtggagcagctgcagagccaccccgaggcccaggaggccctgggcccccccctgaacatccactacctgaagctgatcgacagagagaacttcgtggacatcgtggacgccaagctgaagatccccgtgagcggcagcaagagcgagggcctgctgtacgtgcacagcagcagaggcggccccttccagtag

SEQ ID NO: 17435 - DNA, 267 bp, Artificial Sequence
  Description of Artificial Sequence: Synthetic coding sequence
atgatgtggcagaagtacgccggcagcagaagaagcatgcccctgggcgccagaatcctgttccacggcgtgttctacgccggcggcttcgccatcgtgtactacctgatccagaagttccacagcagagccctgtactacaagctggccgtggagcagctgcagagccaccccgaggcccaggaggccctgggcccccccctgaacatccactacctgaagctgatcgacagagagaacttcgtggacatcgtggacgccaagtag

SEQ ID NO: 17436 - DNA, 441 bp, Artificial Sequence; identical to SEQ ID NO: 17430
  Description of Artificial Sequence: Synthetic coding sequence

SEQ ID NO: 17437 - DNA, 441 bp, Artificial Sequence; identical to SEQ ID NO: 17430
  Description of Artificial Sequence: Synthetic coding sequence

SEQ ID NO: 17438 - DNA, 441 bp, Artificial Sequence; identical to SEQ ID NO: 17430
  Description of Artificial Sequence: Synthetic coding sequence

SEQ ID NO: 17439 - DNA, 735 bp, Artificial Sequence
  Description of Artificial Sequence: Synthetic coding sequence
atgggcgacctgttcagcctgttctgggaggtggaccccccccccatccccgtgaactgcgccatccccaaccaggactacgagtgctggaaggacgacagctgcggcaccatcggcagcttcctgctgtggtacttcgtgatcgtgttcgtgctgatgttcttcagcagagccagcgtgtggatgagcgaggacaagaaggacgagggcagcggcaccagcaccagcgtgagaaaggccagcaaggagaccagctgcaagagacagagcaaggacagcgcctgggaccccagccagaccatgaagaagcccaagcagaaccagctgacccccgtgaccaacagcgaggtggccctggtgaacgcctaccccgagcagagaagagccagaagacagagccagttcaacgaggtgaaccagaaccagcacgacagcgacaccaccgagtacggcagcgaggagagcaacagcgaggccagcagctggaaggagagcgagagcgagcaccaccccagccccgacagcatcaagagaagaaagatggcccagagacagagaaacctgggcagctaccagatgagcgagagacactgcctgcactgcaaggccctgagaaccaacgagtggctggcccaccacagcagacagaagcccagcgtgaccccccccatgaagagagacagccaggaggagagcagcatcagcgacatcaacaagaagttcagcaagttctag

SEQ ID NO: 17440 - DNA, 396 bp, Artificial Sequence
  Description of Artificial Sequence: Synthetic coding sequence
atgacccacagcagccaggacaccggcagctgcggcatccaggaggacggcaagctgtacgtggtggacagcatcaacgacctgaacaagctgaacctgtgccccgccggcagccagcacctgttccccctggaggacaagatccccgtgctgggcaccaacagcggcaacggcagcagaagcctgttcttcgtgggcctgctgatcgtgctgatcgtgagcctggccctggtgttcttcgtgatcttcctgatcgtgcagaccggcaacaagatggacgacgtgagcagaagactgaccgccgagggcaaggacatcgacgacctgaagagaatcaacaacatgatcgtgaagagactgaaccagctgaaccagctggacagcgagcagaactag

SEQ ID NO: 17441 - DNA, 180 bp, Artificial Sequence
  Description of Artificial Sequence: Synthetic coding sequence
atgacccacagcagccaggacaccggcagctgcggcatccaggaggacggcaagctgtacgtggtggacagcatcaacgacctgaacaagctgaacctgtgccccgccggcagccagcacctgttcctgctgagacagagcagcaagaacttccccaagagaagcaaggagatcgcctag

SEQ ID NO: 17442 - DNA, 396 bp, Artificial Sequence; identical to SEQ ID NO: 17440
  Description of Artificial Sequence: Synthetic coding sequence

SEQ ID NO: 17443 - DNA, 342 bp, Artificial Sequence
  Description of Artificial Sequence: Synthetic coding sequence
atggccgccctgggcagccccagccacaccttcagaggcctgctgagagagctgagatacctgagcgccgccaccggcagaccctacagagacaccgccgcctacagatacctggtgaaggccttcagagcccacagagtgaccagcgagaagctgtgcagagcccagcacgagctgcacttccaggccgccacctacctgtgcctgctgagaagcatcagaaagcacgtggccctgcaccaggagttccacggcaagggcgagagaagcgtggaggagagcgccggcctggtgggcctgaagctgccccaccagcccggcggcaagggctgggagccctag

SEQ ID NO: 17444 - DNA, 3081 bp, Artificial Sequence
  Description of Artificial Sequence: Synthetic coding sequence
atggtgtgcagacccgtgttcccctgcagaagaagattctgccccagacccttcctggtgggcctggtggtggccatctgcctgttctaccagaccctgaccctgagaggcagcagaaagctgaccgccgccgcccccggcgccgtgccccacaccagcaccgagacccaggccagcagatgcaagaagggcttcagccaggacaagcagtgcttcctgctgagcggcaacgcccaggagaccagaaaggtgaaggagagcatggagacccacttcggcagccacggcagaagagccatcctgtacagaccccccttctacagcaagaccgagctgcagctgcaccagcacatcctgacccagcacggctacaccgtggtgatcgccgaggagagactgaacgccggcctgggccccggcctgctggagcagggcgacctgggcagctgggacctgctgatctgcctgagcagcaagaaggccgagggcaccccctgcatcagcaaggaggtgatgtgccagctgggcctgcaccagaaggccaacagactgcccgagatccagcagcccctgtgcagaaaggagggcctgtgccagatcgtgagaagattccccgagctgcagctgcccgtgagccccagcgtgtgcctggaccagggcatgcagctgaagcccagcaccagcagccacctgctgaagaccgtgaagcccagagtgtggaagcccggcgactggagcagagagcagctgaacgagaccaccgtgctggccccccacgagaccatcttcagagccgaggacctgagcgtgatcctgaaggcctacgtgctggtgaccagcctgacccccctgagagccttcatccacagcaccggcaccgtgtggaacccccccaagaagaagagattcaccgtgaagctgcagaccttcttcgagaccttcctgagagccagcagcccccagcaggccttcgacatcatgaaggaggccatcggcaagctgctgctggccgccgaggtgttcagcgagaccagcaccctgggccccaagaccttccacagatgcagattctgcttccagctgctgaccttcgacatcggctacggcagcttcatgtaccccgtggtgctgcaggtgcacgagcacctgaacttccaggactacgacaacatggacttcgaggaccagaacaccgaggagttcctgctgaacgacaccttcaacttcctgttccccaacgagagcagcctgagcatcttcagcgagatcttccagagactgtacagaagcgacgtgttcaagggcgagaactaccagaaggagctgaaccagtgcctgagcctggaggagatcaacagcatcatgaccttcatcaaggagctgggcagcctgggccagttccagctgctgttccccagcaccacccccggcatccagagcctgatgcacgagttctacgacgtggccaaccccgtgggcaaccccggcagcgtgctgacccagtactggagcctgctgaacgtgttcgagcagttccagttcatgaacaagaagacccagccccaccccctggagtggaacagcttcaccgaggacaagaacatcgagaagccccaggtgcccttcgacgccatcgagaacaagaaggccgccgtgccccagatcaagaacgagaacaaggagatccactgcagcgacgacgagaacaccccctgccacatcaagcagatcttcacccacccccacctggagctgaaccccgacttccaccccaagatcaaggactactactgcgaggtgcccttcgacgtggtgaccgtgaccatcggcgtggagacccccaagtgcctgtgcaaggtgcacctgtacgagcaggccggccccagcttcgccagctaccccctgggcctgggcatgaacaagatcagcatcttcgtggtggacgagagccccgcccacggcgagaccctgatcacctacaagctgaccatctacagagaggacagacccagcctgcccctgttcgaggccttcaccgcctgcggcttcgtgcaggactgcggcctgctgatccaccccgaggagacctgcggcctgcagcccatcagcagcgactacatcgaggccatcctgcagagcgagctgaagagatgccccagcggcgacatgaagggccagtggatcgtgccctgcctgagctgcagcgacaacagaacctgcgactggagagagatcacctggcagccccacaactgccagtacggcgtgctgaccaagccccagctgcagcagtgcctgggcggcagaaagatcctgttcatcggcgacagcaccaacagaggcatcatgtactacctgatcgagagactgaacgagaccctgcaggagtggcagaaggtgcacggcaccaagttctaccacaacgtgaacggcggcaagaccctgatcagctacagctactacccccagttctggatcagccccagcctgagacccaccttcgagaacgccctggagcacctgctgcagagaagcagacccctggagaacaccggccagaccgtgctggtggtgggcggcgtgcagtggctgaacagcaaccacctgcagatcatccacaaggtgctgaagagagagaacctgctgaacatcctggtgatcatcaagaccctgggcatcggcttccacctgcccgtggacggcgtgcacttcctgacccagagcgaggtgcagaacctgtggaaggagaacctgatcatcctggacaccgccaagaagcacggctacgaggtggtggacaccttcaccatcaccatgggcagatacaaggagttcctgcagggcaagtgcggctgccacttccacgaggtggtgaagagcaagctgagcaaggagtacaacttcatcaagatgaagagaagcagaaaccacatcatgggcagatacttcagcaaccagagcaagctgcagcagggcaccgtgaccaacttcagaagcccctaccacgtgagaggccccatcaaccaggtgtgcagcgagatcctgctgagcagaatgtgcgccaacaagagaaccatgtag

SEQ ID NO: 17445 - DNA, 609 bp, Artificial Sequence
  Description of Artificial Sequence: Synthetic coding sequence
atggtgtgcagacccgtgttcccctgcagaagaagattctgccccagacccttcctggtgggcctggtggtggccatctgcctgttctaccagaccctgaccctgagaggcagcagaaagctgaccgccgccgcccccggcgccgtgccccacaccagcaccgagacccaggccagcagatgcaagaagggcttcagccaggacaagcagtgcttcctgctgagcggcaacgcccaggagaccagaaaggtgaaggagagcatggagacccacttcggcagccacggcagaagagccatcctgtacagaccccccttctacagcaagaccgagctgcagctgcaccagcacatcctgacccagcacggctacaccgtggtgatcgccgaggagagactgaacgccggcctgggccccggcctgctggagcagggcgacctgggcagctgggacctgctgatctgcctgagcagcaagaaggccgagggcaccccctgcatcagcaaggaggtgatgtgccagctgggcctgcaccagaagcagctgagaagaagagaggagagacagagacccggcagccccgccagcagaagactgagcgtgagatag

SEQ ID NO: 17446 - DNA, 1650 bp, Artificial Sequence
  Description of Artificial Sequence: Synthetic coding sequence
atggtgtgcagacccgtgttcccctgcagaagaagattctgccccagacccttcctggtgggcctggtggtggccatctgcctgttctaccagaccctgaccctgagaggcagcagaaagctgaccgccgccgcccccggcgccgtgccccacaccagcaccgagacccaggccagcagatgcaagaagggcttcagccaggacaagcagtgcttcctgctgagcggcaacgcccaggagaccagaaaggtgaaggagagcatggagacccacttcggcagccacggcagaagagccatcctgtacagaccccccttctacagcaagaccgagctgcagctgcaccagcacatcctgacccagcacggctacaccgtggtgatcgccgaggagagactgaacgccggcctgggccccggcctgctggagcagggcgacctgggcagctgggacctgctgatctgcctgagcagcaagaaggccgagggcaccccctgcatcagcaaggaggtgatgtgccagctgggcctgcaccagaaggccaacagactgcccgagatccagcagcccctgtgcagaaaggagggcctgtgccagatcgtgagaagattccccgagctgcagctgcccgtgagccccagcgtgtgcctggaccagggcatgcagctgaagcccagcaccagcagccacctgctgaagaccgtgaagcccagagtgtggaagcccggcgactggagcagagagcagctgaacgagaccaccgtgctggccccccacgagaccatcttcagagccgaggacctgagcgtgatcctgaaggcctacgtgctggtgaccagcctgacccccctgagagccttcatccacagcaccggcaccgtgtggaacccccccaagaagaagagattcaccgtgaagctgcagaccttcttcgagaccttcctgagagccagcagcccccagcaggccttcgacatcatgaaggaggccatcggcaagctgctgctggccgccgaggtgttcagcgagaccagcaccctgggccccaagaccttccacagatgcagattctgcttccagctgctgaccttcgacatcggctacggcagcttcatgtaccccgtggtgctgcaggtgcacgagcacctgaacttccaggactacgacaacatggacttcgaggaccagaacaccgaggagttcctgctgaacgacaccttcaacttcctgttccccaacgagagcagcctgagcatcttcagcgagatcttccagagactgtacagaagcgacgtgttcaagggcgagaactaccagaaggagctgaaccagtgcctgagcctggaggagatcaacagcatcatgaccttcatcaaggagctgggcagcctgggccagttccagctgctgttccccagcaccacccccggcatccagagcctgatgcacgagttctacgacgtggccaaccccgtgggcaaccccggcagcgtgctgacccagtactggagcctgctgaacgtgttcgagcagttccagttcatgaacaagaagacccagccccaccccctggagtggaacagcttcaccgaggacaagaacatcgagaagccccaggtgcccttcgacgccatcgagaacaagaagtag

SEQ ID NO: 17447 - DNA, 2352 bp, Artificial Sequence
  Description of Artificial Sequence: Synthetic coding sequence
atggtgtgcagacccgtgttcccctgcagaagaagattctgccccagacccttcctggtgggcctggtggtggccatctgcctgttctaccagaccctgaccctgagaggcagcagaaagctgaccgccgccgcccccggcgccgtgccccacaccagcaccgagacccaggccagcagatgcaagaagggcttcagccaggacaagcagtgcttcctgctgagcggcaacgcccaggagaccagaaaggtgaaggagagcatggagacccacttcggcagccacggcagaagagccatcctgtacagaccccccttctacagcaagaccgagctgcagctgcaccagcacatcctgacccagcacggctacaccgtggtgatcgccgaggagagactgaacgccggcctgggccccggcctgctggagcagggcgacctgggcagctgggacctgctgatctgcctgagcagcaagaaggccgagggcaccccctgcatcagcaaggaggtgatgtgccagctgggcctgcaccagaaggccaacagactgcccgagatccagcagcccctgtgcagaaaggagggcctgtgccagatcgtgagaagattccccgagctgcagctgcccgtgagccccagcgtgtgcctggaccagggcatgcagctgaagcccagcaccagcagccacctgctgaagaccgtgaagcccagagtgtggaagcccggcgactggagcagagagcagctgaacgagaccaccgtgctggccccccacgagaccatcttcagagccgaggacctgagcgtgatcctgaaggcctacgtgctggtgaccagcctgacccccctgagagccttcatccacagcaccggcaccgtgtggaacccccccaagaagaagagattcaccgtgaagctgcagaccttcttcgagaccttcctgagagccagcagcccccagcaggccttcgacatcatgaaggaggccatcggcaagctgctgctggccgccgaggtgttcagcgagaccagcaccctgggccccaagaccttccacagatgcagattctgcttccagctgctgaccttcgacatcggctacggcagcttcatgtaccccgtggtgctgcaggtgcacgagcacctgaacttccaggactacgacaacatggacttcgaggaccagaacaccgaggagttcctgctgaacgacaccttcaacttcctgttccccaacgagagcagcctgagcatcttcagcgagatcttccagagactgtacagaagcgacgtgttcaagggcgagaactaccagaaggagctgaaccagtgcctgagcctggaggagatcaacagcatcatgaccttcatcaaggagctgggcagcctgggccagttccagctgctgttccccagcaccacccccggcatccagagcctgatgcacgagttctacgacgtggccaaccccgtgggcaaccccggcagcgtgctgacccagtactggagcctgctgaacgtgttcgagcagttccagttcatgaacaagaagacccagccccaccccctggagtggaacagcttcaccgaggacaagaacatcgagaagccccaggtgcccttcgacgccatcgagaacaagaaggccgccgtgccccagatcaagaacgagaacaaggagatccactgcagcgacgacgagaacaccccctgccacatcaagcagatcttcacccacccccacctggagctgaaccccgacttccaccccaagatcaaggactactactgcgaggtgcccttcgacgtggtgaccgtgaccatcggcgtggagacccccaagtgcctgtgcaaggtgcacctgtacgagcaggccggccccagcttcgccagctaccccctgggcctgggcatgaacaagatcagcatcttcgtggtggacgagagccccgcccacggcgagaccctgatcacctacaagctgaccatctacagagaggacagacccagcctgcccctgttcgaggccttcaccgcctgcggcttcgtgcaggactgcggcctgctgatccaccccgaggagacctgcggcctgcagcccatcagcagcgactacatcgaggccatcctgcagagcgagctgaagagatgccccagcggcgacatgaagggccagtggatcgtgccctgcctgagctgcagcgacaacagaacctgcgactggagagagatcacctggcagccccacaactgccagtacggcgtgctgaccaagccccagctgcagcagtgcctgggcggcagaaagctgggcgtggacgtgcagagagtgcccagaagcagaaactag

SEQ ID NO: 17448 - DNA, 348 bp, Artificial Sequence
  Description of Artificial Sequence: Synthetic coding sequence
atgatggccgtgatgacccccagcgacggcctgagccagctgagcgtgccccacctgacccaccagagactgtggagcctgagctgcctggccatgctgttccaggccgtgctgatcctgagcgccccccagatgagctgcctgctgaagtgcttctacgccctggaccccctgcaccccgtgatgagcgaggagttcagcgcccagtacagacacatgatggaccagagatacagaaccagaatccacgagggctacatcagccaggtgaagggcgcctacctgagaatcgtgcacaagaagcccatcagctacgccaagagcttccccaaggagatgggcaactag

SEQ ID NO: 17449 - DNA, 300 bp, Artificial Sequence
  Description of Artificial Sequence: Synthetic coding sequence
atgggcgagtgcccccacctggtggacgtgagactgggccacagaagcctggccaccggccccgagcagagcgacatctgccacaccggcagcgaggccagatggaccaccacctggtacggcagcctgagcttcagcagacacaagtacaagatgctggccgacctgacccccggcgtggagatgagctgcagacactgggccagatggctgacccccgtgatccccgccctgtggaaggccgaggccggcggcctgcccgagctgagaagcagcagacccgcctggaccacctggtag

SEQ ID NO: 17450 - DNA, 324 bp, Artificial Sequence
  Description of Artificial Sequence: Synthetic coding sequence
atggccggcggctacggcgtgatgggcgacgacggcagcatcgactacaccgtgcacgaggcctggaacgaggccaccaacgtgtacctgatcgtgatcctggtgagcttcggcctgttcatgtacgccaagagaaacaagagaagaatcatgagaatcttcagcgtgccccccaccgaggagaccctgagcgagcccaacttctacgacaccatcagcaagatcagactgagacagcagctggagatgtacagcatcagcagaaagtacgactaccagcagccccagaaccaggccgacagcgtgcagctgagcctggagtag

SEQ ID NO: 17451 - DNA, 324 bp, Artificial Sequence; identical to SEQ ID NO: 17450
  Description of Artificial Sequence: Synthetic coding sequence

SEQ ID NO: 17452 - DNA, 324 bp, Artificial Sequence; identical to SEQ ID NO: 17450
  Description of Artificial Sequence: Synthetic coding sequence

SEQ ID NO: 17453 - DNA, 324 bp, Artificial Sequence; identical to SEQ ID NO: 17450
  Description of Artificial Sequence: Synthetic coding sequence

SEQ ID NO: 17454 - DNA, 324 bp, Artificial Sequence; identical to SEQ ID NO: 17450
  Description of Artificial Sequence: Synthetic coding sequence

SEQ ID NO: 17455 - DNA, 651 bp, Artificial Sequence
  Description of Artificial Sequence: Synthetic coding sequence
atgtggcccccctgcggcaccctgagaaccctggccctggccagaagcagaggcgccagagcctgcagcggcgacggcggcgtgagctacacccagggccagagccccgagcccagaaccagagagtacttctactacgtggaccaccagggccagctgttcctggacgacagcaagatgaagaacttcatcacctgcttcaaggacccccagttcctggtgaccttcttcagcagactgagacccaacagaagcggcagatacgaggccgccttccccttcctgagcccctgcggcagagagagaaacttcctgagatgcgaggacagacccgtggtgttcacccacctgctgaccgccgaccacggcccccccagactgagctactgcggcggcggcgaggccctggccgtgcccttcgagcccgccagactgctgcccctggccgccaacggcagactgtaccaccccgcccccgagagagccggcggcgtgggcctggtgagaagcgccctggccttcgagctgagcgcctgcttcgagtacggccccggcgcccccgccctgcccagccacgtgagatggcagggcagaagactggccctgaccatggacctggcccccctgctgctggccgccagaagcccctag

SEQ ID NO: 17456 - DNA, 261 bp, Artificial Sequence
  Description of Artificial Sequence: Synthetic coding sequence
atgggcagaaaggacgccgccaccatcaagctgcccgtggaccagtacagaaagcagatcggcaagcaggactacaagaagaccaagcccatcctgagagccaccaagctgaaggccgaggccaagaagaccgccatcggcatcaaggaggtgggcctggtgctggccgccatcctggccctgctgctggccttctacgccttcttctacctgagactgaccaccgacgtggaccccgacctggaccaggacgaggactag

SEQ ID NO: 17457 - DNA, 228 bp, Artificial Sequence
  Description of Artificial Sequence: Synthetic coding sequence
atgggcagaaaggacgccgccaccatcaagctgcccgtggaccagtacagaaagcagatcggcaagcaggactacaagaagaccaagcccatcctgagagccaccaagctgaaggccgaggccaagaagaccgccatcggcatcaaggaggtgggcctggtgctggccgccatcctggccctgctgctggccttctacgccttcttctacctgagactgaccacctag

SEQ ID NO: 17458 - DNA, 261 bp, Artificial Sequence; identical to SEQ ID NO: 17456
  Description of Artificial Sequence: Synthetic coding sequence

SEQ ID NO: 17459 - DNA, 261 bp, Artificial Sequence; identical to SEQ ID NO: 17456
  Description of Artificial Sequence: Synthetic coding sequence

SEQ ID NO: 17460 - DNA, 261 bp, Artificial Sequence; identical to SEQ ID NO: 17456
  Description of Artificial Sequence: Synthetic coding sequence

SEQ ID NO: 17461 - DNA, 261 bp, Artificial Sequence; identical to SEQ ID NO: 17456
  Description of Artificial Sequence: Synthetic coding sequence

SEQ ID NO: 17462 - DNA, 261 bp, Artificial Sequence; identical to SEQ ID NO: 17456
  Description of Artificial Sequence: Synthetic coding sequence

SEQ ID NO: 17463 - DNA, 261 bp, Artificial Sequence; identical to SEQ ID NO: 17456
  Description of Artificial Sequence: Synthetic coding sequence

SEQ ID NO: 17464 - DNA, 27 bp, Artificial Sequence
  Description of Artificial Sequence: Synthetic coding sequence
atgggcagaaaggacgccgccacctag

SEQ ID NO: 17465 - DNA, 261 bp, Artificial Sequence; identical to SEQ ID NO: 17456
  Description of Artificial Sequence: Synthetic coding sequence

SEQ ID NO: 17466 - DNA, 261 bp, Artificial Sequence; identical to SEQ ID NO: 17456
  Description of Artificial Sequence: Synthetic coding sequence

SEQ ID NO: 17467 - DNA, 384 bp, Artificial Sequence
  Description of Artificial Sequence: Synthetic coding sequence
atgaacttcatcctgttcatcttcatccccggcgtgttcagcctgaagagcagcaccctgaagcccaccatcgaggccctgcccaacgtgctgcccctgaacgaggacgtgaacaagcaggaggagaagaacgaggaccacacccccaactacgcccccgccaacgagaagaacggcaactactacaaggacatcaagcagtacgtgttcaccacccagaaccccaacggcaccgagagcgagatcagcgtgagagccaccaccgacctgaacttcgccctgaagaacgacaagaccgtgaacgccaccacctacgagaagagcaccatcgaggaggagaccaccaccagcgagcccagccacaagaacatccagagcatctag

SEQ ID NO: 17468 - DNA, 885 bp, Artificial Sequence
  Description of Artificial Sequence: Synthetic coding sequence
atgaacttcatcctgttcatcttcatccccggcgtgttcagcctgaagagcagcaccctgaagcccaccatcgaggccctgcccaacgtgctgcccctgaacgaggacgtgaacaagcaggaggagaagaacgaggaccacacccccaactacgcccccgccaacgagaagaacggcaactactacaaggacatcaagcagtacgtgttcaccacccagaaccccaacggcaccgagagcgagatcagcgtgagagccaccaccgacctgaacttcgccctgaagaacgacaagaccgtgaacgccaccacctacgagaagagcaccatcgaggaggagaccaccaccagcgagcccagccacaagaacatccagagaagcacccccaacgtgcccgccttctggaccatgctggccaaggccatcaacggcaccgccgtggtgatggacgacaaggaccagctgttccaccccatccccgagagcgacgtgaacgccacccagggcgagaaccagcccgacctggaggacctgaagatcaagatcatgctgggcatcagcctgatgaccctgctgctgttcgtggtgctgctggccttctgcagcgccaccctgtacaagctgagacacctgagctacaagagctgcgagagccagtacagcgtgaaccccgagctggccaccatgagctacttccaccccagcgagggcgtgagcgacaccagcttcagcaagagcgccgagagcagcaccttcctgggcaccaccagcagcgacatgagaagaagcggcaccagaaccagcgagagcaagatcatgaccgacatcatcagcatcggcagcgacaacgagatgcacgagaacgacgagagcgtgaccagatag

SEQ ID NO: 17469 - DNA, 798 bp, Artificial Sequence
  Description of Artificial Sequence: Synthetic coding sequence
atgaacttcatcctgttcatcttcatccccggcgtgttcagcctgaagagcagcaccctgaagcccaccatcgaggccctgcccaacgtgctgcccctgaacgaggacgtgaacaagcaggaggagaagaacgaggaccacacccccaactacgcccccgccaacgagaagaacggcaactactacaaggacatcaagcagtacgtgttcaccacccagaaccccaacggcaccgagagcgagatcagcgtgagagccaccaccgacctgaacttcgccctgaagaacggcagcacccccaacgtgcccgccttctggaccatgctggccaaggccatcaacggcaccgccgtggtgatggacgacaaggaccagctgttccaccccatccccgagagcgacgtgaacgccacccagggcgagaaccagcccgacctggaggacctgaagatcaagatcatgctgggcatcagcctgatgaccctgctgctgttcgtggtgctgctggccttctgcagcgccaccctgtacaagctgagacacctgagctacaagagctgcgagagccagtacagcgtgaaccccgagctggccaccatgagctacttccaccccagcgagggcgtgagcgacaccagcttcagcaagagcgccgagagcagcaccttcctgggcaccaccagcagcgacatgagaagaagcggcaccagaaccagcgagagcaagatcatgaccgacatcatcagcatcggcagcgacaacgagatgcacgagaacgacgagagcgtgaccagatag

SEQ ID NO: 17470 - DNA, 339 bp, Artificial Sequence
  Description of Artificial Sequence: Synthetic coding sequence
atgggcagcagactgagccagcccttcgagagctacatcaccgccccccccggcaccgccgccgcccccgccaagcccgccccccccgccacccccggcgcccccaccagccccgccgagcacagactgctgaagacctgctggagctgcagagtgctgagcggcctgggcctgatgggcgccggcggctacgtgtactgggtggccagaaagcccatgaagatgggctacccccccagcccctggaccatcacccagatggtgatcggcctgagcatcgccacctggggcatcgtggtgatggccgaccccaagggcaaggcctacagagtggtgtag

SEQ ID NO: 17471 - DNA, 1212 bp, Artificial Sequence
  Description of Artificial Sequence: Synthetic coding sequence
atgagcaccagcaccagccccgccgccatgctgctgagaagactgagaagactgagctggggcagcaccgccgtgcagctgttcatcctgaccgtggtgaccttcggcctgctggcccccctggcctgccacagactgctgcacagctacttctacctgagacactggcacctgaaccagatgagccaggagttcctgcagcagagcctgaaggagggcgaggccgccctgcactacttcgaggagctgcccagcgccaacggcagcgtgcccatcgtgtggcaggccacccccagaccctggctggtgatcaccatcatcaccgtggacagacagcccggcttccactacgtgctgcaggtggtgagccagttccacagactgctgcagcagtgcggcccccagtgcgagggccaccagctgttcctgtgcaacgtggagagaagcgtgagccacttcgacgccaagctgctgagcaagtacgtgcccgtggccaacagatacgagggcaccgaggacgactacggcgacgaccccagcaccaacagcttcgagaaggagaagcaggactacgtgtactgcctggagagcagcctgcagacctacaaccccgactacgtgctgatggtggaggacgacgccgtgcccgaggagcagatcttccccgtgctggagcacctgctgagagccagattcagcgagccccacctgagagacgccctgtacctgaagctgtaccaccccgagagactgcagcactacatcaaccccgagcccatgagaatcctggagtgggtgggcgtgggcatgctgctgggccccctgctgacctggatctacatgagattcgccagcagacccggcttcagctggcccgtgatgctgttcttcagcctgtacagcatgggcctggtggagctggtgggcagacactacttcctggagctgagaagactgagccccagcctgtacagcgtggtgcccgccagccagtgctgcacccccgccatgctgttccccgcccccgccgccagaagaaccctgacctacctgagccaggtgtactgccacaagggcttcggcaaggacatggccctgtacagcctgctgagagccaagggcgagagagcctacgtggtggagcccaacctggtgaagcacatcggcctgttcagcagcctgagatacaacttccaccccagcctgctgtag

SEQ ID NO: 17472 - DNA, 1212 bp, Artificial Sequence; identical to SEQ ID NO: 17471
  Description of Artificial Sequence: Synthetic coding sequence

SEQ ID NO: 17473 - DNA, 1212 bp, Artificial Sequence; identical to SEQ ID NO: 17471
  Description of Artificial Sequence: Synthetic coding sequence

SEQ ID NO: 17474 - DNA, 690 bp, Artificial Sequence
  Description of Artificial Sequence: Synthetic coding sequence
atggacagcctggacagaagctgccaggactggtgcgacagaaagcagcactggctggagatcggcccccccgacctggtggagagaaagggcagcctgaccctgagaagccaccacaagaagtacagcaagcccgtgctggtgtacagctggcacagagacagagaggccttccccaagggctacgacatcgagggccccgagaaggtgaagaagctgtgcaacagcacctacagaagactgggcaccgacgagagccccatctggaccagcgagacccacgagaagctgagccagatgtgcctgaacaccgagtgggtggagatgaagagcaaggccctgctgaacgaggagaccgtgagcagcggcatcatcgagagagtgaccggcctgcccgccaccggcttcggcgccgtgttccccagacacccccccgactggagcaagatgtgcgccctgaccacctacagcgaggactacgtgcccccctacgactaccagccccacgcctacccctgccaggacgactacagcatcgtgcacagaaagtgcagaagccagttcaccgacctgaacggcagcaagagattcggcatcaacacctggcacgacgagagcggcatctacgccaacagcgacgtgaagcagaagctgtaccccctgaccagcggccccatcgtgcccatctag

SEQ ID NO: 17475 - DNA, 1272 bp, Artificial Sequence
  Description of Artificial Sequence: Synthetic coding sequence
atggacagaggccagcccagcctggagcccgccgccgccgcccccagagccagcggcagatgcgtgatcgcccccgtgagagccgtgctgagactgagaagaagagtgtgcgtgctgagaaagagaagactgctgcagcccggcggcggccccgacgtgggcaccggcgcccccagacccggctgcagccccagagcccccagagccgacctggaccagcccaagttcttcaccttcgacagccccgccgagctgcccagcagaacccccagaaagaagagaagaagaagcagactggtgctgtaccccgagaccagcagaaagtacagacccagagtggagcacagaagcagagcccagagatgcctgctgctgctggtggccatcgtgggcttccaggtgctgaacgccatcgagaacctggacgacaacgcccagagatacgacctggacggcctggagaaggccctgcagagagccgtgttcggccagcccgccgccgtgagcagaatcgtggccctgatgagagactacctggccacccacgtgcacagcagacccctgctgctggccctgcacggccccagcggcgtgggcaagagccacgtgggcagactgctggccagacacttcagaagcgtgctggaggacagcgccctggtgctgcagtaccacgccagacaccactgccccgaggccagagccgcccaggactgcagagaggagctggccagaagagtggccgacgtggtggccagagccgaggccgaggagaagacccccctgctggtgctggacgacgtggagctgatgcccagacccctgctggacgagctgcacggcttcctgcagccccagagaagccaccacttccacaacgccatctacgtgctgctgagcggcgccggcggcgccgaggtgaccagattcgtgctgcagaacgccagcagagccctgcccctgagacccgacggcttcagaagcgccgaggccgccgccgcccaggccgaggaggacctgagagccagcctgctggccgtgctgagcagagagcaccccctgtggcaggccgccgccatcgtgcccttcctgctgctggacaagagagacgtggtgagctgcttcagagacgagatggccggcgagggcttcttccccgaccaggccagagccgagaacctggccgcccagctgagcttctacagagtggccggcagagagttcgccgtgaccggctgcaagcaggtggtggccaccgtgaacctgctgtag

SEQ ID NO: 17476 - DNA, 4941 bp, Artificial Sequence
  Description of Artificial Sequence: Synthetic coding sequence
atgtggcacggcaaccacgtgcagcccggcgccacccacagacccaaccagggcctggagatgctgcagggcctgggcatcggcatgaaggccttccacaacttcaactacttcctgttcttctacaacgtgctgctgggcctgggcgcctgcctgagcagactgctgatcagctgcctgctgggcatgtggctgatcgccagaatcgacagaaccatcatgcagagcggctacgagggcgccgacatgggcttcagcgcctggatcggcatgctgtacatggaccactaccacatcaaccccgtgctggtgagcttctgccacatcctgatcaccaaccacagagagaagaagctgcagcagagcaccaagtactggtgcctgaaccagagcgccgagagcctgagaatctgcgccatgagaggcggcgagaacagaccccccgccagagtgcagagcagcagcgaggagctggagctgagacaccagagcctggacgccttccccggcagaagactgcccggcagaggcatccagcccgccgccaagatgagcagcgtgggcaaggtgacccaggtgcccaacggcaaggcctaccagcagatcttccaggccgaggtgcagctggtgcacagcctggccgccaccagaaagagagccgccgagagaagcgtgaccctgaagagcggcagaatccccatgatgaagaaggtggagacccccgagggcgaggtgatgagccccagacagcagaagtggatgcacagcctgcccaacgactggatcatggagaaccccgtgctgcacagagagaaggagagagccaagagagagaaggccagagagagcgagaacaccatcgccgccagagaggtgagaggcctgatggacaccatcgtgcccgagaagatcagcaccagcaccttccagagacaggccgagcacaagagaaagagctacgagagcgccctggccagcttccaggaggagatcgcccaggtgggcaaggagatggagcccctgatcgtggacaccggcggcctgttcctgaagaagctgaccgagagcgacgaggagatgaacagactgttcctgaaggtggagaacgacaccaacctggaggactacaccatccaggccctgctggagctgtgggacaaggtggccggcagactgctgctgagaaagcaggagatcaaggagctggacgaggccctgcacagcctggagttcagcagaaccgacaagctgaagagcgtgctgaagaagtacgccgaggtgatcgagaagaccagctacctgatgagacccgaggtgtacagactgatcaacgaggaggccatggtgatgaactacgccctgctgggcaacagaaaggccctggcccagctgttcgtgaacctgatggagagcaccctgcagcaggagctggacagcagacacagatggcagggcctggtggacacctggaaggccctgaagaaggaggccctgctgcagagcttcagcgagttcatggccagcgagagcatccacaccccccccgccgtgaccaaggagctggaggtgatgctgaagacccagaacgtgctgcagcagagaagactgaagcacctgtgcaccatctgcgacctgctgccccccagctacagcaagacccagctgaccgagtggcacagcagcctgaacagcctgaacaaggagctggacacctaccacgtggactgcatgatgagaatcagactgctgtacgagaagacctggcaggagtgcctgatgcacgtgcagaactgcaagaagcagctgctggactggaaggccttcaccgaggaggaggccgagaccctggtgaaccagttcttcttccagatggtgggcgccctgcagggcaaggtggaggaggacctggagctgctggacaagagcttcgagaccctggccgaccagaccgagtggcagagcagccacctgttcaagtacttccaggaggtggtgcagctgtgggaggcccaccagagcgagctgctggtgcaggagctggagctggagaagagaatggagcagcacagacagaagcacagcctggagagccaggtgcaggaggcccacctggacagactgctggaccagctgagacagcagagcgacaaggagaccctggccttccacctggagaaggtgaaggactacctgaagaacatgaagagcagatacgagtgcttccacaccctgctgaccaaggaggtgatggagtaccccgccatcatgctgaaggagctgaacagctacagcagcgccctgagccagtacttcttcgtgagagagatcttcgagcagaacctggccggcgaggtgatcttcaagttcagacagcccgaggcccacgagaagcccagccagaagagagtgaagaagctgagaaagaagcagggcagcaaggaggacatgaccagaagcgaggagagcatcagcagcggcaccagcaccgccagaagcgtggaggaggtggaggaggagaacgaccaggagatggagagcttcatcaccgaggaggtgctgggccagcagaagaagagccccctgcacgccaagatggacgagagcaaggagggcagcatccagggcctggaggagatgcaggtggagagagagggcagcctgaaccccagcctgaacgaggagaacgtgaagggccagggcgagaagaaggaggagagcgaggaggaggacgagaaggaggaggaggaggaggaggagaagctggaggaggagaaggaggagaaggaggcccaggaggagcaggagagcctgagcgtgggcgaggaggaggacaaggaggagggcctggaggagatctactacgaggacatggagagcttcaccatcagcagcggcaacacctacttcgtgttcgtgcccctggaggaggagcactgcagaaagagccacagcaccttcagcgccatgttcatcaacgacaccagcagcgccaagttcatcgagcaggtgaccatccccagcagactgatcctggagatcaagaagcagctgttcagcgagggcggcaacttcagccccaaggagatcaacagcctgtgcagcagactggagaaggaggccgccagaatcgagctggtggagagcgtgatcatgctgaacatggagaagctggagaacgagtacctggaccaggccaacgacgtgatcaacaagttcgagagcaagttccacaacctgagcgtggacctgatcttcatcgagaagatccagagactgctgaccaacctgcaggtgaagatcaagtgccaggtggccaagagcaacagccagaccaacggcctgaacttcagcctgcagcagctgcagaacaagatcaagacctgccaggagagcagaggcgagaagaccaccgtgaccaccgaggagctgctgagcttcgtgcagacctggaaggagaagctgagccagagaatccagtacctgaactgcagcctggacagagtgagcatgaccgagctggtgttcaccaacaccatcctgaaggaccaggaggaggacagcgacatcctgaccagcagcgaggccctggaggaggaggccaagctggacgtggtgacccccgagagcttcacccagctgagcagagtgggcaagcccctgatcgaggaccccgccgtggacgtgatcagaaagctgctgcagctgcccaacaccaagtggcccacccaccactgcgacaaggaccccagccagaccggcttcaagagacacagatgccagcccgagaacagcggcaagaaggccgtgcccagcgccagcgccaccagcgccggcagcctgcagaccacccacccccccctgagccacagcttcaccccccaccccaagcccaacaagatggagagaaagtacagagtgctgggcgacaagcccccccccgccgccgaggacttcaagggcatcatcctgaccctgctgtgggagagcagcgagaacctgctgaccgtggccgaggagttctacagaaaggagaagagacccgtgaccagacccgactgcatgtgcgacaccttcgaccagtgcgccgagaacatcagcaagaagatcctggagtaccagagccaggccaacaagtaccacaacagctgcctgatcgagctgagaatccagatcagaagattcgaggagctgctgccccaggtgtgctggctggtgatggagaacttcaaggagcaccactggaagaagttcttcaccagcgtgaaggagatcagaggccagttcgaggagcagcagaagagactggagaagagaaaggacaagaacgcccagaagctgcacctgaacctgggccaccccgtgcacttccaggagatggagagcctgcacctgagcgaggaggagagacaggaggagctggacagcatgatcagaatgaacaaggagaagctggaggagtgcaccagaagaaacggccaggtgttcatcaccaacctggccaccttcaccgagaagttcctgctgcagctggacgaggtggtgaccatcgacgacgtgcaggtggccagaatggagccccccaagcagaagctgagcatgctgatcagaagaaagctggccggcctgagcctgaaggaggagagcgagaagcccctgatcgagagaggcagcagaaagtggcccggcatcaagcccaccgaggtgaccatccagaacaagatcctgctgcagcccaccagcagcatcagcaccaccaagaccaccctgggccacctggccgccgtggaggccagagacgccgtgtacctgaagtacctggccagcttcgaggaggagctgaagagaatccaggacgactgcaccagccagatcaaggaggcccagagatggaaggacagctggaagcagagcctgcacaccatccagggcctgtacgtgtag

SEQ ID NO: 17477 - DNA, 5106 bp, Artificial Sequence
  Description of Artificial Sequence: Synthetic coding sequence
atgagaggcggcgagaacagaccccccgccagagtgcagagcagcagcgaggagctggagctgagacaccagagcctggacgccttccccggcagaagactgcccggcagaggcatccagcccgccgccaagatgagcagcgtgggcaaggtgacccaggtgcccaacggcaaggcctaccagcagatcttccaggccgaggtgcagctggtgcacagcctggccgccaccagaaagagagccgccgagagaagcgtgaccctgaagagcggcagaatccccatgatgaagaaggtggagacccccgagggcgaggtgatgagccccagacagcagaagtggatgcacagcctgcccaacgactggatcatggagaaccccgtgctgcacagagagaaggagagagccaagagagagaaggccagagagagcgagaacaccatcgccgccagagaggtgagaggcctgatggacaccatcgtgcccgagaagatcagcaccagcaccttccagagacaggccgagcacaagagaaagagctacgagagcgccctggccagcttccaggaggagatcgcccaggtgggcaaggagatggagcccctgatcgtggacaccggcggcctgttcctgaagaagctgaccgagagcgacgaggagatgaacagactgttcctgaaggtggagaacgacaccaacctggaggactacaccatccaggccctgctggagctgtgggacaaggtggccggcagactgctgctgagaaagcaggagatcaaggagctggacgaggccctgcacagcctggagttcagcagaaccgacaagctgaagagcgtgctgaagaagtacgccgaggtgatcgagaagaccagctacctgatgagacccgaggtgtacagactgatcaacgaggaggccatggtgatgaactacgccctgctgggcaacagaaaggccctggcccagctgttcgtgaacctgatggagagcaccctgcagcaggagctggacagcagacacagatggcagggcctggtggacacctggaaggccctgaagaaggaggccctgctgcagagcttcagcgagttcatggccagcgagagcatccacaccccccccgccgtgaccaaggagctggaggtgatgctgaagacccagaacgtgctgcagcagagaagactgaagcacctgtgcaccatctgcgacctgctgccccccagctacagcaagacccagctgaccgagtggcacagcagcctgaacagcctgaacaaggagctggacacctaccacgtggactgcatgatgagaatcagactgctgtacgagaagacctggcaggagtgcctgatgcacgtgcagaactgcaagaagcagctgctggactggaaggccttcaccgaggaggaggccgagaccctggtgaaccagttcttcttccagatggtgggcgccctgcagggcaaggtggaggaggacctggagctgctggacaagagcttcgagaccctggccgaccagaccgagtggcagagcagccacctgttcaagtacttccaggaggtggtgcagctgtgggaggcccaccagagcgagctgctggtgcaggagctggagctggagaagagaatggagcagcacagacagaagcacagcctggagagccaggtgcaggaggcccacctggacagactgctggaccagctgagacagcagagcgacaaggagaccctggccttccacctggagaaggtgaaggactacctgaagaacatgaagagcagatacgagtgcttccacaccctgctgaccaaggaggtgatggagtaccccgccatcatgctgaaggagctgaacagctacagcagcgccctgagccagtacttcttcgtgagagagatcttcgagcagaacctggccggcgaggtgatcttcaagttcagacagcccgaggcccacgagaagcccagccagaagagagtgaagaagctgagaaagaagcagggcagcaaggaggacatgaccagaagcgaggagagcatcagcagcggcaccagcaccgccagaagcgtggaggaggtggaggaggagaacgaccaggagatggagagcttcatcaccgaggaggtgctgggccagcagaagaagagccccctgcacgccaagatggacgagagcaaggagggcagcatccagggcctggaggagatgcaggtggagagagagggcagcctgaaccccagcctgaacgaggagaacgtgaagggccagggcgagaagaaggaggagagcgaggaggaggacgagaaggaggaggaggaggaggaggagaagctggaggaggagaaggaggagaaggaggcccaggaggagcaggagagcctgagcgtgggcgaggaggaggacaaggaggagggcctggaggagatctactacgaggacatggagagcttcaccatcagcagcggcaacacctacttcgtgttcgtgcccctggaggaggagcactgcagaaagagccacagcaccttcagcgccatgttcatcaacgacaccagcagcgccaagttcatcgagcaggtgaccatccccagcagactgatcctggagatcaagaagcagctgagagccggcttcttcgagcacctggagaagtggttcgaccagtgcagcctgaacaccagagtgaccgtggccaccaagatcaacgagctggacagcgagctggagctgcacctgcacctgcaccagcccagagcccagcagatcgagaaggacatccacaacgtgagagccgccgagctgctgctgcaccaggagcagctggacagccactgcgccggcgtgaccgagaccctgaagaagaagagactgatgttctgccagttccaggaggagcagaacgtgagaagcaagaacttcagactgaagatctacgacatggagcacatcttcctgaacgccaccagaagccagaagctggtgaccctgagcaacaccctgcaccaggagctgctgagctacgtggacgtgacccaggtgagcctgagaagcttcagacagtacctggaggagagcctgggcaagctgagatacagcaacatcgagttcatcaagcactgcagactgttcagcgagggcggcaacttcagccccaaggagatcaacagcctgtgcagcagactggagaaggaggccgccagaatcgagctggtggagagcgtgatcatgctgaacatggagaagctggagaacgagtacctggaccaggccaacgacgtgatcaacaagttcgagagcaagttccacaacctgagcgtggacctgatcttcatcgagaagatccagagactgctgaccaacctgcaggtgaagatcaagtgccaggtggccaagagcaacagccagaccaacggcctgaacttcagcctgcagcagctgcagaacaagatcaagacctgccaggagagcagaggcgagaagaccaccgtgaccaccgaggagctgctgagcttcgtgcagacctggaaggagaagctgagccagagaatccagtacctgaactgcagcctggacagagtgagcatgaccgagctggtgttcaccaacaccatcctgaaggaccaggaggaggacagcgacatcctgaccagcagcgaggccctggaggaggaggccaagctggacgtggtgacccccgagagcttcacccagctgagcagagtgggcaagcccctgatcgaggaccccgccgtggacgtgatcagaaagctgctgcagctgcccaacaccaagtggcccacccaccactgcgacaaggaccccagccagaccggcagaggcgcctgggcctgcggcagcagaggcagcagcgaggccggcgccggcggcgccgtgtgcagcccccccgtgctgtgcagctgccccggccccagcagccccaagggcttcaagagacacagatgccagcccgagaacagcggcaagaaggccgtgcccagcgccagcgccaccagcgccggcagcttcaccccccaccccaagcccaacaagatggagagaaagtacagagtgctgggcgacaagcccccccccgccgccgaggacttcaagggcatcatcctgaccctgctgtgggagagcagcgagaacctgctgaccgtggccgaggagttctacagaaaggagaagagacccgtgaccagacccgactgcatgtgcgacaccttcgaccagtgcgccgagaacatcagcaagaagatcctggagtaccagagccaggccaacaagtaccacaacagctgcctgatcgagctgagaatccagatcagaagattcgaggagctgctgccccaggtgtgctggctggtgatggagaacttcaaggagcaccactggaagaagttcttcaccagcgtgaaggagatcagaggccagttcgaggagcagcagaagagactggagaagagaaaggacaagaacgcccagaagctgcacctgaacctgggccaccccgtgcacttccaggagatggagagcctgcacctgagcgaggaggagagacaggaggagctggacagcatgatcagaatgaacaaggagaagctggaggagtgcaccagaagaaacggccaggtgttcatcaccaacctggccaccttcaccgagaagttcctgctgcagctggacgaggtggtgaccatcgacgacgtgcaggtggccagaatggagccccccaagcagaagctgagcatgctgatcagaagaaagctggccggcctgagcctgaaggaggagagcgagaagcccctgatcgagagaggcagcagaaagtggcccggcatcaagcccaccgaggtgaccatccagaacaagatcctgctgcagcccaccagcagcatcagcaccaccaagaccaccctgggccacctggccgccgtggaggccagagacgccgtgtacctgaagtacctggccagcttcgaggaggagctgaagagaatccaggacgactgcaccagccagatcaaggaggcccagagatggaaggacagctggaagcagagcctgcacaccatccagggcctgtacgtgtag

SEQ ID NO: 17478 - DNA, 663 bp, Artificial Sequence
  Description of Artificial Sequence: Synthetic coding sequence
atgtggcacggcaaccacgtgcagcccggcgccacccacagacccaaccagggcctggagatgctgcagggcctgggcatcggcatcctgaccatcagcatcgtggtgggcctgatgatcctgcagatgtgcatcgccgccagcttcttcctgcagcccaagctgggcaccgccgacaagcagaagcccctggccctgaacaacagaaaggccttccacaacttcaactacttcctgttcttctacaacgtgctgctgggcctgggcgcctgcctgagcagactgctgatcagctgcctgctgggcatgtggctgatcgccagaatcgacagaaccatcatgcagagcggctacgagggcgccgacatgggcttcagcgcctggatcggcatgctgtacatggaccactaccacatcaaccccgtgctggtgagcttctgccacatcctgatcaccaaccacagagagaagaagctgcagcagagcaccaagtactggtgcctgaaccagagcgccggcccccacgtgagcgccagaagcagaaccagatggttcctgctgcagaccctgatcgacaaccccagactgaccatgcacagaaagctgaagctgggccacagcagccaggagagccagatcctgatggcctgcagcgagagctag

SEQ ID NO: 17479 - DNA, 2049 bp, Artificial Sequence
  Description of Artificial Sequence: Synthetic coding sequence
atgtggcacggcaaccacgtgcagcccggcgccacccacagacccaaccagggcctggagatgctgcagggcctgggcatcggcatgaaggccttccacaacttcaactacttcctgttcttctacaacgtgctgctgggcctgggcgcctgcctgagcagactgctgatcagctgcctgctgggcatgtggctgatcgccagaatcgacagaaccatcatgcagagcggctacgagggcgccgacatgggcttcagcgcctggatcggcatgctgtacatggaccactaccacatcaaccccgtgctggtgagcttctgccacatcctgatcaccaaccacagagagaagaagctgcagcagagcaccaagtactggtgcctgaaccagagcgccgagagcctgagaatctgcgccatgagaggcggcgagaacagaccccccgccagagtgcagagcagcagcgaggagctggagctgagacaccagagcctggacgccttccccggcagaagactgcccggcagaggcatccagcccgccgccaagatgagcagcgtgggcaaggtgacccaggtgcccaacggcaaggcctaccagcagatcttccaggccgaggtgcagctggtgcacagcctggccgccaccagaaagagagccgccgagagaagcgtgaccctgaagagcggcagaatccccatgatgaagaaggtggagacccccgagggcgaggtgatgagccccagacagcagaagtggatgcacagcctgcccaacgactggatcatggagaaccccgtgctgcacagagagaaggagagagccaagagagagaaggccagagagagcgagaacaccatcgccgccagagaggtgagaggcctgatggacaccatcgtgcccgagaagatcagcaccagcaccttccagagacaggccgagcacaagagaaagagctacgagagcgccctggccagcttccaggaggagatcgcccaggtgggcaaggagatggagcccctgatcgtggacaccggcggcctgttcctgaagaagctgaccgagagcgacgaggagatgaacagactgttcctgaaggtggagaacgacaccaacctggaggactacaccatccaggccctgctggagctgtgggacaaggtggccggcagactgctgctgagaaagcaggagatcaaggagctggacgaggccctgcacagcctggagttcagcagaaccgacaagctgaagagcgtgctgaagaagtacgccgaggtgatcgagaagaccagctacctgatgagacccgaggtgtacagactgatcaacgaggaggccatggtgatgaactacgccctgctgggcaacagaaaggccctggcccagctgttcgtgaacctgatggagagcaccctgcagcaggagctggacagcagacacagatggcagggcctggtggacacctggaaggccctgaagaaggaggccctgctgcagagcttcagcgacctgctgccccccagctacagcaagacccagctgaccgagtggcacagcagcctgaacagcctgaacaaggagctggacacctaccacgtggactgcatgatgagaatcagactgctgtacgagaagacctggcaggagtgcctgatgcacgtgcagaactgcaagaagcagctgctggactggaaggccttcaccgaggaggaggccgagaccctggtgaaccagttcttcttccagatggtgggcgccctgcagggcaaggtggaggaggacctggagctgctggacgtgagagccggcgactgcagcaccggcgagctgagaaaccccagcagactgtggcagatcagacagagcggcagagtgcacaccagcagcagcatcagcagaagatggtacaactgcggcagacacaccagagccagctgctggtgcagaagctggagctggagaagaggctggagcagcaccggcagaagcaccgcctggagagccagatgcagaagacccaccagcatcggcagctggaccaactag

SEQ ID NO: 17480 - DNA, 2712 bp, Artificial Sequence
  Description of Artificial Sequence: Synthetic coding sequence
atgagaggcggcgagaacagaccccccgccagagtgcagagcagcagcgaggagctggagctgagacaccagagcctggacgccttccccggcagaagactgcccggcagaggcatccagcccgccgccaagatgagcagcgtgggcaaggtgacccaggtgcccaacggcaaggcctaccagcagatcttccaggccgaggtgcagctggtgcacagcctggccgccaccagaaagagagccgccgagagaagcgtgaccctgaagagcggcagaatccccatgatgaagaaggtggagacccccgagggcgaggtgatgagccccagacagcagaagtggatgcacagcctgcccaacgactggatcatggagaaccccgtgctgcacagagagaaggagagagccaagagagagaaggccagagagagcgagaacaccatcgccgccagagaggtgagaggcctgatggacaccatcgtgcccgagaagatcagcaccagcaccttccagagacaggccgagcacaagagaaagagctacgagagcgccctggccagcttccaggaggagatcgcccaggagatggagcccctgatcgtggacaccggcggcctgttcctgaagaagctgaccgagagcgacgaggagatgaacagactgttcctgaaggtggagaacgacaccaacctggaggactacaccatccaggccctgctggagctgtgggacaaggtggccggcagactgctgctgagaaagcaggagatcaaggagctggacgaggccctgcacagcctggagttcagcagaaccgacaagctgaagagcgtgctgaagaagtacgccgaggtgatcgagaagaccagctacctgatgagacccgaggtgtacagactgatcaacgaggaggccatggtgatgaactacgccctgctgggcaacagaaaggccctggcccagctgttcgtgaacctgatggagagcaccctgcagcaggagctggacagcagacacagatggcagggcctggtggacacctggaaggccctgaagaaggaggccctgctgcagagcttcagcgagttcatggccagcgagagcatccacaccccccccgccgtgaccaaggagctggaggtgatgctgaagacccagaacgtgctgcagcagagaagactgaagcacctgtgcaccatctgcgacctgctgccccccagctacagcaagacccagctgaccgagtggcacagcagcctgaacagcctgaacaaggagctggacacctaccacgtggactgcatgatgagaatcagactgctgtacgagaagacctggcaggagtgcctgatgcacgtgcagaactgcaagaagcagctgctggactggaaggccttcaccgaggaggaggccgagaccctggtgaaccagttcttcttccagatggtgggcgccctgcagggcaaggtggaggaggacctggagctgctggacaagagcttcgagaccctggccgaccagaccgagtggcagagcagccacctgttcaagtacttccaggaggtggtgcagctgtgggaggcccaccagagcgagctgctggtgcaggagctggagctggagaagagaatggagcagcacagacagaagcacagcctggagagccaggtgcaggaggcccacctggacagactgctggaccagctgagacagcagagcgacaaggagaccctggccttccacctggagaaggtgaaggactacctgaagaacatgaagagcagatacgagtgcttccacaccctgctgaccaaggaggtgatggagtaccccgccatcatgctgaaggagctgaacagctacagcagcgccctgagccagtacttcttcgtgagagagatcttcgagcagaacctggccggcgaggtgatcttcaagttcagacagcccgaggcccacgagaagcccagccagaagagagtgaagaagctgagaaagaagcagggcagcaaggaggacatgaccagaagcgaggagagcatcagcagcggcaccagcaccgccagaagcgtggaggaggtggaggaggagaacgaccaggagatggagagcttcatcaccgaggaggtgctgggccagcagaagaagagccccctgcacgccaagatggacgagagcaaggagggcagcatccagggcctggaggagatgcaggtggagagagagggcagcctgaaccccagcctgaacgaggagaacgtgaagggccagggcgagaagaaggaggagagcgaggaggaggacgagaaggaggaggaggaggaggaggagaagctggaggaggagaaggaggagaaggaggcccaggaggagcaggagagcctgagcgtgggcgaggaggaggacaaggaggagggcctggaggagatctactacgaggacatggagagcttcaccatcagcagcggcaacacctacttcgtgttcgtgcccctggaggaggagcactgcagaaagagccacagcaccttcagcgccatgttcatcaacgacaccagcagcgccaagttcatcgagcaggtgaccatccccagcagactgatcctggagatcaagaagcacagagcctggtggtgcgtgcccgtgatccccgccacccaggaggccgaggccggcgagagccccgagcccagaagaagaagactgcagtag

SEQ ID NO: 17481 - DNA, 5106 bp, Artificial Sequence; identical to SEQ ID NO: 17477
  Description of Artificial Sequence: Synthetic coding sequence

SEQ ID NO: 17482 - DNA, 2700 bp, Artificial Sequence
  Description of Artificial Sequence: Synthetic coding sequence
ggcagacccgccgccgtggtggccggccccgccctggccgccctgagagagagcctgagaatctgcgccatgagaggcggcgagaacagaccccccgccagagtgcagagcagcagcgaggagctggagctgagacaccagagcctggacgccttccccggcagaagactgcccggcagaggcatccagcccgccgccaagatgagcagcgtgggcaaggtgacccaggtgcccaacggcaaggcctaccagcagatcttccaggccgaggtgcagctggtgcacagcctggccgccaccagaaagagagccgccgagagaagcgtgaccctgaagagcggcagaatccccatgatgaagaaggtggagacccccgagggcgaggtgatgagccccagacagcagaagtggatgcacagcctgcccaacgactggatcatggagaaccccgtgctgcacagagagaaggagagagccaagagagagaaggccagagagagcgagaacaccatcgccgccagagaggtgagaggcctgatggacaccatcgtgcccgagaagatcagcaccagcaccttccagagacaggccgagcacaagagaaagagctacgagagcgccctggccagcttccaggaggagatcgcccaggtgggcaaggagatggagcccctgatcgtggacaccggcggcctgttcctgaagaagctgaccgagagcgacgaggagatgaacagactgttcctgaaggtggagaacgacaccaacctggaggactacaccatccaggccctgctggagctgtgggacaaggtggccggcagactgctgctgagaaagcaggagatcaaggagctggacgaggccctgcacagcctggagttcagcagaaccgacaagctgaagagcgtgctgaagaagtacgccgaggtgatcgagaagaccagctacctgatgagacccgaggtgtacagactgatcaacgaggaggccatggtgatgaactacgccctgctgggcaacagaaaggccctggcccagctgttcgtgaacctgatggagagcaccctgcagcaggagctggacagcagacacagatggcagggcctggtggacacctggaaggccctgaagaaggaggccctgctgcagagcttcagcgagttcatggccagcgagagcatccacaccccccccgccgtgaccaaggagctggaggtgatgctgaagacccagaacgtgctgcagcagagaagactgaagcacctgtgcaccatctgcgacctgctgccccccagctacagcaagacccagctgaccgagtggcacagcagcctgaacagcctgaacaaggagctggacacctaccacgtggactgcatgatgagaatcagactgctgtacgagaagacctggcaggagtgcctgatgcacgtgcagaactgcaagaagcagctgctggactggaaggccttcaccgaggaggaggccgagaccctggtgaaccagttcttcttccagatggtgggcgccctgcagggcaaggtggaggaggacctggagctgctggacaagagcttcgagaccctggccgaccagaccgagtggcagagcagccacctgttcaagtacttccaggaggtggtgcagctgtgggaggcccaccagagcgagctgctggtgcaggagctggagctggagaagagaatggagcagcacagacagaagcacagcctggagagccaggtgcaggaggcccacctggacagactgctggaccagctgagacagcagagcgacaaggagaccctggccttccacctggagaaggtgaaggactacctgaagaacatgaagagcagatacgagtgcttccacaccctgctgaccaaggaggtgatggagtaccccgccatcatgctgaaggagctgaacagctacagcagcgccctgagccagtacttcttcgtgagagagatcttcgagcagaacctggccggcgaggtgatcttcaagttcagacagcccgaggcccacgagaagcccagccagaagagagtgaagaagctgagaaagaagcagggcagcaaggaggacatgaccagaagcgaggagagcatcagcagcggcaccagcaccgccagaagcgtggaggaggtggaggaggagaacgaccaggagatggagagcttcatcaccgaggaggtgctgggccagcagaagaagagccccctgcacgccaagatggacgagagcaaggagggcagcatccagggcctggaggagatgcaggtggagagagagggcagcctgaaccccagcctgaacgaggagaacgtgaagggccagggcgagaagaaggaggagagcgaggaggaggacgagaaggaggaggaggaggaggaggagaagctggaggaggagaaggaggagaaggaggcccaggaggagcaggagagcctgagcgtgggcgaggaggaggacaaggaggagggcctggaggagatctactacgaggacatggagagcttcaccatcagcagcggcaacacctacttcgtgttcgtgcccctggaggaggagcactgcagaaagagccacagcaccttcagcgccatgttcatcaacgacaccagcagcgccaagttcatcgagcaggtgaccatccccagcagactgatcctggagatcaagaagtag

SEQ ID NO: 17483 - DNA, 585 bp, Artificial Sequence
  Description of Artificial Sequence: Synthetic coding sequence
atggccaagagaagagccgccgagcccgtgaccttccacgtgccctggaagagactgctgctgtgcgacttcgccgagcagcccccccccccccccctgtggatcagaccccccggcgtggcccacgccggccagctgctgggcgtgcccgagcagcacagaaagagaaagatcgacgccggcaccatggccgagcccagcgccagccccagcaagagaagagacagcggcgacaacagcgcccccagcggccaggagagagaggaccacggcctggagaccggcgacccccccctgccccccccccccgtgctgcccggccccggcgaggagctgcccggcgccagactgcccggcggcggcggcgacgacggcgccggcagagccggcccccccagaggcgactggggcgtggccagcagacagcacaacgaggagttctggcagtacaacaccttccagtactggagaaaccccctgccccccatcgacctggccgacatcgaggacctgagcgaggacaccctgaccgaggccaccctgcagggcagaaacgagggcgccgaggtggacatggagagctag

SEQ ID NO: 17484 - DNA, 558 bp, Artificial Sequence
  Description of Artificial Sequence: Synthetic coding sequence
atgcccagactgttcctgttccacctgctggagttctgcctgctgctgaaccagttcagcagagccgtggccgccaagtggaaggacgacgtgatcaagctgtgcggcagagagctggtgagagcccagatcgccatctgcggcatgagcacctggagcaagagaagcctgagccaggaggacgccccccagacccccagacccgtggccgagatcgtgcccagcttcatcaacaaggacaccgagaccatcatcatcatgctggagttcatcgccaacctgccccccgagctgaaggccgccctgagcgagagacagcccagcctgcccgagctgcagcagtacgtgcccgccctgaaggacagcaacctgagcttcgaggagttcaagaagctgatcagaaacagacagagcgaggccgccgacagcaaccccagcgagctgaagtacctgggcctggacacccacagccagaagaagagaagaccctacgtggccctgttcgagaagtgctgcctgatcggctgcaccaagagaagcctggccaagtactgctag

SEQ ID NO: 17485 - DNA, 486 bp, Artificial Sequence
  Description of Artificial Sequence: Synthetic coding sequence
atgaagaagatcgagatcagcggcacctgcctgagcttccacctgctgttcggcctggagatcagaatgagaagaatcgtgttcgccggcgtgatcctgttcagactgctgggcgtgatcctgttcagactgctgggcgtgatcctgttcggcagactgggcgacctgggcacctgccagaccaagcccggccagtactggaaggaggaggtgcacatccaggacgtgggcggcctgatctgcagagcctgcaacctgagcctgcccttccacggctgcctgctggacctgggcacctgccaggccgagcccggccagtactgcaaggaggaggtgcacatccagggcggcatccagtggtacagcgtgaagggctgcaccaagaacaccagcgagtgcttcaagagcaccctggtgaagagaatcctgcagctgcacgagctggtgaccacccactgctgcaaccacagcctgtgcaacttctag

SEQ ID NO: 17486 - DNA, 384 bp, Artificial Sequence
  Description of Artificial Sequence: Synthetic coding sequence
atgggcgtgggcttcaccgagctggagtacctggccccctggctgagaccccccttcagcgacctgggcacctgccagaccaagcccggccagtactggaaggaggaggtgcacatccaggacgtgggcggcctgatctgcagagcctgcaacctgagcctgcccttccacggctgcctgctggacctgggcacctgccaggccgagcccggccagtactgcaaggaggaggtgcacatccagggcggcatccagtggtacagcgtgaagggctgcaccaagaacaccagcgagtgcttcaagagcaccctggtgaagagaatcctgcagctgcacgagctggtgaccacccactgctgcaaccacagcctgtgcaacttctag

SEQ ID NO: 17487 - DNA, 513 bp, Artificial Sequence
  Description of Artificial Sequence: Synthetic coding sequence
atgcagaacagaaccggcctgatcctgtgcgccctggccctgctgatgggcttcctgatggtgtgcctgggcgccttcttcatcagctggggcagcatcttcgactgccagggcagcctgatcgccgcctacctgctgctgcccctgggcttcgtgatcctgctgagcggcatcttctggagcaactacagacaggtgaccgagagcaagggcgtgctgagacacatgctgagacagcacctggcccacggcgccctgcccgtggccaccgtggacagacccgacttctacccccccgcctacgaggagagcctggaggtggagaagcagagctgccccgccgagagagaggccagcggcatccccccccccctgtacaccgagaccggcctggagttccaggacggcaacgacagccaccccgaggccccccccagctacagagagagcatcgccggcctggtggtgaccgccatcagcgaggacgcccagagaagaggccaggagtgctag

SEQ ID NO: 17488 - DNA, 4338 bp, Artificial Sequence
  Description of Artificial Sequence: Synthetic coding sequence
atgggcaacctggtgatccccctgggcaagggcagagccggcagagtggagagcggccagagaatccccccccccgcccccagacccagcgtggagtgcaccggcgacgacatcgccctgcagatggagaagatgctgttccccctgaagagccccagcgccacctggctgagccccagcagcaccccctggatgatggacttcatcctgaccagcgtgtgcggcctggtgctgctgttcctgctgctgctgtacgtgcacagcgacccccccagccccccccccggcagaaagagaagcagcagagagccccagagagagagaagcggcagaagcagaagcagaaagatcagcgccctgaaggcctgcagaatcctgctgagagagctggaggagaccagagacctgaactacctgctggagagccacctgagaaagctggccggcgagggcagcagccacctgcccctgggcggcgaccccctgggcgacgtgtgcaagcccgtgcccgccaaggcccaccagccccacggcaagtgcatgcaggaccccagccccgccagcctgagcccccccgccccccccgcccccctggccagcaccctgagccccggccccatgaccttcagcgagcccttcggcccccacagcaccctgagcgccagcggcccccccgagcccctgctgcccctgaagtgccccgccacccagccccacgtggtgttcccccccagcccccagccccacggccccctggccagcagcccccccccccccgacagcagcctggccggcctgcagtgcggcagcaccacctgccccgtgccccagagcagccccctgcacaaccaggtgctgcccccccccaccagagtgatcagcggcctgggctgcagcagcgaccccatctgggacctgtactgctggagagaggccgccaccacctggggcctgagcacctacagccacggcaagagccagcccagacacctgcccgaccacaccagcgaggccagcttctggggcgaccccacccccaagcacatggaggtgggcggctgcaccttcatccaccccgacgtgcagaagctgctggagaccctgatcgccaagagagccctgatgaagatgtggcaggagaaggagagaaagagagccgaccacccccacatgaccagcctgggcaaggagtgggacatcaccaccctgaaccccttctggaacgtgagcacccagccccagcagctgcccagaccccagcaggtgagcgacgccaccaccgtgggcaaccacctgcagcagaagagaagccagctgttctgggacctgcccagcctgaacagcgagagcctggccaccaccgtgtgggtgagcagaaaccccagcagccagaacgcccacagcgtgcccctggacaaggccagcaccagcctgcccggcgagcccgaggtggaggccagcagccagctgagccaggcccccccccagccccaccacatggcccagccccagcacttcacccccgcctggccccagagccagcccccccccctggccgagatccagacccaggcccacctgagcccccccgtgcccagcctgggctgcagcagccccccccagatcagaggctgcggcgccagctaccccaccagccaggagagaacccagagcgtgatccccaccggcaaggagtacctggagtggcccctgaagaagagacccaagtggaagagagtgctgcccagcctgctgaagaagagccaggccgtgctgagccagcccaccgcccacctgccccaggagagacccgccagctggagccccaagagcgcccccatcctgcccggcgtggtgaccagccccgagctgcccgagcactggtggcagggcagaaacgccatccaccaggagcagagctgcggcccccccagcagactgcaggccagcggcgacctgctgcagcccgacggcgagttccccggcagaccccagagccaggccgaggacacccagcaggccctgctgcccagccagcccagcgacttcgccggcaagggcagaaaggacgtgcagaagaccggcttcagaagcagcggcagattcagcgacaagggctgcctgggcagcaagctgggccccgaccccagcagagaccagggcagcggcagaaccagcgtgaaggccctggacgaggacaaggaggccgagggcgacctgagaagaagctggaagtaccagagcgtgagcagcacccccagagaccccgacaaggagcacctggagaacaagctgcagatccacctggccagaaaggtgggcgagatcaaggagggctggatccccatgcccgtgagaagaagctggctgatggccaagtgcgccgtgcccaagagcgacacccacagaaagcccggcaagctggccagctggagaggcggcaaggcccacgtgaacaccagccaggagctgagcttcctgcacccctgcacccagcagatcctggaggtgcacctggtgagattctgcgtgagacacagctggggcaccgacctgcagagcctggagcccatcaacgtgtggagcggcgaggcccaggccccccccttcccccagagcaccttcaccccctgggccagctgggtgagcagagtggagagcgtgcccaaggtgcccatcttcctgggcaagagaccccagaacggccccggcgacaacagaaccaccagcaagagcgtgcccaccgtgagcggccccctggccgcccccccccccgagcaggagggcgtgcagagaccccccagaggcagccagagcgccgacacccacggcagaagcgaggccttccccaccggccacaagggcagaggctgcagccagccccccacctgcagcctggtgggcagaacctggcagagcagaaccgtgctggagagcggcaagcccaagcccagactggagggcagcatgggcagcgagatggccggcaacgaggcctggctggagagcgagagcatgagccccggcgacccctgcagcagcagagccctgcaggtgctgagcatcggcagccagtgggccagagccgaggacgccctgcaggccctgaaggtgggcgagaagccccccacctgggaggtgaccctgggcgccagcgtgagagccagcagcggcagcgtgcaggaggacctgagaagcaccggcgccctgggcaccaccggcaaccccagcgccagcagcgtgtgcgtggcccaggaccccgagcagctgcacctgaaggcccaggtggtgagcgagatcgccctgatcgtgcaggtggacagcgaggagcagctgcccggcagagcccccggcatcctgctgcaggacggcgccaccggcctgtgcctgcccggcagacacatggacatgctgaccgccgccgacagactgcccacccaggcccccctgagcaccagccagagcgtgagcggcaagaacatgaccgccagccagggcccctgcgccctgctgtggaagggcggcgacagccccggccagcaggagcccggcagccccaaggccaaggccccccagaagagccagaagaccctgggctgcgccgacaagggcgaggcccacagaagacccagaaccggcgagcagggccacagaagcaagggccccagaaccagcgaggccagcggcagaagccaccccgcccaggccagagagatcggcgacaagcaggagagaaagtacaaccagctgcagctggagaagggccagaccccccccgagagccacttccagagaaagatcagccaccacccccagggcctgcaccccagaaagggcggcaccagatgggaggacgtgctgcagaagggcaagcccggcgccgacgccttccagagctggggcagcggcccccccagacagttcatggactgcatggccgacaaggcctggaccatcagcagagtggtgggccagatcctggtggacaagctgggcctgcagtggggcagaggccccagcgaggtgaacagacacaagggcgacttcagagcccaggagaacgtgcccagctgctgccacagaggccactgccaccaggagagaagcagagagatgagagccctggcctgcagccccaaggccacccccaagggccaccactgccccgtgaagaacagaggcatcagagacagagacagcagctgggcccccccccccagagagcccgtgagccccgccggcccccaccaccacagacccagaatggccagcaccagcggcggcccccacccccagctgcaggagctgatgagcgcccagagatgcctggccagctag

SEQ ID NO: 17489 - DNA, 1761 bp, Artificial Sequence
  Description of Artificial Sequence: Synthetic coding sequence
atggaggtgggcggctgcaccttcatccaccccgacgtgcagaagctgctggagaccctgatcgccaagagagccctgatgaagatgtggcaggagaaggagagaaagagagccgaccacccccacatgaccagcctgggcaaggagtgggacatcaccaccctgaaccccttctggaacgtgagcacccagccccagcagctgcccagaccccagcaggtgagcgacgccaccaccgtgggcaaccacctgcagcagaagagaagccagctgttctgggacctgcccagcctgaacagcgagagcctggccaccaccgtgtgggtgagcagaaaccccagcagccagaacgcccacagcgtgcccctggacaaggccagcaccagcctgcccggcgagcccgaggtggaggccagcagccagctgagccaggcccccccccagccccaccacatggcccagccccagcacttcacccccgcctggccccagagccagcccccccccctggccgagatccagacccaggcccacctgagcccccccgtgcccagcctgggctgcagcagccccccccagatcagaggctgcggcgccagctaccccaccagccaggagagaacccagagcgtgatccccaccggcaaggagtacctggagtggcccctgaagaagagacccaagtggaagagagtgctgcccagcctgctgaagaagagccaggccgtgctgagccagcccaccgcccacctgccccaggagagacccgccagctggagccccaagagcgcccccatcctgcccggcgtggtgaccagccccgagctgcccgagcactggtggcagggcagaaacgccatccaccaggagcagagctgcggcccccccagcagactgcaggccagcggcgacctgctgcagcccgacggcgagttccccggcagaccccagagccaggccgaggacacccagcaggccctgctgcccagccagcccagcgacttcgccggcaagggcagaaaggacgtgcagaagaccggcttcagaagcagcggcagattcagcgacaagggctgcctgggcagcaagctgggccccgaccccagcagagaccagggcagcggcagaaccagcgtgaaggccctggacgaggacaaggaggccgagggcgacctgagaagaagctggaagtaccagagcgtgagcagcacccccagagaccccgacaaggagcacctggagaacaagctgcagatccacctggccagaaaggtgggcgagatcaaggagggctggatccccatgcccgtgagaagaagctggctgatggccaagtgcgccgtgcccaagagcgacacccacagaaagcccggcaagctggccagctggagaggcggcaaggcccacgtgaacaccagccaggagctgagcttcctgcacccctgcacccagcagatcctggaggtgcacctggtgagattctgcgtgagacacagctggggcaccgacctgcagagcctggagcccatcaacgtgtggagcggcgaggcccaggccccccccttcccccagagcaccttcaccccctgggccagctgggtgagcagagtggagagcgtgcccaaggtgcccatcttcctgggcaagagaccccagaacggccccggcgacaacagaaccaccagcaagagcgtgcccaccgtgagcggccccctggccgccaccggcgtgaccgccaccaagaacgtggccgagagatag

SEQ ID NO: 17490 - DNA, 1029 bp, Artificial Sequence
  Description of Artificial Sequence: Synthetic coding sequence
atggcctgcgagccccaggtggaccccggcgccaccggccccctgccccccagcagccccggctggagcgccctgcccggcggcagcccccccggctggggccaggagctgcacaacggccaggtgctgaccgtgctgagaatcgacaacacctgcgcccccatcagcttcgacctgggcgccgccgaggagcagctgcagacctggggcatccaggtgcccgccgaccagtacagaagcctggccgagagcgccctgctggagccccaggtgagaagatacatcatctacaacagcagacccatgagactggccttcgccgtggtgttctacgtggtggtgtgggccaacatctacagcaccagccagatgttcgccctgggcaaccactgggccggcatgctgctggtgaccctggccgccgtgagcctgaccctgaccctggtgctggtgttcgagagacaccagaagaaggccaacaccaacaccgacctgagactggccgccgccaacggcgccctgctgagacacagagtgctgctgggcgtgaccgacaccgtggagggctgccagagcgtgatccagctgtggttcgtgtacttcgacctggagaactgcgtgcagttcctgagcgaccacgtgcaggagatgaagaccagccaggagagcctgctgagaagcagactgagccagctgtgcgtggtgatggagaccggcgtgagccccgccaccgccgagggccccgagaacctggaggacgcccccctgctgcccggcaacagctgccccaacgagagacccctgatgcagaccgagctgcaccagctggtgcccgaggccgagcccgaggagatggccagacagctgctggccgtgttcggcggctactacatcagactgctggtgaccagccagctgccccaggccatgggcaccagacacaccaacagccccagaatcccctgcccctgccagctgatcgaggcctacatcctgggcaccggctgctgccccttcctggccagatag

SEQ ID NO: 17491 - DNA, 1032 bp, Artificial Sequence
  Description of Artificial Sequence: Synthetic coding sequence
atggcctgcgagccccaggtggaccccggcgccaccggccccctgccccccagcagccccggctggagcgccctgcccggcggcagcccccccggctggggccaggagctgcacaacggccaggtgctgaccgtgctgagaatcgacaacacctgcgcccccatcagcttcgacctgggcgccgccgaggagcagctgcagacctggggcatccagcaggtgcccgccgaccagtacagaagcctggccgagagcgccctgctggagccccaggtgagaagatacatcatctacaacagcagacccatgagactggccttcgccgtggtgttctacgtggtggtgtgggccaacatctacagcaccagccagatgttcgccctgggcaaccactgggccggcatgctgctggtgaccctggccgccgtgagcctgaccctgaccctggtgctggtgttcgagagacaccagaagaaggccaacaccaacaccgacctgagactggccgccgccaacggcgccctgctgagacacagagtgctgctgggcgtgaccgacaccgtggagggctgccagagcgtgatccagctgtggttcgtgtacttcgacctggagaactgcgtgcagttcctgagcgaccacgtgcaggagatgaagaccagccaggagagcctgctgagaagcagactgagccagctgtgcgtggtgatggagaccggcgtgagccccgccaccgccgagggccccgagaacctggaggacgcccccctgctgcccggcaacagctgccccaacgagagacccctgatgcagaccgagctgcaccagctggtgcccgaggccgagcccgaggagatggccagacagctgctggccgtgttcggcggctactacatcagactgctggtgaccagccagctgccccaggccatgggcaccagacacaccaacagccccagaatcccctgcccctgccagctgatcgaggcctacatcctgggcaccggctgctgccccttcctggccagatag

SEQ ID NO: 17492 - DNA, 2136 bp, Artificial Sequence
  Description of Artificial Sequence: Synthetic coding sequence
atggccagaagcagaagcagaagccccagatggaagcacagaagcctgagccccgtgcccagaaacgccgagcactacaagcagagacacagccacggccactacggctgcgagtacagaaaggaccccaagagacccgtggcctggagaatggacagcgagaagcacggccagagcaagcccagaatccccagcagaggcaacatctactaccagagctacgagcacagaagccccagccccaacatcagaaacagcctggagaacgtgtacatgtacaagccccacagaggctacagccccggcagaggcgacagcaacagaagagcccagtacatgcccaagtacagcgagggcatcccctacaaggagcacgagagaaacagctacccccagaaggtgcagggcggccacagccccgacgaccacagagtgagaggcagcggcaagggcggcaagcccccccagagaagcatcgccgacagcttcagattcgagggcaagtggcacgaggacgagctgagacaccagagaatccaggaggagaagtacagccagagcaccagaagaggcagcgaggacttcgagaccagaagcagcttccagaagagataccccgaggacagagacttcagaaagtacggccacaccagcaagagacccaaggacgtggagagatacgagagcagagagcccgccagaaaccccaagtggaagcccgagcacagcctgcccccctaccaggaggacaccgaccagtggaacctgggcccccagacctacagacacgccgagagagagcaccccgagaccagcagcgccaccaaggtgagctacgactacagacacaagagacccaagctgctggacggcgaccaggacttcagcgacggcagaacccagaagtactgcaaggaggaggacagaaagtacagcttccagaagggccccctgaacagagagctggactgcttcaacaccggcagaggcagagagacccaggacggccaggtgaaggagcccttcaagcccagcaagaaggacagcatcgcctgcacctacagcaacaagaacgacgtggacctgagaagcagcaacgacaagtggaaggagaagatcaagaaggagggcgactgcagaaaggagagcaacagcagcagcaaccagctggacaagagccagaagctgcccgacgtgaagcccagccccatcaacctgagaaagaagagcctgaccgtgaaggtggacgtgaagaagaccgtggacaccttcagagtggccagcagctacagcaccgagagacagatgagccacgacctggtggccgtgggcagaaagagcgagaacttccaccccgtgttcgagcacctggacagcacccagaacaccgagaacaagcccaccggcgagttcgcccaggagatcatcaccatcatccaccaggtgaaggccaactacttccccagccccggcatcaccctgcacgagagattcagcaccatgcaggacatccacaaggccgacgtgaacgagatccccctgaacagcgaccccgagatccacagaagaatcgacatgagcctggccgagctgcagagcaagcaggccgtgatctacgagagcgagcagaccctgatcaagatcatcgaccccaacgacctgagacacgacatcgagagaagaagaaaggagagactgcagaacgaggacgagcacatcttccacatcgccagcgccgccgagagagacgaccagaacagcagcttcagcaaggtgaagaacgtgcacaccgacggcttccagaagcccacccacttcatcaagagcaacttcagaaagtgcatcgagaagccctacatgaactacaccacccagagaaaggacatcatcacccacaagcccttcgaggtggagggcaaccacagaaacaccagagtgagacccttcaagagcaacttcagaggcggcagatgccagcccaactacaagagcggcctggtgcagaagagcctgtacatccaggccaagtaccagagactgagattcaccggccccagaggcttcatcacccacaagttcagagagagactgatgagaaagaagaaggagtacaccgacgtggccaccggcatctag

SEQ ID NO: 17493 - DNA, 1509 bp, Artificial Sequence
  Description of Artificial Sequence: Synthetic coding sequence
atggccatccacctggacaagcagaacatcatcctgaagaacgacaaggacgagtacctgaagaagaccagagacggcgtgctgcccccctaccaggacgccaagccccccagccccgccagcatcaagaagacctacaccaccagcaagttcaacgacgccgagcccgccaagggcaacctgttcatcggcgtggaggtgctgcccgagaacctgcacctggacgagagcgagaccagcgaggaggaccacggcagcctggagaaggagaagtacgagcagttcctgagcctggaggagggcaccaaggcccactacttcttcgagaaggtggtgaacgccgcccagacctggttcagcctgttcggctggcccgagggcccccacagcttcagcatccccgagaccatcagaagagacgtgtacaagatgcagttctacagcagcaccagccccccccagaagttcagcagacagaacgacttcagcaagtacaacaagaccatctacgacgtgctgctgcacctgagcggcaagatgccccccggcatcaacagcagccagagcctgcccgtggacaaccacgagaagagagtgatccagctgcacctgcagcacagcagcctgctggacttcctgaacgcccagggcggctgcatcagccacgtgctgcccgagttcctgctggagcccgaggactacaagagatggatcgagatcatgagcagcaccaacaccatgcccgtgagcagctgcacccccaagaagaagtgcagcatcgtgatcgagatgagcaagttcgaggcctggagcaagagagcctggaccgacgtgttcctgcagatctacaaggtgctggtgctgagcagagtggtgccctactgcagcaacaacatgccccccatctgcgtgcagaacacccccaaggtgaacccctgcttcgccagcagcaacatctacagcgacagcgagagaatcctgctgagctggatgaacatcaactacgagaacaccagacacgtgatctggaagaactgccacaaggacgtgatccccagcgagagatggatcgtgaacttcgacaaggacctgagcgacggcctggtgttcgccacccagctgggcgcctactgccccttcctgatcgagagccacttcatcaacatgtacaccagacccaagagccccgaggagtacctgcacaactgcctgatcatcgtgaacaccctgtacgagatcgacttcgacgtggagatccaggtgtgcctgagagtgttccccaaggagatggacgccggcgtgagcggcctgagaaaggaggacatgcccagcgtgtgggtggtgaccatcagactggccgtggccgtggccagaaccaagagacagaagaagggcgacatccagttcgcctgcttcttcgtgtgcctgttcttcttcatcttcgtggtgatcagcttcagcctgtggagcagaatgcacttcttcctgctgctgcccctggacatctag

SEQ ID NO: 17494 - DNA, 1509 bp, Artificial Sequence; identical to SEQ ID NO: 17493
  Description of Artificial Sequence: Synthetic coding sequence

SEQ ID NO: 17495 - DNA, 471 bp, Artificial Sequence
  Description of Artificial Sequence: Synthetic coding sequence
atgctgctgaactacatccccgtgtgctacaagatcctgcacctgaccggcgaggtgaagagccccgagctgctgttcgacccccccttcatcttcttcacccccgtgcccctggacatcaccaccgtgatggacatcaacatcctgccccagaactacttcagaaacagcaccctgtgcgtgcagatccccaccgtgagactgctggacggcgaggagatccaccccctgagcgtgaagttccccaagggcagagtgatccccggcagccacagcggcatcaacaacaagctgacctgccacctgagcttcaagagcagcaagcccgtgagcttcttcaccaacctgctgttctgcgacgacagaaagaactggtgcttccacttccagctgctgcagcagcagaagaccgccttcctgctgttcacccacatctggcagttcatctggatcagcaagaccctgttctag

SEQ ID NO: 17496 - DNA, 462 bp, Artificial Sequence
  Description of Artificial Sequence: Synthetic coding sequence
atgctgctgaactacatccccgtgtgctacaagatcctgcacctgaccggcgaggtgaagagccccgagctgctgttcgacccccccttcatcttcttcacccccgtgcccctggacatcaccaccgtgatggacatcaacatcctgccccagaactacttcagaaacagcaccctgtgcgtgcagatccccaccgtgagactgctggacggcgaggagatccaccccctgagcgtgaagttccccaagggcagagtgatccccggcagccacagcggcatcaacaacaagctgacctgccacctgagcttcaagagcagcaagcccgtgagcttcttcaccaacctgctgttctgcgacgacagaaagaactggtgcttccacttccagctgctgcagcagcagaagaccgccttcctgctgttcacccacatctggcagttcatctggatcagcaagtag

SEQ ID NO: 17497 - DNA, 1086 bp, Artificial Sequence
  Description of Artificial Sequence: Synthetic coding sequence
atgaacctggtgatctgcgtgctgctgctgagcatctggaagaacaactgcatgaccaccaaccagaccaacggcagcagcaccaccggcgacaagcccgtggagagcatgcagaccaagctgaactacctgagaagaaacctgctgatcctggtgggcatcatcatcatggtgttcgtgttcatctgcttctgctacctgcactacaactgcctgagcgacgacgccagcaaggccggcatggtgaagaagaagggcatcgccgccaagagcagcaagaccagcttcagcgaggccaagaccgccagccagtgcagccccgagacccagcccatgctgagcaccgccgacaagagcagcgacagcagcagccccgagagagccagcgcccagagcagcaccgagaagctgatcagacccagcagcctgcagaagcccagcatccccaacagcgccggcaagctgaccagacccagctaccccaagagaagcagcaagagcagctgcagcaagaagctgagcaagagcagccacctggagaaggcccacaagaagggcagcctggagaagctgtgcaagctggactacgcctgcaagctggccagcagcgacaagcccgtgagacccccccagctgttcaagcccctgtacagcagccacccccagaacgagatcagccccagcaagcccttcggcccccaggagctggccaagccccccaagcacttcaaccccaagagaagcgtgagcctgggcagagccgccctgctgagcaacagcgagctggccgagacctgccagccctacaagaagaagcacctggtggccaagacctacagacccctggtgaacgacatcagcgaggccaaggagaagaacacccagaacctgcacgtgagcagcaaggtgaagagcagcagcagaagcttcagaaagctggacagcagaaacaacgcctacggcgaccacgtgaacgacagcgacaccatgaagtactacagcgaggtggacagcgacaaggtgatcatcatcacctgcgacagaggctacaaccaggtgaccagcgaggtgaccctgaacgactag

SEQ ID NO: 17498 - DNA, 300 bp, Artificial Sequence
  Description of Artificial Sequence: Synthetic coding sequence
atggagccccagaagctgctgatcatcggcttcctgctgtgcagcctgacctgcctgctgctggagaccgtggccagcagccccctgcccctgagcgccctgggcatccaggagaagaccggcagcaagcccagaagcggcggcaaccacagaagctggctgaacaacttcagagactacctgtggcagctgatcaagagcgccctgccccccgccgccatcgtggccttcctgctgaccagcgccctgatgggcatcctgtgctgcttcaccatcctggtggtggaccccgtgcactag

SEQ ID NO: 17499 - DNA, 6054 bp, Artificial Sequence
  Description of Artificial Sequence: Synthetic coding sequence
atgagcctgggcctggccagagcccaggaggtggagctgaccctggagaccgtgatccagaccctggagagcagcgtgctgtgccaggagaagggcctgggcgccagagacctggcccaggacgcccagatcaccagcctgcccgccctgatcagagagatcgtgaccagaaacctgagccagcccgagagccccgtgctgctgcccgccaccgagatggccagcctgctgagcctgcaggaggagaaccagctgctgcagcaggagctgagcagagtggaggacctgctggcccagagcagagccgagagagacgagctggccatcaagtacaacgccgtgagcgagagactggagcaggccctgagactggagcccggcgagctggagacccaggagcccagaggcctggtgagacagagcgtggagctgagaagacagctgcaggaggagcaggccagctacagaagaaagctgcaggcctaccaggagggccagcagagacaggcccagctggtgcagagactgcagggcaagatcctgcagtacaagaagagatgcagcgagctggagcagcagctgctggagagaagcggcgagctggagcagcagagactgagagacaccgagcacagccaggacctggagagcgccctgatcagactggaggaggagcagcagagaagcgccagcctggcccaggtgaacgccatgctgagagagcagctggaccaggccggcagcgccaaccaggccctgagcgaggacatcagaaaggtgaccaacgactggaccagatgcagaaaggagctggagcacagagaggccgcctggagaagagaggaggagagcttcaacgcctacttcagcaacgagcacagcagactgctgctgctgtggagacaggtggtgggcttcagaagactggtgagcgaggtgaagatgttcaccgagagagacctgctgcagctgggcggcgagctggccagaaccagcagagccgtgcaggaggccggcctgggcctgagcaccggcctgagactggccgagagcagagccgaggccgccctggagaagcaggccctgctgcaggcccagctggaggagcagctgagagacaaggtgctgagagagaaggacctggcccagcagcagatgcagagcgacctggacaaggccgacctgagcgccagagtgaccgagctgggcctggccgtgaagagactggagaagcagaacctggagaaggaccaggtgaacaaggacctgaccgagaagctggaggccctggagagcctgagactgcaggagcaggccgccctggagaccgaggacggcgagggcctgcagcagaccctgagagacctggcccaggccgtgctgagcgacagcgagagcggcgtgcagctgagcggcagcgagagaaccgccgacgccagcaacggcagcctgagaggcctgagcggccagagaacccccagcccccccagaagaagcagccccggcagaggcagaagccccagaagaggccccagccccgcctgcagcgacagcagcaccctggccctgatccacagcgccctgcacaagagacagctgcaggtgcaggacatgagaggcagatacgaggccagccaggacctgctgggcaccctgagaaagcagctgagcgacagcgagagcgagagaagagccctggaggagcagctgcagagactgagagacaagaccgacggcgccatgcaggcccacgaggacgcccagagagaggtgcagagactgagaagcgccaacgagctgctgagcagagagaagagcaacctggcccacagcctgcaggtggcccagcagcaggccgaggagctgagacaggagagagagaagctgcaggccgcccaggaggagctgagaagacagagagacagactggaggaggagcaggaggacgccgtgcaggacggcgccagagtgagaagagagctggagagaagccacagacagctggagcagctggagggcaagagaagcgtgctggccaaggagctggtggaggtgagagaggccctgagcagagccaccctgcagagagacatgctgcaggccgagaaggccgaggtggccgaggccctgaccaaggccgaggccggcagagtggagctggagctgagcatgaccaagctgagagccgaggaggccagcctgcaggacagcctgagcaagctgagcgccctgaacgagagcctggcccaggacaagctggacctgaacagactggtggcccagctggaggaggagaagagcgccctgcagggcagacagagacaggccgagcaggaggccaccgtggccagagaggagcaggagagactggaggagctgagactggagcaggaggtggccagacagggcctggagggcagcctgagagtggccgagcaggcccaggaggccctggagcagcagctgcccaccctgagacacgagagaagccagctgcaggagcagctggcccagctgagcagacagctgagcggcagagagcaggagctggagcaggccagaagagaggcccagagacaggtggaggccctggagagagccgccagagagaaggaggccctggccaaggagcacgccggcctggccgtgcagctggtggccgccgagagagagggcagaaccctgagcgaggaggccaccagactgagactggagaaggaggccctggagggcagcctgttcgaggtgcagagacagctggcccagctggaggccagaagagagcagctggaggccgagggccaggccctgctgctggccaaggagaccctgaccggcgagctggccggcctgagacagcagatcatcgccacccaggagaaggccagcctggacaaggagctgatggcccagaagctggtgcaggccgagagagaggcccaggccagcctgagagagcagagagccgcccacgaggaggacctgcagagactgcagagagagaaggaggccgcctggagagagctggaggccgagagagcccagctgcagagccagctgcagagagagcaggaggagctgctggccagactggaggccgagaaggaggagctgagcgaggagatcgccgccctgcagcaggagagagacgagggcctgctgctggccgagagcgagaagcagcaggccctgagcctgaaggagagcgagaagaccgccctgagcgagaagctgatgggcaccagacacagcctggccaccatcagcctggagatggagagacagaagagagacgcccagagcagacaggagcaggacagaagcaccgtgaacgccctgaccagcgagctgagagacctgagagcccagagagaggaggccgccgccgcccacgcccaggaggtgagaagactgcaggagcaggccagagacctgggcaagcagagagacagctgcctgagagaggccgaggagctgagaacccagctgagactgctggaggacgccagagacggcctgagaagagagctgctggaggcccagagaaagctgagagagagccaggagggcagagaggtgcagagacaggaggccggcgagctgagaagaagcctgggcgagggcgccaaggagagagaggccctgagaagaagcaacgaggagctgagaagcgccgtgaagaaggccgagagcgagagaatcagcctgaagctggccaacgaggacaaggagcagaagctggccctgctggaggaggccagaaccgccgtgggcaaggaggccggcgagctgagaaccggcctgcaggaggtggagagaagcagactggaggccagaagagagctgcaggagctgagaagacagatgaagatgctggacagcgagaacaccagactgggcagagagctggccgagctgcagggcagactggccctgggcgagagagccgagaaggagagcagaagagagaccctgggcctgagacagagactgctgaagggcgaggccagcctggaggtgatgagacaggagctgcaggtggcccagagaaagctgcaggagcaggagggcgagttcagaaccagagagagaagactgctgggcagcctggaggaggccagaggcaccgagaagcagcagctggaccacgccagaggcctggagctgaagctggaggccgccagagccgaggccgccgagctgggcctgagactgagcgccgccgagggcagagcccagggcctggaggccgagctggccagagtggaggtgcagagaagagccgccgaggcccagctgggcggcctgagaagcgccctgagaagaggcctgggcctgggcagagcccccagccccgcccccagacccgtgcccggcagccccgccagagacgcccccgccgagggcagcggcgagggcctgaacagccccagcaccctggagtgcagccccggcagccagccccccagccccggccccgccaccagccccgccagccccgacctggaccccgaggccgtgagaggcgccctgagagagttcctgcaggagctgagaagcgcccagagagagagagacgagctgagaacccagaccagcgccctgaacagacagctggccgagatggaggccgagagagacagcgccaccagcagagccagacagctgcagaaggccgtggccgagagcgaggaggccagaagaagcgtggacggcagactgagcggcgtgcaggccgagctggccctgcaggaggagagcgtgagaagaagcgagagagagagaagagccaccctggaccaggtggccaccctggagagaagcctgcaggccaccgagagcgagctgagagccagccaggagaagatcagcaagatgaaggccaacgagaccaagctggagggcgacaagagaagactgaaggaggtgctggacgccagcgagagcagaaccgtgaagctggagctgcagagaagaagcctggagggcgagctgcagagaagcagactgggcctgagcgacagagaggcccaggcccaggccctgcaggacagagtggacagcctgcagagacaggtggccgacagcgaggtgaaggccggcaccctgcagctgaccgtggagagactgaacggcgccctggccaaggtggaggagagcgagggcgccctgagagacaaggtgagaggcctgaccgaggccctggcccagagcagcgccagcctgaacagcaccagagacaagaacctgcacctgcagaaggccctgaccgcctgcgagcacgacagacaggtgctgcaggagagactggacgccgccagacaggccctgagcgaggccagaaagcagagcagcagcctgggcgagcaggtgcagaccctgagaggcgaggtggccgacctggagctgcagagagtggaggccgagggccagctgcagcagctgagagaggtgctgagacagagacaggagggcgaggccgccgccctgaacaccgtgcagaagctgcaggacgagagaagactgctgcaggagagactgggcagcctgcagagagccctggcccagctggaggccgagaagagagaggtggagagaagcgccctgagactggagaaggacagagtggccctgagaagaaccctggacaaggtggagagagagaagctgagaagccacgaggacaccgtgagactgagcgccgagaagggcagactggacagaaccctgaccggcgccgagctggagctggccgaggcccagagacagatccagcagctggaggcccaggtggtggtgctggagcagagccacagccccgcccagctggaggtggacgcccagcagcagcagctggagctgcagcaggaggtggagagactgagaagcgcccaggcccagaccgagagaaccctggaggccagagagagagcccacagacagagagtgagaggcctggaggagcaggtgagcaccctgaagggccagctgcagcaggagctgagaagaagcagcgcccccttcagcccccccagcggcccccccgagaagtag

SEQ ID NO: 17500 - DNA, 5697 bp, Artificial Sequence
  Description of Artificial Sequence: Synthetic coding sequence
gagaagggcctgggcgccagagacctggcccaggacgcccagatcaccagcctgcccgccctgatcagagagatcgtgaccagaaacctgagccagcccgagagccccgtgctgctgcccgccaccgagatggccagcctgctgagcctgcaggaggagaaccagctgctgcagcaggagctgagcagagtggaggacctgctggcccagagcagagccgagagagacgagctggccatcaagtacaacgccgtgagcgagagagacaccgagcacagccaggacctggagagcgccctgatcagactggaggaggagcagcagagaagcgccagcctggcccaggtgaacgccatgctgagagagcagctggaccaggccggcagcgccaaccaggccctgagcgaggacatcagaaaggtgaccaacgactggaccagatgcagaaaggagctggagcacagagaggccgcctggagaagagaggaggagagcttcaacgcctacttcagcaacgagcacagcagactgctgctgctgtggagacaggtggtgggcttcagaagactggtgagcgaggtgaagatgttcaccgagagagacctgctgcagctgggcggcgagctggccagaaccagcagagccgtgcaggaggccggcctgggcctgagcaccggcctgagactggccgagagcagagccgaggccgccctggagaagcaggccctgctgcaggcccagctggaggagcagctgagagacaaggtgctgagagagaaggacctggcccagcagcagatgcagagcgacctggacaaggccgacctgagcgccagagtgaccgagctgggcctggccgtgaagagactggagaagcagaacctggagaaggaccaggtgaacaaggacctgaccgagaagctggaggccctggagagcctgagactgcaggagcaggccgccctggagaccgaggacggcgagggcctgcagcagaccctgagagacctggcccaggccgtgctgagcgacagcgagagcggcgtgcagctgagcggcagcgagagaaccgccgacgccagcaacggcagcctgagaggcctgagcggccagagaacccccagcccccccagaagaagcagccccggcagaggcagaagccccagaagaggccccagccccgcctgcagcgacagcagcaccctggccctgatccacagcgccctgcacaagagacagctgcaggtgcaggacatgagaggcagatacgaggccagccaggacctgctgggcaccctgagaaagcagctgagcgacagcgagagcgagagaagagccctggaggagcagctgcagagactgagagacaagaccgacggcgccatgcaggcccacgaggacgcccagagagaggtgcagagactgagaagcgccaacgagctgctgagcagagagaagagcaacctggcccacagcctgcaggtggcccagcagcaggccgaggagctgagacaggagagagagaagctgcaggccgcccaggaggagctgagaagacagagagacagactggaggaggagcaggaggacgccgtgcaggacggcgccagagtgagaagagagctggagagaagccacagacagctggagcagctggagggcaagagaagcgtgctggccaaggagctggtggaggtgagagaggccctgagcagagccaccctgcagagagacatgctgcaggccgagaaggccgaggtggccgaggccctgaccaaggccgaggccggcagagtggagctggagctgagcatgaccaagctgagagccgaggaggccagcctgcaggacagcctgagcaagctgagcgccctgaacgagagcctggcccaggacaagctggacctgaacagactggtggcccagctggaggaggagaagagcgccctgcagggcagacagagacaggccgagcaggaggccaccgtggccagagaggagcaggagagactggaggagctgagactggagcaggaggtggccagacagggcctggagggcagcctgagagtggccgagcaggcccaggaggccctggagcagcagctgcccaccctgagacacgagagaagccagctgcaggagcagctggcccagctgagcagacagctgagcggcagagagcaggagctggagcaggccagaagagaggcccagagacaggtggaggccctggagagagccgccagagagaaggaggccctggccaaggagcacgccggcctggccgtgcagctggtggccgccgagagagagggcagaaccctgagcgaggaggccaccagactgagactggagaaggaggccctggagggcagcctgttcgaggtgcagagacagctggcccagctggaggccagaagagagcagctggaggccgagggccaggccctgctgctggccaaggagaccctgaccggcgagctggccggcctgagacagcagatcatcgccacccaggagaaggccagcctggacaaggagctgatggcccagaagctggtgcaggccgagagagaggcccaggccagcctgagagagcagagagccgcccacgaggaggacctgcagagactgcagagagagaaggaggccgcctggagagagctggaggccgagagagcccagctgcagagccagctgcagagagagcaggaggagctgctggccagactggaggccgagaaggaggagctgagcgaggagatcgccgccctgcagcaggagagagacgagggcctgctgctggccgagagcgagaagcagcaggccctgagcctgaaggagagcgagaagaccgccctgagcgagaagctgatgggcaccagacacagcctggccaccatcagcctggagatggagagacagaagagagacgcccagagcagacaggagcaggacagaagcaccgtgaacgccctgaccagcgagctgagagacctgagagcccagagagaggaggccgccgccgcccacgcccaggaggtgagaagactgcaggagcaggccagagacctgggcaagcagagagacagctgcctgagagaggccgaggagctgagaacccagctgagactgctggaggacgccagagacggcctgagaagagagctgctggaggcccagagaaagctgagagagagccaggagggcagagaggtgcagagacaggaggccggcgagctgagaagaagcctgggcgagggcgccaaggagagagaggccctgagaagaagcaacgaggagctgagaagcgccgtgaagaaggccgagagcgagagaatcagcctgaagctggccaacgaggacaaggagcagaagctggccctgctggaggaggccagaaccgccgtgggcaaggaggccggcgagctgagaaccggcctgcaggaggtggagagaagcagactggaggccagaagagagctgcaggagctgagaagacagatgaagatgctggacagcgagaacaccagactgggcagagagctggccgagctgcagggcagactggccctgggcgagagagccgagaaggagagcagaagagagaccctgggcctgagacagagactgctgaagggcgaggccagcctggaggtgatgagacaggagctgcaggtggcccagagaaagctgcaggagcaggagggcgagttcagaaccagagagagaagactgctgggcagcctggaggaggccagaggcaccgagaagcagcagctggaccacgccagaggcctggagctgaagctggaggccgccagagccgaggccgccgagctgggcctgagactgagcgccgccgagggcagagcccagggcctggaggccgagctggccagagtggaggtgcagagaagagccgccgaggcccagctgggcggcctgagaagcgccctgagaagaggcctgggcctgggcagagcccccagccccgcccccagacccgtgcccggcagccccgccagagacgcccccgccgagggcagcggcgagggcctgaacagccccagcaccctggagtgcagccccggcagccagccccccagccccggccccgccaccagccccgccagccccgacctggaccccgaggccgtgagaggcgccctgagagagttcctgcaggagctgagaagcgcccagagagagagagacgagctgagaacccagaccagcgccctgaacagacagctggccgagatggaggccgagagagacagcgccaccagcagagccagacagctgcagaaggccgtggccgagagcgaggaggccagaagaagcgtggacggcagactgagcggcgtgcaggccgagctggccctgcaggaggagagcgtgagaagaagcgagagagagagaagagccaccctggaccaggtggccaccctggagagaagcctgcaggccaccgagagcgagctgagagccagccaggagaagatcagcaagatgaaggccaacgagaccaagctggagggcgacaagagaagactgaaggaggtgctggacgccagcgagagcagaaccgtgaagctggagctgcagagaagaagcctggagggcgagctgcagagaagcagactgggcctgagcgacagagaggcccaggcccaggccctgcaggacagagtggacagcctgcagagacaggtggccgacagcgaggtgaaggccggcaccctgcagctgaccgtggagagactgaacggcgccctggccaaggtggaggagagcgagggcgccctgagagacaaggtgagaggcctgaccgaggccctggcccagagcagcgccagcctgaacagcaccagagacaagaacctgcacctgcagaaggccctgaccgcctgcgagcacgacagacaggtgctgcaggagagactggacgccgccagacaggccctgagcgaggccagaaagcagagcagcagcctgggcgagcaggtgcagaccctgagaggcgaggtggccgacctggagctgcagagagtggaggccgagggccagctgcagcagctgagagaggtgctgagacagagacaggagggcgaggccgccgccctgaacaccgtgcagaagctgcaggacgagagaagactgctgcaggagagactgggcagcctgcagagagccctggcccagctggaggccgagaagagagaggtggagagaagcgccctgagactggagaaggacagagtggccctgagaagaaccctggacaaggtggagagagagaagctgagaagccacgaggacaccgtgagactgagcgccgagaagggcagactggacagaaccctgaccggcgccgagctggagctggccgaggcccagagacagatccagcagctggaggcccaggtggtggtgctggagcagagccacagccccgcccagctggaggtggacgcccagcagcagcagctggagctgcagcaggaggtggagagactgagaagcgcccaggcccagaccgagagaaccctggaggccagagagagagcccacagacagagagtgagaggcctggaggagcaggtgagcaccctgaagggccagctgcagcaggagctgagaagaagcagcgcccccttcagcccccccagcggcccccccgagaagtag

SEQ ID NO: 17501 - DNA, 3612 bp, Artificial Sequence
  Description of Artificial Sequence: Synthetic coding sequence
atggagcaggcccccaacatggccgagcccagaggccccgtggaccacggcgtgcagatcagattcatcaccgagcccgtgagcggcgccgagatgggcaccctgagaagaggcggcagaagacccgccaaggacgccagagccagcacctacggcgtggccgtgagagtgcagggcatcgccggccagcccttcgtggtgctgaacagcggcgagaagggcggcgacagcttcggcgtgcagatcaagggcgccaacgaccagggcgccagcggcgccctgagcagcgacctggagctgcccgagaacccctacagccaggtgaagggcttccccgcccccagccagagcagcaccagcgacgaggagcccggcgcctactggaacggcaagctgctgagaagccacagccaggccagcctggccggccccggccccgtggaccccagcaacagaagcaacagcatgctggagctggcccccaaggtggccagccccggcagcaccatcgacaccgcccccctgagcagcgtggacagcctgatcaacaagttcgacagccagctgggcggccaggccagaggcagaaccggcagaagaaccagaatgctgccccccgagcagagaaagagaagcaagagcctggacagcagactgcccagagacaccttcgaggagagagagagacagagcaccaaccactggaccagcagcaccaagtacgacaaccacgtgggcaccagcaagcagcccgcccagagccagaacctgagccccctgagcggcttcagcagaagcagacagacccaggactgggtgctgcagagcttcgaggagcccagaagaagcgcccaggaccccaccatgctgcagttcaagagcacccccgacctgctgagagaccagcaggaggccgccccccccggcagcgtggaccacatgaaggccaccatctacggcatcctgagagagggcagcagcgagagcgagaccagcgtgagaagaaaggtgagcctggtgctggagaagatgcagcccctggtgatggtgagcagcggcagcaccaaggccgtggccggccagggcgagctgaccagaaaggtggaggagctgcagagaaagctggacgaggaggtgaagaagagacagaagctggagcccagccaggtgggcctggagagacagctggaggagaagaccgaggagtgcagcagactgcaggagctgctggagagaagaaagggcgaggcccagcagagcaacaaggagctgcagaacatgaagagactgctggaccagggcgaggacctgagacacggcctggagacccaggtgatggagctgcagaacaagctgaagcacgtgcagggccccgagcccgccaaggaggtgctgctgaaggacctgctggagaccagagagctgctggaggaggtgctggagggcaagcagagagtggaggagcagctgagactgagagagagagagctgaccgccctgaagggcgccctgaaggaggaggtggccagcagagaccaggaggtggagcacgtgagacagcagtaccagagagacaccgagcagctgagaagaagcatgcaggacgccacccaggaccacgccgtgctggaggccgagagacagaagatgagcgccctggtgagaggcctgcagagagagctggaggagaccagcgaggagaccggccactggcagagcatgttccagaagaacaaggaggacctgagagccaccaagcaggagctgctgcagctgagaatggagaaggaggagatggaggaggagctgggcgagaagatcgaggtgctgcagagagagctggagcaggccagagccagcgccggcgacaccagacaggtggaggtgctgaagaaggagctgctgagaacccaggaggagctgaaggagctgcaggccgagagacagagccaggaggtggccggcagacacagagacagagagctggagaagcagctggccgtgctgagagtggaggccgacagaggcagagagctggaggagcagaacctgcagctgcagaagaccctgcagcagctgagacaggactgcgaggaggccagcaaggccaagatggtggccgaggccgaggccaccgtgctgggccagagaagagccgccgtggagaccaccctgagagagacccaggaggagaacgacgagttcagaagaagaatcctgggcctggagcagcagctgaaggagaccagaggcctggtggacggcggcgaggccgtggaggccagactgagagacaagctgcagagactggaggccgagaagcagcagctggaggaggccctgaacgccagccaggaggaggagggcagcctggccgccgccaagagagccctggaggccagactggaggaggcccagagaggcctggccagactgggccaggagcagcagaccctgaacagagccctggaggaggagggcaagcagagagaggtgctgagaagaggcaaggccgagctggaggagcagaagagactgctggacagaaccgtggacagactgaacaaggagctggagaagatcggcgaggacagcaagcaggccctgcagcagctgcaggcccagctggaggactacaaggagaaggccagaagagaggtggccgacgcccagagacaggccaaggactgggccagcgaggccgagaagaccagcggcggcctgagcagactgcaggacgagatccagagactgagacaggccctgcaggccagccaggccgagagagacaccgccagactggacaaggagctgctggcccagagactgcagggcctggagcaggaggccgagaacaagaagagaagccaggacgacagagccagacagctgaagggcctggaggagaaggtgagcagactggagaccgagctggacgaggagaagaacaccgtggagctgctgaccgacagagtgaacagaggcagagaccaggtggaccagctgagaaccgagctgatgcaggagagaagcgccagacaggacctggagtgcgacaagatcagcctggagagacagaacaaggacctgaagaccagactggccagcagcgagggcttccagaagcccagcgccagcctgagccagctggagagccagaaccagctgctgcaggagagactgcaggccgaggagagagagaagaccgtgctgcagagcaccaacagaaagctggagagaaaggtgaaggagctgagcatccagatcgaggacgagagacagcacgtgaacgaccagaaggaccagctgagcctgagagtgaaggccctgaagagacaggtggacgaggccgaggaggagatcgagagactggacggcctgagaaagaaggcccagagagaggtggaggagcagcacgaggtgaacgagcagctgcaggccagaatcaagagcctggagaaggacagctggagaaaggccagcagaagcgccgccgagagcgccctgaagaacgagggcctgagcagcgacgaggagttcgacagcgtgtacgaccccagcagcatcgccagcctgctgaccgagagcaacctgcagaccagcagctgctag

SEQ ID NO: 17502 - DNA, 876 bp, Artificial Sequence
  Description of Artificial Sequence: Synthetic coding sequence
atggagcaggcccccaacatggccgagcccagaggccccgtggaccacggcgtgcagatcagattcatcaccgagcccgtgagcggcgccgagatgggcaccctgagaagaggcggcagaagacccgccaaggacgccagagccagcacctacggcgtggccgtgagagtgcagggcatcgccggccagcccttcgtggtgctgaacagcggcgagaagggcggcgacagcttcggcgtgcagatcaagggcgccaacgaccagggcgccagcggcgccctgagcagcgacctggagctgcccgagaacccctacagccaggtgaagggcttccccgcccccagccagagcagcaccagcgacgaggagcccggcgcctactggaacggcaagctgctgagaagccacagccaggccagcctggccggccccggccccgtggaccccagcaacagaagcaacagcatgctggagctggcccccaaggtggccagccccggcagcaccatcgacaccgcccccctgagcagcgtggacagcctgatcaacaagttcgacagccagctgggcggccaggccagaggcagaaccggcagaagaaccagaatgctgccccccgagcagagaaagagaagcaagagcctggacagcagactgcccagagacaccttcgaggagagagagagacagagcaccaaccactggaccagcagcaccaagtacgacaaccacgtgggcaccagcaagcagcccgcccagagccagaacctgagccccctgagcggcttcagcagaagcagacagacccaggactgggtgctgcagagcttcgaggagcccagaagaagcgcccaggaccccaccatgctgcagtag

SEQ ID NO: 17503 - DNA, 513 bp, Artificial Sequence
  Description of Artificial Sequence: Synthetic coding sequence
atggagcaggcccccaacatggccgagcccagaggccccgtggaccacggcgtgcagatcagattcatcaccgagcccgtgagcggcgccgagatgggcaccctgagaagaggcggcagaagacccgccaaggacgccagagccagcacctacggcgtggccgtgagagtgcagggcatcgccggccagcccttcgtggtgctgaacagcggcgagaagggcggcgacagcttcggcgtgcagatcaagggcgccaacgaccagggcgccagcggcgccctgagcagcgacctggagctgcccgagaacccctacagccaggtgaagggcttccccgcccccagccagagcagcaccagcgacgaggagcccggcgcctactggaacggcaagctgctgagaagccacagccaggccagcctggccggccccggccccgtggaccccagcaacagaagcaacagcatgctggagctggcccccaaggtggccagccccggcagcaccatctag

SEQ ID NO: 17504 - DNA, 513 bp, Artificial Sequence; identical to SEQ ID NO: 17503
  Description of Artificial Sequence: Synthetic coding sequence

SEQ ID NO: 17505 - DNA, 699 bp, Artificial Sequence
  Description of Artificial Sequence: Synthetic coding sequence
atgcccggctggttcaagaaggcctggtacggcctggccagcctgctgagcttcagcagcttcatcctgatcatcgtggccctggtggtgccccactggctgagcggcaagatcctgtgccagaccggcgtggacctggtgaacgccaccgacagagagctggtgaagttcatcggcgacatctactacggcctgttcagaggctgcaaggtgagacagtgcggcctgggcggcagacagagccagttcaccatcttcccccacctggtgaaggagctgaacgccggcctgcacgtgatgatcctgctgctgctgttcctggccctggccctggccctggtgagcatgggcttcgccatcctgaacatgatccaggtgccctacagagccgtgagcggccccggcggcatctgcctgtggaacgtgctggccggcggcgtggtggccctggccatcgccagcttcgtggccgccgtgaagttccacgacctgaccgagagaatcgccaacttccaggagaagctgttccagttcgtggtggtggaggagcagtacgaggagagcttctggatctgcgtggccagcgccagcgcccacgccgccaacctggtggtggtggccatcagccagatccccctgcccgagatcaagaccaagatcgaggaggccaccgtgaccgccgaggacatcctgtactag

SEQ ID NO: 17506 - DNA, 681 bp, Artificial Sequence
  Description of Artificial Sequence: Synthetic coding sequence
atgcccaccaccaagaagaccctgatgttcctgagcagcttcttcaccagcctgggcagcttcatcgtgatctgcagcatcctgggcacccaggcctggatcaccagcaccatcgccgtgagagacagcgccagcaacggcagcatcttcatcacctacggcctgttcagaggcgagagcagcgaggagctgagccacggcctggccgagcccaagaagaagttcgccgtgctggagatcctgaacaacagcagccagaagaccctgcacagcgtgaccatcctgttcctggtgctgagcctgatcaccagcctgctgagcagcggcttcaccttctacaacagcatcagcaacccctaccagaccttcctgggccccaccggcgtgtacacctggaacggcctgggcgccagcttcgtgttcgtgaccatgatcctgttcgtggccaacacccagagcaaccagctgagcgaggagctgttccagatgctgtaccccgccaccaccagcaagggcaccacccacagctacggctacagcttctggctgatcctgctggtgatcctgctgaacatcgtgaccgtgaccatcatcatcttctaccagaaggccagataccagagaaagcaggagcagagaaagcccatggagtacgcccccagagacggcatcctgttctag

SEQ ID NO: 17507 - DNA, 687 bp, Artificial Sequence
  Description of Artificial Sequence: Synthetic coding sequence
atggccagcaccgccagcgagatcatcgccttcatggtgagcatcagcggctgggtgctggtgagcagcaccctgcccaccgactactggaaggtgagcaccatcgacggcaccgtgatcaccaccgccacctactgggccaacctgtggaaggcctgcgtgaccgacagcaccggcgtgagcaactgcaaggacttccccagcatgctggccctggacggctacatccaggcctgcagaggcctgatgatcgccgccgtgagcctgggcttcttcggcagcatcttcgccctgttcggcatgaagtgcaccaaggtgggcggcagcgacaaggccaaggccaagatcgcctgcctggccggcatcgtgttcatcctgagcggcctgtgcagcatgaccggctgcagcctgtacgccaacaagatcaccaccgagttcttcgaccccctgttcgtggagcagaagtacgagctgggcgccgccctgttcatcggctgggccggcgccagcctgtgcatcatcggcggcgtgatcttctgcttcagcatcagcgacaacaacaagacccccagatacacctacaacggcgccaccagcgtgatgagcagcagaaccaagtaccacggcggcgaggacttcaagaccaccaaccccagcaagcagttcgacaagaacgcctacgtgtag

SEQ ID NO: 17508 - DNA, 222 bp, Artificial Sequence
  Description of Artificial Sequence: Synthetic coding sequence
atgatcgccgccgtgagcctgggcttcttcggcagcatcttcgccctgttcggcatgaagtgcaccaaggtgggcggcagcgacaaggccaaggccaagatcgcctgcctggccggcatcgtgttcatcctgagcggcctgtgcagcatgaccggctgcagcctgtacgccaacaagatcaccaccgagttcttcgaccccctgttcgtggagcagaagtag

SEQ ID NO: 17509 - DNA, 681 bp, Artificial Sequence
  Description of Artificial Sequence: Synthetic coding sequence
atgagcagagcccagatctgggccctggtgagcggcgtgggcggcttcggcgccctggtggccgccaccaccagcaacgagtggaaggtgaccaccagagccagcagcgtgatcaccgccacctgggtgtaccagggcctgtggatgaactgcgccggcaacgccctgggcagcttccactgcagaccccacttcaccatcttcaaggtggccggctacatccaggcctgcagaggcctgatgatcgccgccgtgagcctgggcttcttcggcagcatcttcgccctgttcggcatgaagtgcaccaaggtgggcggcagcgacaaggccaaggccaagatcgcctgcctggccggcatcgtgttcatcctgagcggcctgtgcagcatgaccggctgcagcctgtacgccaacaagatcaccaccgagttcttcgaccccctgttcgtggagcagaagtacgagctgggcgccgccctgttcatcggctgggccggcgccagcctgtgcatcatcggcggcgtgatcttctgcttcagcatcagcgacaacaacaagacccccagatacacctacaacggcgccaccagcgtgatgagcagcagaaccaagtaccacggcggcgaggacttcaagaccaccaaccccagcaagcagttcgacaagaacgcctacgtgtag

SEQ ID NO: 17510 - DNA, 735 bp, Artificial Sequence
  Description of Artificial Sequence: Synthetic coding sequence
atgggctgcagagacgtgcacgccgccaccgtgctgagcttcctgtgcggcatcgccagcgtggccggcctgttcgccggcaccctgctgcccaactggagaaagctgagactgatcaccttcaacagaaacgagaagaacctgaccgtgtacaccggcctgtgggtgaagtgcgccagatacgacggcagcagcgactgcctgatgtacgacaccacctggtacagcagcgtggaccagctggacctgagagtgctgcagttcgccctgcccctgagcatgctgatcgccatgggcgccctgctgctgtgcctgatcggcatgtgcaacaccgccttcagaagcagcgtgcccaacatcaagctggccaagtgcctggtgaacagcgccggctgccacctggtggccggcctgctgttcttcctggccggcaccgtgagcctgagccccagcatctgggtgatcttctacaacatccacctgaacaagaagttcgagcccgtgttcagcttcgactacgccgtgtacgtgaccatcgccagcgccggcggcctgttcatgaccagcctgatcctgttcatctggtactgcacctgcaagagcctgcccagccccttctggcagcccctgtacagccacccccccagcatgcacacctacagccagccctacagcgccagaagcagactgagcgccatcgagatcgacatccccgtggtgagccacaccacctag

SEQ ID NO: 17511 - DNA, 564 bp, Artificial Sequence
  Description of Artificial Sequence: Synthetic coding sequence
atgggctgcagagacgtgcacgccgccaccgtgctgagcttcctgtgcggcatcgccagcgtggccggcctgttcgccggcaccctgctgcccaactggagaaagctgagactgatcaccttcaacagaaacgagaagaacctgaccgtgtacaccggcctgtgggtgaagtgcgccagatacgacggcagcagcgactgcctgatgtacgacaccacctggtacagcagcgtggaccagctggacctgagagtgctgcagttcgccctgcccctgagcatgctgatcgccatgggcgccctgctgctgtgcctgatcggcatgtgcaacaccgccttcagaagcagcgtgcccaacatcaagctggccaagtgcctggtgaacagcgccggctgccacctggtggccggcctgctgttcttcctggccggcaccgtgagcctgagccccagcatctgggtgatcttctacaacatccacctgaacaagaagttcgagcccgtgttcagcttcgactacgccgtgtacgtgaccatcgccagcgccggcggcctgttcatgtag

SEQ ID NO: 17512 - DNA, 735 bp, Artificial Sequence; identical to SEQ ID NO: 17510
  Description of Artificial Sequence: Synthetic coding sequence

SEQ ID NO: 17513 - DNA, 528 bp, Artificial Sequence
  Description of Artificial Sequence: Synthetic coding sequence
atgggctgcagagacgtgcacgccgccaccgtgctgagcttcctgtgcggcatcgccagcgtggccggcctgttcgccggcaccctgctgcccaactggagaaagctgagactgatcaccttcaacagaaacgagaagaacctgaccgtgtacaccggcctgtgggtgaagtgcgccagatacgacggcagcagcgactgcctgatgtacgacaccacctggtacagcagcgtggaccagctggacctgagagtgctgcagttcgccctgcccctgagcatgctgatcgccatgggcgccctgctgctgtgcctgatcggcatgtgcaacaccgccttcagaagcagcgtgcccaacatcaagctggccaagtgcctggtgaacagcgccggctgccacctggtggccggcctgctgttcttcctggccggcaccgtgagcctgagccccagcatctgggtgatcttctacaacatccacctgaacaagaagttcgagcccgtgttcagcttcgactacgccgtgtag

SEQ ID NO: 17514 - DNA, 528 bp, Artificial Sequence; identical to SEQ ID NO: 17513
  Description of Artificial Sequence: Synthetic coding sequence

SEQ ID NO: 17515 - DNA, 381 bp, Artificial Sequence
  Description of Artificial Sequence: Synthetic coding sequence
atgggctgcagagacgtgcacgccgccaccgtgctgagcttcctgtgcggcatcgccagcgtggccggcctgttcgccggcaccctgctgcccaactggagaaagctgagactgatcaccttcaacagaaacgagaagaacctgaccgtgtacaccggcctgtgggtgaagtgcgccagatacgacggcagcagcgactgcctgatgtacgacaccacctggtacagcagcgtggaccagctggacctgagagtgctgcagttcgccctgcccctgagcatgctgatcgccatgggcgccctgctgctgtgcctgatcggcatgtgcaacaccgccttcagaagcagcgtgcccaacatcaagctggccaagtgcctgtag

SEQ ID NO: 17516 - DNA, 735 bp, Artificial Sequence; identical to SEQ ID NO: 17510
  Description of Artificial Sequence: Synthetic coding sequence

SEQ ID NO: 17517 - DNA, 735 bp, Artificial Sequence; identical to SEQ ID NO: 17510
  Description of Artificial Sequence: Synthetic coding sequence

SEQ ID NO: 17518 - DNA, 687 bp, Artificial Sequence
  Description of Artificial Sequence: Synthetic coding sequence
atgagcatggccgtggagaccttcggcttcttcatggccaccgtgggcctgctgatgctgggcgtgaccctgcccaacagctactggagagtgagcaccgtgcacggcaacgtgatcaccaccaacaccatcttcgagaacctgtggttcagctgcgccaccgacagcctgggcgtgtacaactgctgggagttccccagcatgctggccctgagcggctacatccaggcctgcagagccctgatgatcaccgccatcctgctgggcttcctgggcctgctgctgggcatcgccggcctgagatgcaccaacatcggcggcctggagctgagcagaaaggccaagctggccgccaccgccggcgccctgcacatcctggccggcatctgcggcatggtggccatcagctggtacgccttcaacatcaccagagacttcttcgaccccctgtaccccggcaccaagtacgagctgggccccgccctgtacctgggctggagcgccagcctgatcagcatcctgggcggcctgtgcctgtgcagcgcctgctgctgcggcagcgacgaggaccccgccgccagcgccagaagaccctaccaggcccccgtgagcgtgatgcccgtggccaccagcgaccaggagggcgacagcagcttcggcaagtacggcagaaacgcctacgtgtag

SEQ ID NO: 17519 - DNA, 687 bp, Artificial Sequence; identical to SEQ ID NO: 17518
  Description of Artificial Sequence: Synthetic coding sequence

SEQ ID NO: 17520 - DNA, 675 bp, Artificial Sequence
  Description of Artificial Sequence: Synthetic coding sequence
atggccttctaccccctgcagatcgccggcctggtgctgggcttcctgggcatggtgggcaccctggccaccaccctgctgccccagtggagagtgagcgccttcgtgggcagcaacatcatcgtgttcgagagactgtgggagggcctgtggatgaactgcatcagacaggccagagtgagactgcagtgcaagttctacagcagcctgctggccctgccccccgccctggagaccgccagagccctgatgtgcgtggccgtggccctgagcctgatcgccctgctgatcggcatctgcggcatgaagcaggtgcagtgcaccggcagcaacgagagagccaaggcctacctgctgggcaccagcggcgtgctgttcatcctgaccggcatcttcgtgctgatccccgtgagctggaccgccaacatcatcatcagagacttctacaaccccgccatccacatcggccagaagagagagctgggcgccgccctgttcctgggctgggccagcgccgccgtgctgttcatcggcggcggcctgctgtgcggcttctgctgctgcaacagaaagaagcagggctacagataccccgtgcccggctacagagtgccccacaccgacaagagaagaaacaccaccatgctgagcaagaccagcaccagctacgtgtag

SEQ ID NO: 17521 - DNA, 693 bp, Artificial Sequence
  Description of Artificial Sequence: Synthetic coding sequence
atggccagcctgggcctgcagctggtgggctacatcctgggcctgctgggcctgctgggcaccctggtggccatgctgctgcccagctggaagaccagcagctacgtgggcgccagcatcgtgaccgccgtgggcttcagcaagggcctgtggatggagtgcgccacccacagcaccggcatcacccagtgcgacatctacagcaccctgctgggcctgcccgccgacatccaggccgcccaggccatgatggtgaccagcagcgccatcagcagcctggcctgcatcatcagcgtggtgggcatgagatgcaccgtgttctgccaggagagcagagccaaggacagagtggccgtggccggcggcgtgttcttcatcctgggcggcctgctgggcttcatccccgtggcctggaacctgcacggcatcctgagagacttctacagccccctggtgcccgacagcatgaagttcgagatcggcgaggccctgtacctgggcatcatcagcagcctgttcagcctgatcgccggcatcatcctgtgcttcagctgcagcagccagagaaacagaagcaactactacgacgcctaccaggcccagcccctggccaccagaagcagccccagacccggccagccccccaaggtgaagagcgagttcaacagctacagcctgaccggctacgtgtag

SEQ ID NO: 17522 - DNA, 693 bp, Artificial Sequence; identical to SEQ ID NO: 17521
  Description of Artificial Sequence: Synthetic coding sequence

SEQ ID NO: 17523 - DNA, 693 bp, Artificial Sequence; identical to SEQ ID NO: 17521
  Description of Artificial Sequence: Synthetic coding sequence

SEQ ID NO: 17524 - DNA, 660 bp, Artificial Sequence
  Description of Artificial Sequence: Synthetic coding sequence
atggccagcgccggcctgcagctgctggccttcatcctggccctgagcggcgtgagcggcgtgctgaccgccaccctgctgcccaactggaaggtgaacgtggacgtggacagcaacatcatcaccgccatcgtgcagctgcacggcctgtggatggactgcacctggtacagcaccggcatgttcagctgcgccctgaagcacagcatcctgagcctgcccatccacgtgcaggccgccagagccaccatggtgctggcctgcgtgctgagcgccctgggcatctgcaccagcaccgtgggcatgaagtgcaccagactgggcggcgacagagagaccaagagccacgccagcttcgccggcggcgtgtgcttcatgagcgccggcatcagcagcctgatcagcaccgtgtggtacaccaaggagatcatcgccaacttcctggacctgaccgtgcccgagagcaacaagcacgagcccggcggcgccatctacatcggcttcatcagcgccatgctgctgttcatcagcggcatgatcttctgcaccagctgcatcaagagaaaccccgaggccagactggacccccccacccagcagcccatcagcaacacccagctggagaacaacagcacccacaacctgaaggactacgtgtag

SEQ ID NO: 17525 - DNA, 663 bp, Artificial Sequence
  Description of Artificial Sequence: Synthetic coding sequence
atggccctggtgttcagaaccgtggcccagctggccggcgtgagcctgagcctgctgggctgggtgctgagctgcctgaccaactacctgccccactggaagaacctgaacctggacctgaacgagatggagaactggaccatgggcctgtggcagacctgcgtgatccaggaggaggtgggcatgcagtgcaaggacttcgacagcttcctggccctgcccgccgagctgagagtgagcagaatcctgatgttcctgagcaacggcctgggcttcctgggcctgctggtgagcggcttcggcctggactgcctgagaatcggcgagagccagagagacctgaagagaagactgctgatcctgggcggcatcctgagctgggccagcggcgtgaccgccctggtgcccgtgagctgggtggcccacaagaccgtgcaggagttctgggacgagaacgtgcccgacttcgtgcccagatgggagttcggcgaggccctgttcctgggctggttcgccggcctgagcctgctgctgggcggctgcctgctgcactgcgccgcctgcagcagccacgcccccctggccagcggccactacgccgtggcccagacccaggaccaccaccaggagctggagaccagaaacaccaacctgaagcactag

SEQ ID NO: 17526 - DNA, 879 bp, Artificial Sequence
  Description of Artificial Sequence: Synthetic coding sequence
atgagaacccccgtggtgatgaccctgggcatggtgctggccccctgcggcctgctgctgaacctgaccggcaccctggcccccggctggagactggtgaagggcttcctgaaccagcccgtggacgtggagctgtaccagggcctgtgggacatgtgcagagagcagagcagcagagagagagagtgcggccagaccgaccagtggggctacttcgaggcccagcccgtgctggtggccagagccctgatggtgaccagcctggccgccaccgtgctgggcctgctgctggccagcctgggcgtgagatgctggcaggacgagcccaacttcgtgctggccggcctgagcggcgtggtgctgttcgtggccggcctgctgggcctgatccccgtgagctggtacaaccacttcctgggcgacagagacgtgctgcccgcccccgccagccccgtgaccgtgcaggtgagctacagcctggtgctgggctacctgggcagctgcctgctgctgctgggcggcttcagcctggccctgagcttcgccccctggtgcgacgagagatgcagaagaagaagaaagggccccagcgccggccccagaagaagcagcgtgagcaccatccaggtggagtggcccgagcccgacctggcccccgccatcaagtactacagcgacggccagcacagacccccccccgcccagcacagaaagcccaagcccaagcccaaggtgggcttccccatgcccagacccagacccaaggcctacaccaacagcgtggacgtgctggacggcgagggctgggagagccaggacgcccccagctgcagcacccacccctgcgacagcagcctgccctgcgacagcgacctgtag

SEQ ID NO: 17527 - DNA, 690 bp, Artificial Sequence
  Description of Artificial Sequence: Synthetic coding sequence
atggcctggagcttcagagccaaggtgcagctgggcggcctgctgctgagcctgctgggctgggtgtgcagctgcgtgaccaccatcctgccccagtggaagaccctgaacctggagctgaacgagatggagacctggatcatgggcatctgggaggtgtgcgtggacagagaggaggtggccaccgtgtgcaaggccttcgagagcttcctgagcctgccccaggagctgcaggtggccagaatcctgatggtggccagccacggcctgggcctgctgggcctgctgctgtgcagcttcggcagcgagtgcttccagttccacagaatcagatgggtgttcaagagaagactgggcctgctgggcagaaccctggaggccagcgccagcgccaccaccctgctgcccgtgagctgggtggcccacgccaccatccaggacttctgggacgacagcatccccgacatcatccccagatgggagttcggcggcgccctgtacctgggctgggccgccggcatcttcctggccctgggcggcctgctgctgatcttcagcgcctgcctgggcaaggaggacgtgcccttccccctgatggccggccccaccgtgcccctgagctgcgcccccgtggaggagagcgacggcagcttccacctgatgctgagacccagaaacctggtgatctag

SEQ ID NO: 17528 - DNA, 663 bp, Artificial Sequence
  Description of Artificial Sequence: Synthetic coding sequence
atggccagcgccggcatgcagatcctgggcgtggtgctgaccctgctgggctgggtgaacggcctggtgagctgcgccctgcccatgtggaaggtgaccgccttcatcggcaacagcatcgtggtggcccaggtggtgtgggagggcctgtggatgagctgcgtggtgcagagcaccggccagatgcagtgcaaggtgtacgacagcctgctggccctgccccaggacctgcaggccgccagagccctgtgcgtgatcgccctgctggtggccctgttcggcctgctggtgtacctggccggcgccaagtgcaccacctgcgtggaggagaaggacagcaaggccagactggtgctgaccagcggcatcgtgttcgtgatcagcggcgtgctgaccctgatccccgtgtgctggaccgcccacgccatcatcagagacttctacaaccccctggtggccgaggcccagaagagagagctgggcgccagcctgtacctgggctgggccgccagcggcctgctgctgctgggcggcggcctgctgtgctgcacctgccccagcggcggcagccagggccccagccactacatggccagatacagcaccagcgcccccgccatcagcagaggccccagcgagtaccccaccaagaactacgtgtag

SEQ ID NO: 17529 - DNA, 663 bp, Artificial Sequence; identical to SEQ ID NO: 17528
  Description of Artificial Sequence: Synthetic coding sequence

SEQ ID NO: 17530 - DNA, 636 bp, Artificial Sequence
  Description of Artificial Sequence: Synthetic coding sequence
atggccaacagcggcctgcagctgctgggcttcagcatggccctgctgggctgggtgggcctggtggcctgcaccgccatcccccagtggcagatgagcagctacgccggcgacaacatcatcaccgcccaggccatgtacaagggcctgtggatggactgcgtgacccagagcaccggcatgatgagctgcaagatgtacgacagcgtgctggccctgagcgccgccctgcaggccaccagagccctgatggtggtgagcctggtgctgggcttcctggccatgttcgtggccaccatgggcatgaagtgcaccagatgcggcggcgacgacaaggtgaagaaggccagaatcgccatgggcggcggcatcatcttcatcgtggccggcctggccgccctggtggcctgcagctggtacggccaccagatcgtgaccgacttctacaaccccctgatccccaccaacatcaagtacgagttcggccccgccatcttcatcggctgggccggcagcgccctggtgatcctgggcggcgccctgctgagctgcagctgccccggcaacgagagcaaggccggctacagagtgcccagaagctaccccaagagcaacagcagcaaggagtacgtgtag

SEQ ID NO: 17531 - DNA, 636 bp, Artificial Sequence; identical to SEQ ID NO: 17530
  Description of Artificial Sequence: Synthetic coding sequence

SEQ ID NO: 17532 - DNA, 438 bp, Artificial Sequence
  Description of Artificial Sequence: Synthetic coding sequence
atggccaacagcggcctgcagctgctgggcttcagcatggccctgctgggctgggtgggcctggtggcctgcaccgccatcccccagtggcagatgagcagctacgccggcgacaacatcatcaccgcccaggccatgtacaagggcctgtggatggactgcgtgacccagagcaccggcatgatgagctgcaagatgtacgacagcgtgctggccctgagcgccgccctgcaggccaccagagccctgatggtggtgagcctggtgctgggcttcctggccatgttcgtggccaccatgggcatgaagtgcaccagatgcggcggcgacgacaaggtgaagaaggccagaatcgccatgggcggcggcatcatcttcatcgtggccggcatgagcctggccctgcccagcctgctggccggccagggcctgccctag

SEQ ID NO: 17533 - DNA, 678 bp, Artificial Sequence
  Description of Artificial Sequence: Synthetic coding sequence
atggccacccacgccctggagatcgccggcctgttcctgggcggcgtgggcatggtgggcaccgtggccgtgaccgtgatgccccagtggagagtgagcgccttcatcgagaacaacatcgtggtgttcgagaacttctgggagggcctgtggatgaactgcgtgagacaggccaacatcagaatgcagtgcaagatctacgacagcctgctggccctgagccccgacctgcaggccgccagaggcctgatgtgcgccgccagcgtgatgagcttcctggccttcatgatggccatcctgggcatgaagtgcaccagatgcaccggcgacaacgagaaggtgaaggcccacatcctgctgaccgccggcatcatcttcatcatcaccggcatggtggtgctgatccccgtgagctgggtggccaacgccatcatcagagacttctacaacagcatcgtgaacgtggcccagaagagagagctgggcgaggccctgtacctgggctggaccaccgccctggtgctgatcgtgggcggcgccctgttctgctgcgtgttctgctgcaacgagaagagcagcagctacagatacagcatccccagccacagaaccacccagaagagctaccacaccggcaagaagagccccagcgtgtacagcagaagccagtacgtgtag

SEQ ID NO: 17534 - DNA, 678 bp, Artificial Sequence; identical to SEQ ID NO: 17533
  Description of Artificial Sequence: Synthetic coding sequence

SEQ ID NO: 17535 - DNA, 702 bp, Artificial Sequence
  Description of Artificial Sequence: Synthetic coding sequence
atggccacccacgccctggagatcgccggcctgttcctgggcggcgtgggcatggtgggcaccgtggccgtgaccgtgatgccccagtggagagtgagcgccttcatcgagaacaacatcgtggtgttcgagaacttctgggagggcctgtggatgaactgcgtgagacaggccaacatcagaatgcagtgcaagatctacgacagcctgctggccctgagccccgacctgcaggccgccagaggcctgatgtgcgccgccagcgtgatgagcttcctggccttcatgatggccatcctgggcatgaagtgcaccagatgcaccggcgacaacgagaaggtgaaggcccacatcctgctgaccgccggcatcatcttcatcatcaccggcatggtggtgctgatccccgtgagctgggtggccaacgccatcatcagagacttctacaacagcatcgtgaacgtggcccagaagagagagctgggcgaggccctgtacctgggctggaccaccgccctggtgctgatcgtgggcggcgccctgttctgctgcgtgttctgctgcaacgagaagagcagcagctacagatacagcatccccagccacagaaccacccagaagagctaccacaccggcaagaagagcagactgctgcagaagagcgtgtgcgtggtggtgtacgtgttcctgaccctgctgtag

SEQ ID NO: 17536 - DNA, 654 bp, Artificial Sequence
  Description of Artificial Sequence: Synthetic coding sequence
atggccagcaccggcctggagctgctgggcatgaccctggccgtgctgggctggctgggcaccctggtgagctgcgccctgcccctgtggaaggtgaccgccttcatcggcaacagcatcgtggtggcccaggtggtgtgggagggcctgtggatgagctgcgtggtgcagagcaccggccagatgcagtgcaaggtgtacgacagcctgctggccctgccccaggacctgcaggccgccagagccctgtgcgtgatcgccctgctgctggccctgctgggcctgctggtggccatcaccggcgcccagtgcaccacctgcgtggaggacgagggcgccaaggccagaatcgtgctgaccgccggcgtgatcctgctgctggccggcatcctggtgctgatccccgtgtgctggaccgcccacgccatcatccaggacttctacaaccccctggtggccgaggccctgaagagagagctgggcgccagcctgtacctgggctgggccgccgccgccctgctgatgctgggcggcggcctgctgtgctgcacctgcccccccccccaggtggagagacccagaggccccagactgggctacagcatccccagcagaagcggcgccagcggcctggacaagagagactacgtgtag

SEQ ID NO: 17537 - DNA, 762 bp, Artificial Sequence
  Description of Artificial Sequence: Synthetic coding sequence
atggacaacagattcgccaccgccttcgtgatcgcctgcgtgctgagcctgatcagcaccatctacatggccgccagcatcggcaccgacttctggtacgagtacagaagccccgtgcaggagaacagcagcgacctgaacaagagcatctgggacgagttcatcagcgacgaggccgacgagaagacctacaacgacgccctgttcagatacaacggcaccgtgggcctgtggagaagatgcatcaccatccccaagaacatgcactggtacagcccccccgagagaaccgagagcttcgacgtggtgaccaagtgcgtgagcttcaccctgaccgagcagttcatggagaagttcgtggaccccggcaaccacaacagcggcatcgacctgctgagaacctacctgtggagatgccagttcctgctgcccttcgtgagcctgggcctgatgtgcttcggcgccctgatcggcctgtgcgcctgcatctgcagaagcctgtaccccaccatcgccaccggcatcctgcacctgctggccggcctgtgcaccctgggcagcgtgagctgctacgtggccggcatcgagctgctgcaccagaagctggagctgcccgacaacgtgagcggcgagttcggctggagcttctgcctggcctgcgtgagcgcccccctgcagttcatggccagcgccctgttcatctgggccgcccacaccaacagaaaggagtacaccctgatgaaggcctacagagtggcctag

SEQ ID NO: 17538 - DNA, 762 bp, Artificial Sequence; identical to SEQ ID NO: 17537
  Description of Artificial Sequence: Synthetic coding sequence

SEQ ID NO: 17539 - DNA, 762 bp, Artificial Sequence; identical to SEQ ID NO: 17537
  Description of Artificial Sequence: Synthetic coding sequence

SEQ ID NO: 17540 - DNA, 762 bp, Artificial Sequence; identical to SEQ ID NO: 17537
  Description of Artificial Sequence: Synthetic coding sequence

SEQ ID NO: 17541 - DNA, 831 bp, Artificial Sequence
  Description of Artificial Sequence: Synthetic coding sequence
atgggcggcgacagactggagaacaagaccagcgtgagcgtggccagctggagcagcctgaacgccagaatggacaacagattcgccaccgccttcgtgatcgcctgcgtgctgagcctgatcagcaccatctacatggccgccagcatcggcaccgacttctggtacgagtacagaagccccgtgcaggagaacagcagcgacctgaacaagagcatctgggacgagttcatcagcgacgaggccgacgagaagacctacaacgacgccctgttcagatacaacggcaccgtgggcctgtggagaagatgcatcaccatccccaagaacatgcactggtacagcccccccgagagaaccgagagcttcgacgtggtgaccaagtgcgtgagcttcaccctgaccgagcagttcatggagaagttcgtggaccccggcaaccacaacagcggcatcgacctgctgagaacctacctgtggagatgccagttcctgctgcccttcgtgagcctgggcctgatgtgcttcggcgccctgatcggcctgtgcgcctgcatctgcagaagcctgtaccccaccatcgccaccggcatcctgcacctgctggccggcctgtgcaccctgggcagcgtgagctgctacgtggccggcatcgagctgctgcaccagaagctggagctgcccgacaacgtgagcggcgagttcggctggagcttctgcctggcctgcgtgagcgcccccctgcagttcatggccagcgccctgttcatctgggccgcccacaccaacagaaaggagtacaccctgatgaaggcctacagagtggcctag

SEQ ID NO: 17542 - DNA, 720 bp, Artificial Sequence
  Description of Artificial Sequence: Synthetic coding sequence
atggacaacagattcgccaccgccttcgtgatcgcctgcgtgctgagcctgatcagcaccatctacatggccgccagcatcggcaccgacttctggtacgagtacagaagccccgtgcaggagaacagcagcgacctgaacaagagcatctgggacgagttcatcagcgacgaggccgacgagaagacctacaacgacgccctgttcagatacaacggcaccgtgggcctgtggagaagatgcatcaccatccccaagaacatgcactggtacagcccccccgagagaaccgagagcttcgacgtggtgaccaagtgcgtgagcttcaccctgaccgagcagttcatggagaagttcgtggaccccggcaaccacaacagcggcatcgacctgctgagaacctacctgtggagatgccagttcctgctgcccttcgtgagcctgggcctgatgtgcttcggcgccctgatcggcctgtgcgcctgcatctgcagaagcctgtaccccaccatcgccaccggcatcctgcacctgctggccggcctgtgcaccctgggcagcgtgagctgctacgtggccggcatcgagctgctgcaccagaagctggagctgcccgacaacgtgagcggcgagttcggctggagcttctgcctggcctgcgtgagcgcccccctgcagttcatggccagcgccctgttcatctgggccgcccacacctag

SEQ ID NO: 17543 - DNA, 762 bp, Artificial Sequence; identical to SEQ ID NO: 17537
  Description of Artificial Sequence: Synthetic coding sequence

SEQ ID NO: 17544 - DNA, 270 bp, Artificial Sequence
  Description of Artificial Sequence: Synthetic coding sequence
atggacaacagattcgccaccgccttcgtgatcgcctgcgtgctgagcctgatcagcaccatctacatggccgccagcatcggcaccgacttctggtacgagtacagaagccccgtgcaggagaacagcagcgacctgaacaagagcatctgggacgagttcatcagcgacgaggccgacgagaagacctacaacgacgccctgttcagatacaacggcaccgtgggcctgtggagaagatgcatcaccatccccaagaacatgcactag

SEQ ID NO: 17545 - DNA, 534 bp, Artificial Sequence
  Description of Artificial Sequence: Synthetic coding sequence
atggacaacagattcgccaccgccttcgtgatcgcctgcgtgctgagcctgatcagcaccatctacatggccgccagcatcggcaccgacttctggtacgagtacagaagccccgtgcaggagaacagcagcgacctgaacaagagcatctgggacgagttcatcagcgacgaggccgacgagaagacctacaacgacgccctgttcagatacaacggcaccgtgggcctgtggagaagatgcatcaccatccccaagaacatgcactggtacagcccccccgagagaaccgagagcttcgacgtggtgaccaagtgcgtgagcttcaccctgaccgagcagttcatggagaagttcgtggaccccggcaaccacaacagcggcatcgacctgctgagaacctacctgtggagatgccagttcctgctgcccttcgtgagcctgggcctgatgtgcttcggcgccctgatcggcctgtgcgcctgcatctgcagaagcctgtaccccaccatcgccaccggcatcctgcactag

SEQ ID NO: 17546 - DNA, 438 bp, Artificial Sequence
  Description of Artificial Sequence: Synthetic coding sequence
atggacaacagattcgccaccgccttcgtgatcgcctgcgtgctgagcctgatcagcaccatctacatggccgccagcatcggcaccgacttctggtacgagtacagaagccccgtgcaggagaacagcagcgacctgaacaagagcatctgggacgagttcatcagcgacgaggccgacgagaagacctacaacgacgccctgttcagatacaacggcaccgtgggcctgtggagaagatgcatcaccatccccaagaacatgcactggtacagcccccccgagagaaccgagagcttcgacgtggtgaccaagtgcgtgagcttcaccctgaccgagcagttcatggagaagttcgtggaccccggcaaccacaacagcggcatcgacctgctgagaacctacctgtggagatgccagttcctgctgcccttctag

SEQ ID NO: 17547 - DNA, 519 bp, Artificial Sequence
  Description of Artificial Sequence: Synthetic coding sequence
atggacaacagattcgccaccgccttcgtgatcgcctgcgtgctgagcctgatcagcaccatctacatggccgccagcatcggcaccgacttctggtacgagtacagaagccccgtgcaggagaacagcagcgacctgaacaagagcatctgggacgagttcatcagcgacgaggccgacgagaagacctacaacgacgccctgttcagatacaacggcaccgtgggcctgtggagaagatgcatcaccatccccaagaacatgcactggtacagcccccccgagagaaccgagagcttcgacgtggtgaccaagtgcgtgagcttcaccctgaccgagcagttcatggagaagttcgtggaccccggcaaccacaacagcggcatcgacctgctgagaacctacctgtggagatgccagttcctgctgcccttcgtgagcctgggcctgatgtgcttcggcgccctgatcggcctgtgcgcctgcatctgcagaagcctgtaccccaccatcgcctag

SEQ ID NO: 17548 - DNA, 714 bp, Artificial Sequence
  Description of Artificial Sequence: Synthetic coding sequence
atggacaacagattcgccaccgccttcgtgatcgcctgcgtgctgagcctgatcagcaccatctacatggccgccagcatcggcaccgacttctggtacgagtacagaagccccgtgcaggagaacagcagcgacctgaacaagagcatctgggacgagttcatcagcgacgaggccgacgagaagacctacaacgacgccctgttcagatacaacggcaccgtgggcctgtggagaagatgcatcaccatccccaagaacatgcactggtacagcccccccgagagaaccgagagcttcgacgtggtgaccaagtgcgtgagcttcaccctgaccgagcagttcatggagaagttcgtggaccccggcaaccacaacagcggcatcgacctgctgagaacctacctgtggagatgccagttcctgctgcccttcgtgagcctgggcctgatgtgcttcggcgccctgatcggcctgtgcgcctgcatctgcagaagcctgtaccccaccatcgccaccggcatcctgcacctgctggccggcctgtgcaccctgggcagcgtgagctgctacgtggccggcatcgagctgctgcaccagaagctggagctgcccgacaacgtgagcggcgagttcggctggagcttctgcctggcctgcgtgagcgcccccctgcagttcatggccagcgccctgttcatctgggccgcctag

SEQ ID NO: 17549 - DNA, 762 bp, Artificial Sequence; identical to SEQ ID NO: 17537
  Description of Artificial Sequence: Synthetic coding sequence

SEQ ID NO: 17550 - DNA, 477 bp, Artificial Sequence
  Description of Artificial Sequence: Synthetic coding sequence
atgggcgagagcttcgacgtggtgaccaagtgcgtgagcttcaccctgaccgagcagttcatggagaagttcgtggaccccggcaaccacaacagcggcatcgacctgctgagaacctacctgtggagatgccagttcctgctgcccttcgtgagcctgggcctgatgtgcttcggcgccctgatcggcctgtgcgcctgcatctgcagaagcctgtaccccaccatcgccaccggcatcctgcacctgctggccggcctgtgcaccctgggcagcgtgagctgctacgtggccggcatcgagctgctgcaccagaagctggagctgcccgacaacgtgagcggcgagttcggctggagcttctgcctggcctgcgtgagcgcccccctgcagttcatggccagcgccctgttcatctgggccgcccacaccaacagaaaggagtacaccctgatgaaggcctacagagtggcctag

SEQ ID NO: 17551 - DNA, 294 bp, Artificial Sequence
  Description of Artificial Sequence: Synthetic coding sequence
atggacaacagattcgccaccgccttcgtgatcgcctgcgtgctgagcctgatcagcaccatctacatggccgccagcatcggcaccgacttctggtacgagtacagaagccccgtgcaggagaacagcagcgacctgaacaagagcatctgggacgagttcatcagcgacgaggccgacgagaagacctacaacgacgccctgttcagatacaacggcaccgtgggcctgtggagaagatgcatcaccatccccaagaacatgcactggtacagcccccccgagagaacctag

SEQ ID NO: 17552 - DNA, 762 bp, Artificial Sequence; identical to SEQ ID NO: 17537
  Description of Artificial Sequence: Synthetic coding sequence

SEQ ID NO: 17553 - DNA, 738 bp, Artificial Sequence
  Description of Artificial Sequence: Synthetic coding sequence
atggacaacagattcgccaccgccttcgtgatcgcctgcgtgctgagcctgatcagcaccatctacatggccgccagcatcggcaccgacttctggtacgagtacagaagccccgtgcaggagaacagcagcgacctgaacaagagcatctgggacgagttcatcagcgacgaggccgacgagaagacctacaacgacgccctgttcagatacaacggcaccgtgggcctgtggagaagatgcatcaccatccccaagaacatgcactggtacagcccccccgagagaaccgagagcttcgacgtggtgaccaagtgcgtgagcttcaccctgaccgagcagttcatggagaagttcgtggaccccggcaaccacaacagcggcatcgacctgctgagaacctacctgtggagatgccagttcctgctgcccttcgtgagcctgggcctgatgtgcttcggcgccctgatcggcctgtgcgcctgcatctgcagaagcctgtaccccaccatcgccaccggcatcctgcacctgctggccggcctgtgcaccctgggcagcgtgagctgctacgtggccggcatcgagctgctgcaccagaagctggagctgcccgacaacgtgagcggcgagttcggctggagcttctgcctggcctgcgtgagcgcccccctgcagttcatggccagcgccctgttcatctgggccgcccacaccaacagaaaggagtacacctag

SEQ ID NO: 17554 - DNA, 642 bp, Artificial Sequence
  Description of Artificial Sequence: Synthetic coding sequence
atggacaacagattcgccaccgccttcgtgatcgcctgcgtgctgagcctgatcagcaccatctacatggccgccagcatcggcaccgacttctggtacgagtacagaagccccgtgcaggagaacagcagcgacctgaacaagagcatctgggacgagttcatcagcgacgaggccgacgagaagacctacaacgacgccctgttcagatacaacggcaccgtgggcctgtggagaagatgcatcaccatccccaagaacatgcactggtacagcccccccgagagaaccgagagcttcgacgtggtgaccaagtgcgtgagcttcaccctgaccgagcagttcatggagaagttcgtggaccccggcaaccacaacagcggcatcgacctgctgagaacctacctgtggagatgccagttcctgctgcccttcgtgagcctgggcctgatgtgcttcggcgccctgatcggcctgtgcgcctgcatctgcagaagcctgtaccccaccatcgccaccggcatcctgcacctgctggccggcctgtgcaccctgggcagcgtgagctgctacgtggccggcatcgagctgctgcaccagaagctggagctgcccgacaacgtgagcggcgagttcggctag

SEQ ID NO: 17555 - DNA, 543 bp, Artificial Sequence
  Description of Artificial Sequence: Synthetic coding sequence
atggacaacagattcgccaccgccttcgtgatcgcctgcgtgctgagcctgatcagcaccatctacatggccgccagcatcggcaccgacttctggtacgagtacagaagccccgtgcaggagaacagcagcgacctgaacaagagcatctgggacgagttcatcagcgacgaggccgacgagaagacctacaacgacgccctgttcagatacaacggcaccgtgggcctgtggagaagatgcatcaccatccccaagaacatgcactggtacagcccccccgagagaaccgagagcttcgacgtggtgaccaagtgcgtgagcttcaccctgaccgagcagttcatggagaagttcgtggaccccggcaaccacaacagcggcatcgacctgctgagaacctacctgtggagatgccagttcctgctgcccttcgtgagcctgggcctgatgtgcttcggcgccctgatcggcctgtgcgcctgcatctgcagaagcctgtaccccaccatcgccaccggcatcctgcacctgctggcctag

SEQ ID NO: 17556 - DNA, 504 bp, Artificial Sequence
  Description of Artificial Sequence: Synthetic coding sequence
atgggcgtgaagagaagcctgcagagcggcggcatcctgctgagcctggtggccaacgtgctgatggtgctgagcaccgccaccaactactggaccagacagcaggagggccacagcggcctgtggcaggagtgcaaccacggcatctgcagcagcatcccctgccagaccaccctggccgtgaccgtggcctgcatggtgctggccgtgggcgtgggcgtggtgggcatggtgatgggcctgagaatcagatgcgacgagggcgagagcctgagaggccagaccaccagcgccttcctgttcctgggcggcctgctgctgctgaccgccctgatcggctacaccgtgaagaacgcctggaagaacaacgtgttcttcagctggagctacttcagcggctggctggccctgcccttcagcatcctggccggcttctgcttcctgctggccgacatgatcatgcagagcaccgacgccatcagcggcttccccgtgtgcctgtag

SEQ ID NO: 17557 - DNA, 1065 bp, Artificial Sequence
  Description of Artificial Sequence: Synthetic coding sequence
atgggccccgtgagcctgctgcccaagtaccagaagctgaacacctggaacggcgacctggccaagatgacccacctgcaggccggcctgagccccgagaccatcgagaaggccagactggagctgaacgagaaccccgacgtgctgcaccaggacatccagcaggtgagagacatgatcatcaccagacccgacatcggcttcctgagaaccgacgacgccttcatcctgagattcctgagagccagaaagttccaccaggccgacgccttcagactgctggcccagtacttccagtacagacagctgaacctggacatgttcaagaacttcaaggccgacgaccccggcatcaagagagccctgatcgacggcttccccggcgtgctggagaacagagaccactacggcagaaagatcctgctgctgttcgccgccaactgggaccagagcagaaacagcttcaccgacatcctgagagccatcctgctgagcctggaggtgctgatcgaggaccccgagctgcagatcaacggcttcatcctgatcatcgactggagcaacttcagcttcaagcaggccagcaagctgacccccagcatcctgaagctggccatcgagggcctgcaggacagcttccccgccagattcggcggcgtgcacttcgtgaaccagccctggtacatccacgccctgtacaccctgatcaagcccttcctgaaggacaagaccagaaagagaatcttcctgcacggcaacaacctgaacagcctgcaccagctgatccaccccgagttcctgcccagcgagttcggcggcaccctgcccccctacgacatgggcacctgggccagaaccctgctgggccccgactacagcgacgagaacgactacacccacaccagctacaacgccatgcacgtgaagcacaccagcagcaacctggagagagagtgcagccccaagctgatgaagagaagccagagcgtggtggaggccggcaccctgaagcacgaggagaagggcgagaacgagaacacccagcccctgctggccctggactag

SEQ ID NO: 17558 - DNA, 1065 bp, Artificial Sequence; identical to SEQ ID NO: 17557
  Description of Artificial Sequence: Synthetic coding sequence

SEQ ID NO: 17559 - DNA, 240 bp, Artificial Sequence
  Description of Artificial Sequence: Synthetic coding sequence
atgggccccgtgagcctgctgcccaagtaccagaagctgaacacctggaacggcgacctggccaagatgacccacctgcaggccggcctgagccccgagaccatcgagaaggccagactggagctgaacgagaaccccgacgtgctgcaccaggacatccagcaggtgagagacatgatcatcaccagacccgacatcggcttcctgagaaccgacgacgccttcatcctgagattctag

SEQ ID NO: 17560 - DNA, 984 bp, Artificial Sequence
  Description of Artificial Sequence: Synthetic coding sequence
atgacccacctgcaggccggcctgagccccgagaccctggagaaggccagactggagctgaacgagaaccccgacaccctgcaccaggacatccaggaggtgagagacatggtgatcaccagacccgacatcggcttcctgagaaccgacgacgccttcatcctgagattcctgagagccagaaagttccaccacttcgaggccttcagactgctggcccagtacttcgagtacagacagcagaacctggacatgttcaagagcttcaaggccaccgaccccggcatcaagcaggccctgaaggacggcttccccggcggcctggccaacctggaccactacggcagaaagatcctggtgctgttcgccgccaactgggaccagagcagatacaccctggtggacatcctgagagccatcctgctgagcctggaggccatgatcgaggaccccgagctgcaggtgaacggcttcgtgctgatcatcgactggagcaacttcaccttcaagcaggccagcaagctgacccccagcatgctgagactggccatcgagggcctgcaggacagcttccccgccagattcggcggcatccacttcgtgaaccagccctggtacatccacgccctgtacaccgtgatcagacccttcctgaaggagaagaccagaaagagaatcttcctgcacggcaacaacctgaacagcctgcaccagctgatccaccccgagatcctgcccagcgagttcggcggcatgctgcccccctacgacatgggcacctgggccagaaccctgctggaccacgagtacgacgacgacagcgagtacaacgtggacagctacagcatgcccgtgaaggaggtggagaaggagctgagccccaagagcatgaagagaagccagagcgtggtggaccccaccgtgctgaagagaatggacaagaacgaggaggagaacatgcagcccctgctgagcctggactag

SEQ ID NO: 17561 - DNA, 546 bp, Artificial Sequence
  Description of Artificial Sequence: Synthetic coding sequence
atgatcgaggaccccgagctgcaggtgaacggcttcgtgctgatcatcgactggagcaacttcaccttcaagcaggccagcaagctgacccccagcatgctgagactggccatcgagggcctgcaggacagcttccccgccagattcggcggcatccacttcgtgaaccagccctggtacatccacgccctgtacaccgtgatcagacccttcctgaaggagaagaccagaaagagaatcttcctgcacggcaacaacctgaacagcctgcaccagctgatccaccccgagatcctgcccagcgagttcggcggcatgctgcccccctacgacatgggcacctgggccagaaccctgctggaccacgagtacgacgacgacagcgagtacaacgtggacagctacagcatgcccgtgaaggaggtggagaaggagctgagccccaagagcatgaagagaagccagagcgtggtggaccccaccgtgctgaagagaatggacaagaacgaggaggagaacatgcagcccctgctgagcctggactag

SEQ ID NO: 17562 - DNA, 2010 bp, Artificial Sequence
  Description of Artificial Sequence: Synthetic coding sequence
atggccgccgcccaggaggccgacggcgccagaagcgccgtggtggccgccggcggcggcagcagcggccaggtgaccagcaacggcagcatcggcagagacccccccgccgagacccagccccagaacccccccgcccagcccgcccccaacgcctggcaggtgatcaagggcgtgctgttcagaatcttcatcatctgggccatcagcagctggttcagaagaggccccgccccccaggaccaggccggccccggcggcgcccccagagtggccagcagaaacctgttccccaaggacaccctgatgaacctgcacgtgtacatcagcgagcacgagcacttcaccgacttcaacgccaccagcgccctgttctgggagcagcacgacctggtgtacggcgactggaccagcggcgagaacagcgacggctgctacgagcacttcgccgagctggacatcccccagagcgtgcagcagaacggcagcatctacatccacgtgtacttcaccaagagcggcttccaccccgaccccagacagaaggccctgtacagaagactggccaccgtgcacatgagcagaatgatcaacaagtacaagagaagaagattccagaagaccaagaacctgctgaccggcgagaccgaggccgaccccgagatgatcaagagagccgaggactacggccccgtggaggtgatcagccactggcaccccaacatcaccatcaacatcgtggacgaccacaccccctgggtgaagggcagcgtgcccccccccctggaccagtacgtgaagttcgacgccgtgagcggcgactactaccccatcatctacttcaacgactactggaacctgcagaaggactactaccccatcaacgagagcctggccagcctgcccctgagagtgagcttctgccccctgagcctgtggagatggcagctgtacgccgcccagagcaccaagagcccctggaacttcctgggcgacgagctgtacgagcagagcgacgaggagcaggacagcgtgaaggtggccctgctggagaccaacccctacctgctggccctgaccatcatcgtgagcatcgtgcacagcgtgttcgagttcctggccttcaagaacgacatccagttctggaacagcagacagagcctggagggcctgagcgtgagaagcgtgttcttcggcgtgttccagagcttcgtggtgctgctgtacatcctggacaacgagaccaacttcgtggtgcaggtgagcgtgttcatcggcgtgctgatcgacctgtggaagatcaccaaggtgatggacgtgagactggacagagagcacagagtggccggcatcttccccagactgagcttcaaggacaagagcacctacatcgagagcagcaccaaggtgtacgacgacatggccttcagatacctgagctggatcctgttccccctgctgggctgctacgccgtgtacagcctgctgtacctggagcacaagggctggtacagctgggtgctgagcatgctgtacggcttcctgctgaccttcggcttcatcaccatgaccccccagctgttcatcaactacaagctgaagagcgtggcccacctgccctggagaatgctgacctacaaggccctgaacaccttcatcgacgacctgttcgccttcgtgatcaagatgcccgtgatgtacagaatcggctgcctgagagacgacgtggtgttcttcatctacctgtaccagagatggatctacagagtggaccccaccagagtgaacgagttcggcatgagcggcgaggaccccaccgccgccgcccccgtggccgaggtgcccaccgccgccggcgccctgacccccacccccgcccccaccaccaccaccgccaccagagaggaggccagcaccagcctgcccaccaagcccacccagggcgccagcagcgccagcgagccccaggaggccccccccaagcccgccgaggacaagaagaaggactag

SEQ ID NO: 17563 - DNA, 2061 bp, Artificial Sequence
  Description of Artificial Sequence: Synthetic coding sequence
atggccgccgcccaggaggccgacggcgccagaagcgccgtggtggccgccggcggcggcagcagcggccaggtgaccagcaacggcagcatcggcagagacccccccgccgagacccagccccagaacccccccgcccagcccgcccccaacgcctggcaggtgatcaagggcgtgctgttcagaatcttcatcatctgggccatcagcagctggttcagaagaggccccgccccccaggaccaggccggccccggcggcgcccccagagtggccagcagaaacctgttccccaaggacaccctgatgaacctgcacgtgtacatcagcgagcacgagcacttcaccgacttcaacgccaccagcgccctgttctgggagcagcacgacctggtgtacggcgactggaccagcggcgagaacagcgacggctgctacgagcacttcgccgagctggacatcccccagagcgtgcagcagaacggcagcatctacatccacgtgtacttcaccaagagcggcttccaccccgaccccagacagaaggccctgtacagaagactggccaccgtgcacatgagcagaatgatcaacaagtacaagagaagaagattccagaagaccaagaacctgctgaccggcgagaccgaggccgaccccgagatgatcaagagagccgaggactacggccccgtggaggtgatcagccactggcaccccaacatcaccatcaacatcgtggacgaccacaccccctgggtgaagggcagcgtgcccccccccctggaccagtacgtgaagttcgacgccgtgagcggcgactactaccccatcatctacttcaacgactactggaacctgcagaaggactactaccccatcaacgagagcctggccagcctgcccctgagagtgagcttctgccccctgagcctgtggagatggcagctgtacgccgcccagagcaccaagagcccctggaacttcctgggcgacgagctgtacgagcagagcgacgaggagcaggacagcgtgaaggtggccctgctggagaccaacccctacctgctggccctgaccatcatcgtgagcatcgtgcacagcgtgttcgagttcctggccttcaagaacgacatccagttctggaacagcagacagagcctggagggcctgagcgtgagaagcgtgttcttcggcgtgttccagagcttcgtggtgctgctgtacatcctggacaacgagaccaacttcgtggtgcaggtgagcgtgttcatcggcgtgctgatcgacctgtggaagatcaccaaggtgatggacgtgagactggacagagagcacagagtggccggcatcttccccagactgagcttcaaggacaagagcacctacatcgagagcagcaccaaggtgtacgacgacatggccttcagatacctgagctggatcctgttccccctgctgggctgctacgccgtgtacagcctgctgtacctggagcacaagggctggtacagctgggtgctgagcatgctgtacggcttcctgctgaccttcggcttcatcaccatgaccccccagctgttcatcaactacaagctgaagagcgtggcccacctgccctggagaatgctgacctacaaggccctgaacaccttcatcgacgacctgttcgccttcgtgatcaagatgcccgtgatgtacagaatcggctgcctgagagacgacgtggtgttcttcatctacctgtaccagagatggatctacagagtggaccccaccagagtgaacgagttcggcatgagcggcgaggaccccaccgccgccgcccccgtggccgaggtgcccaccgccgccggcgccctgacccccacccccgcccccaccaccaccaccgccaccagagaggaggccagcaccagcctgcccaccaagcccacccagggcgccagcagcgccagcgagccccagggcctgttcgtggaggccctgagcgtgcccctgagcctgtgcgtgagcagccacctggccctgcccgcccagcaccactgggagagctggtag

SEQ ID NO: 17564 - DNA, 1968 bp, Artificial Sequence
  Description of Artificial Sequence: Synthetic coding sequence
atgagcagaaaggcccacatcaccgagaaggtgaccagcaacggcagcatcggcagagacccccccgccgagacccagccccagaacccccccgcccagcccgcccccaacgcctggcaggtgatcaagggcgtgctgttcagaatcttcatcatctgggccatcagcagctggttcagaagaggccccgccccccaggaccaggccggccccggcggcgcccccagagtggccagcagaaacctgttccccaaggacaccctgatgaacctgcacgtgtacatcagcgagcacgagcacttcaccgacttcaacgccaccagcgccctgttctgggagcagcacgacctggtgtacggcgactggaccagcggcgagaacagcgacggctgctacgagcacttcgccgagctggacatcccccagagcgtgcagcagaacggcagcatctacatccacgtgtacttcaccaagagcggcttccaccccgaccccagacagaaggccctgtacagaagactggccaccgtgcacatgagcagaatgatcaacaagtacaagagaagaagattccagaagaccaagaacctgctgaccggcgagaccgaggccgaccccgagatgatcaagagagccgaggactacggccccgtggaggtgatcagccactggcaccccaacatcaccatcaacatcgtggacgaccacaccccctgggtgaagggcagcgtgcccccccccctggaccagtacgtgaagttcgacgccgtgagcggcgactactaccccatcatctacttcaacgactactggaacctgcagaaggactactaccccatcaacgagagcctggccagcctgcccctgagagtgagcttctgccccctgagcctgtggagatggcagctgtacgccgcccagagcaccaagagcccctggaacttcctgggcgacgagctgtacgagcagagcgacgaggagcaggacagcgtgaaggtggccctgctggagaccaacccctacctgctggccctgaccatcatcgtgagcatcgtgcacagcgtgttcgagttcctggccttcaagaacgacatccagttctggaacagcagacagagcctggagggcctgagcgtgagaagcgtgttcttcggcgtgttccagagcttcgtggtgctgctgtacatcctggacaacgagaccaacttcgtggtgcaggtgagcgtgttcatcggcgtgctgatcgacctgtggaagatcaccaaggtgatggacgtgagactggacagagagcacagagtggccggcatcttccccagactgagcttcaaggacaagagcacctacatcgagagcagcaccaaggtgtacgacgacatggccttcagatacctgagctggatcctgttccccctgctgggctgctacgccgtgtacagcctgctgtacctggagcacaagggctggtacagctgggtgctgagcatgctgtacggcttcctgctgaccttcggcttcatcaccatgaccccccagctgttcatcaactacaagctgaagagcgtggcccacctgccctggagaatgctgacctacaaggccctgaacaccttcatcgacgacctgttcgccttcgtgatcaagatgcccgtgatgtacagaatcggctgcctgagagacgacgtggtgttcttcatctacctgtaccagagatggatctacagagtggaccccaccagagtgaacgagttcggcatgagcggcgaggaccccaccgccgccgcccccgtggccgaggtgcccaccgccgccggcgccctgacccccacccccgcccccaccaccaccaccgccaccagagaggaggccagcaccagcctgcccaccaagcccacccagggcgccagcagcgccagcgagccccaggaggccccccccaagcccgccgaggacaagaagaaggactag

SEQ ID NO: 17565 - DNA, 1704 bp, Artificial Sequence
  Description of Artificial Sequence: Synthetic coding sequence
atgaacctgcacgtgtacatcagcgagcacgagcacttcaccgacttcaacgccaccagcgccctgttctgggagcagcacgacctggtgtacggcgactggaccagcggcgagaacagcgacggctgctacgagcacttcgccgagctggacatcccccagagcgtgcagcagaacggcagcatctacatccacgtgtacttcaccaagagcggcttccaccccgaccccagacagaaggccctgtacagaagactggccaccgtgcacatgagcagaatgatcaacaagtacaagagaagaagattccagaagaccaagaacctgctgaccggcgagaccgaggccgaccccgagatgatcaagagagccgaggactacggccccgtggaggtgatcagccactggcaccccaacatcaccatcaacatcgtggacgaccacaccccctgggtgaagggcagcgtgcccccccccctggaccagtacgtgaagttcgacgccgtgagcggcgactactaccccatcatctacttcaacgactactggaacctgcagaaggactactaccccatcaacgagagcctggccagcctgcccctgagagtgagcttctgccccctgagcctgtggagatggcagctgtacgccgcccagagcaccaagagcccctggaacttcctgggcgacgagctgtacgagcagagcgacgaggagcaggacagcgtgaaggtggccctgctggagaccaacccctacctgctggccctgaccatcatcgtgagcatcgtgcacagcgtgttcgagttcctggccttcaagaacgacatccagttctggaacagcagacagagcctggagggcctgagcgtgagaagcgtgttcttcggcgtgttccagagcttcgtggtgctgctgtacatcctggacaacgagaccaacttcgtggtgcaggtgagcgtgttcatcggcgtgctgatcgacctgtggaagatcaccaaggtgatggacgtgagactggacagagagcacagagtggccggcatcttccccagactgagcttcaaggacaagagcacctacatcgagagcagcaccaaggtgtacgacgacatggccttcagatacctgagctggatcctgttccccctgctgggctgctacgccgtgtacagcctgctgtacctggagcacaagggctggtacagctgggtgctgagcatgctgtacggcttcctgctgaccttcggcttcatcaccatgaccccccagctgttcatcaactacaagctgaagagcgtggcccacctgccctggagaatgctgacctacaaggccctgaacaccttcatcgacgacctgttcgccttcgtgatcaagatgcccgtgatgtacagaatcggctgcctgagagacgacgtggtgttcttcatctacctgtaccagagatggatctacagagtggaccccaccagagtgaacgagttcggcatgagcggcgaggaccccaccgccgccgcccccgtggccgaggtgcccaccgccgccggcgccctgacccccacccccgcccccaccaccaccaccgccaccagagaggaggccagcaccagcctgcccaccaagcccacccagggcgccagcagcgccagcgagccccaggaggccccccccaagcccgccgaggacaagaagaaggactag

SEQ ID NO: 17566 - DNA, 2124 bp, Artificial Sequence
  Description of Artificial Sequence: Synthetic coding sequence
atgctgggcagcctggtgctgagaagaaaggccctggcccccagactgctgctgagactgctgagaagccccaccctgagaggccacggcggcgccagcggcagaaacgtgaccaccggcagcctgggcgagccccagtggctgagagtggccaccggcggcagacccggcaccagccccgccctgttcagcggcagaggcgccgccaccggcggcagacagggcggcagattcgacaccaagtgcctggccgccgccacctggggcagactgcccggccccgaggagaccctgcccggccaggacagctggaacggcgtgcccagcagagccggcctgggcatgtgcgccctggccgccgccctggtggtgcactgctacagcaagagccccagcaacaaggacgccgccctgctggaggccgccagagccaacaacatgcaggaggtgagcagactgctgagcgagggcgccgacgtgaacgccaagcacagactgggctggaccgccctgatggtggccgccatcaacagaaacaacagcgtggtgcaggtgctgctggccgccggcgccgaccccaacctgggcgacgacttcagcagcgtgtacaagaccgccaaggagcagggcatccacagcctggaggacggcggccaggacggcgccagcagacacatcaccaaccagtggaccagcgccctggagttcagaagatggctgggcctgcccgccggcgtgctgatcaccagagaggacgacttcaacaacagactgaacaacagagccagcttcaagggctgcaccgccctgcactacgccgtgctggccgacgactacagaaccgtgaaggagctgctggacggcggcgccaaccccctgcagagaaacgagatgggccacacccccctggactacgccagagagggcgaggtgatgaagctgctgagaaccagcgaggccaagtaccaggagaagcagagaaagagagaggccgaggagagaagaagattccccctggagcagagactgaaggagcacatcatcggccaggagagcgccatcgccaccgtgggcgccgccatcagaagaaaggagaacggctggtacgacgaggagcaccccctggtgttcctgttcctgggcagcagcggcatcggcaagaccgagctggccaagcagaccgccaagtacatgcacaaggacgccaagaagggcttcatcagactggacatgagcgagttccaggagagacacgaggtggccaagttcatcggcagcccccccggctacgtgggccacgaggagggcggccagctgaccaagaagctgaagcagtgccccaacgccgtggtgctgttcgacgaggtggacaaggcccaccccgacgtgctgaccatcatgctgcagctgttcgacgagggcagactgaccgacggcaagggcaagaccatcgactgcaaggacgccatcttcatcatgaccagcaacgtggccagcgacgagatcgcccagcacgccctgcagctgagacaggaggccctggagatgagcagaaacagaatcgccgagaacctgggcgacgtgcagatcagcgacaagatcaccatcagcaagaacttcaaggagaacgtgatcagacccatcctgaaggcccacttcagaagagacgagttcctgggcagaatcaacgagatcgtgtacttcctgcccttctgccacagcgagctgatccagctggtgaacaaggagctgaacttctgggccaagagagccaagcagagacacaacatcaccctgctgtgggacagagaggtggccgacgtgctggtggacggctacaacgtgcactacggcgccagaagcatcaagcacgaggtggagagaagagtggtgaaccagctggccgccgcctacgagcaggacctgctgcccggcggctgcaccctgagaatcaccgtggaggacagcgacaagcagctgctgaagagccccgagctgcccagcccccaggccgagaagagactgcccaagctgagactggagatcatcgacaaggacagcaagaccagaagactggacatcagagcccccctgcaccccgagaaggtgtgcaacaccatctag

SEQ ID NO: 17567 - DNA, 1989 bp, Artificial Sequence
  Description of Artificial Sequence: Synthetic coding sequence
atgcccagaggctgccacctgggcacccccagctggagcagaagaaacacccccagaaccggccagctggagagaggcccccagcagggcagaaccggccacgtgagacccggcagaagcgccggcggcagcctgctgcagcaggagagcgtgcagcagggctgcagccccgtgggcagctgcccctgccagcagtacgccagaagccagcagccccaggagaccgccaagaacgacgcccagagcagaagctgggccggcctgaacgccggcgtgagcctgaagaacaccaagatcagcagcagcgagtggcccctgagactgctgagcgagggcgccgacgtgaacgccaagcacagactgggctggaccgccctgatggtggccgccatcaacagaaacaacagcgtggtgcaggtgctgctggccgccggcgccgaccccaacctgggcgacgacttcagcagcgtgtacaagaccgccaaggagcagggcatccacagcctggaggacggcggccaggacggcgccagcagacacatcaccaaccagtggaccagcgccctggagttcagaagatggctgggcctgcccgccggcgtgctgatcaccagagaggacgacttcaacaacagactgaacaacagagccagcttcaagggctgcaccgccctgcactacgccgtgctggccgacgactacagaaccgtgaaggagctgctggacggcggcgccaaccccctgcagagaaacgagatgggccacacccccctggactacgccagagagggcgaggtgatgaagctgctgagaaccagcgaggccaagtaccaggagaagcagagaaagagagaggccgaggagagaagaagattccccctggagcagagactgaaggagcacatcatcggccaggagagcgccatcgccaccgtgggcgccgccatcagaagaaaggagaacggctggtacgacgaggagcaccccctggtgttcctgttcctgggcagcagcggcatcggcaagaccgagctggccaagcagaccgccaagtacatgcacaaggacgccaagaagggcttcatcagactggacatgagcgagttccaggagagacacgaggtggccaagttcatcggcagcccccccggctacgtgggccacgaggagggcggccagctgaccaagaagctgaagcagtgccccaacgccgtggtgctgttcgacgaggtggacaaggcccaccccgacgtgctgaccatcatgctgcagctgttcgacgagggcagactgaccgacggcaagggcaagaccatcgactgcaaggacgccatcttcatcatgaccagcaacgtggccagcgacgagatcgcccagcacgccctgcagctgagacaggaggccctggagatgagcagaaacagaatcgccgagaacctgggcgacgtgcagatcagcgacaagatcaccatcagcaagaacttcaaggagaacgtgatcagacccatcctgaaggcccacttcagaagagacgagttcctgggcagaatcaacgagatcgtgtacttcctgcccttctgccacagcgagctgatccagctggtgaacaaggagctgaacttctgggccaagagagccaagcagagacacaacatcaccctgctgtgggacagagaggtggccgacgtgctggtggacggctacaacgtgcactacggcgccagaagcatcaagcacgaggtggagagaagagtggtgaaccagctggccgccgcctacgagcaggacctgctgcccggcggctgcaccctgagaatcaccgtggaggacagcgacaagcagctgctgaagagccccgagctgcccagcccccaggccgagaagagactgcccaagctgagactggagatcatcgacaaggacagcaagaccagaagactggacatcagagcccccctgcaccccgagaaggtgtgcaacaccatctag

SEQ ID NO: 17568 - DNA, 2034 bp, Artificial Sequence
  Description of Artificial Sequence: Synthetic coding sequence
atgctgggcagcctggtgctgagaagaaaggccctggcccccagactgctgctgagactgctgagaagccccaccctgagaggccacggcggcgccagcggcagaaacgtgaccaccggcagcctgggcgagccccagtggctgagagtggccaccggcggcagacccggcaccagccccgccctgttcagcggcagaggcgccgccaccggcggcagacagggcggcagattcgacaccaagtgcctggccgccgccacctggggcagactgcccggccccgaggagaccctgcccggccaggacagctggaacggcgtgcccagcagagccggcctgggcatgtgcgccctggccgccgccctggtggtgcactgctacagcaagagccccagcaacaaggacgccgccctgctggaggccgccagagccaacaacatgcaggaggtgagcagactgctgagcgagggcgccgacgtgaacgccaagcacagactgggctggaccgccctgatggtggccgccatcaacagaaacaacagcgtggtgcaggtgctgctggccgccggcgccgaccccaacctgggcgacgacttcagcagcgtgtacaagaccgccaaggagcagggcatccacagcctggaggtgctgatcaccagagaggacgacttcaacaacagactgaacaacagagccagcttcaagggctgcaccgccctgcactacgccgtgctggccgacgactacagaaccgtgaaggagctgctggacggcggcgccaaccccctgcagagaaacgagatgggccacacccccctggactacgccagagagggcgaggtgatgaagctgctgagaaccagcgaggccaagtaccaggagaagcagagaaagagagaggccgaggagagaagaagattccccctggagcagagactgaaggagcacatcatcggccaggagagcgccatcgccaccgtgggcgccgccatcagaagaaaggagaacggctggtacgacgaggagcaccccctggtgttcctgttcctgggcagcagcggcatcggcaagaccgagctggccaagcagaccgccaagtacatgcacaaggacgccaagaagggcttcatcagactggacatgagcgagttccaggagagacacgaggtggccaagttcatcggcagcccccccggctacgtgggccacgaggagggcggccagctgaccaagaagctgaagcagtgccccaacgccgtggtgctgttcgacgaggtggacaaggcccaccccgacgtgctgaccatcatgctgcagctgttcgacgagggcagactgaccgacggcaagggcaagaccatcgactgcaaggacgccatcttcatcatgaccagcaacgtggccagcgacgagatcgcccagcacgccctgcagctgagacaggaggccctggagatgagcagaaacagaatcgccgagaacctgggcgacgtgcagatcagcgacaagatcaccatcagcaagaacttcaaggagaacgtgatcagacccatcctgaaggcccacttcagaagagacgagttcctgggcagaatcaacgagatcgtgtacttcctgcccttctgccacagcgagctgatccagctggtgaacaaggagctgaacttctgggccaagagagccaagcagagacacaacatcaccctgctgtgggacagagaggtggccgacgtgctggtggacggctacaacgtgcactacggcgccagaagcatcaagcacgaggtggagagaagagtggtgaaccagctggccgccgcctacgagcaggacctgctgcccggcggctgcaccctgagaatcaccgtggaggacagcgacaagcagctgctgaagagccccgagctgcccagcccccaggccgagaagagactgcccaagctgagactggagatcatcgacaaggacagcaagaccagaagactggacatcagagcccccctgcaccccgagaaggtgtgcaacaccatctag

SEQ ID NO: 17569 - DNA, 1521 bp, Artificial Sequence
  Description of Artificial Sequence: Synthetic coding sequence
atggtggccgccatcaacagaaacaacagcgtggtgcaggtgctgctggccgccggcgccgaccccaacctgggcgacgacttcagcagcgtgtacaagaccgccaaggagcagggcatccacagcctggaggtgctgatcaccagagaggacgacttcaacaacagactgaacaacagagccagcttcaagggctgcaccgccctgcactacgccgtgctggccgacgactacagaaccgtgaaggagctgctggacggcggcgccaaccccctgcagagaaacgagatgggccacacccccctggactacgccagagagggcgaggtgatgaagctgctgagaaccagcgaggccaagtaccaggagaagcagagaaagagagaggccgaggagagaagaagattccccctggagcagagactgaaggagcacatcatcggccaggagagcgccatcgccaccgtgggcgccgccatcagaagaaaggagaacggctggtacgacgaggagcaccccctggtgttcctgttcctgggcagcagcggcatcggcaagaccgagctggccaagcagaccgccaagtacatgcacaaggacgccaagaagggcttcatcagactggacatgagcgagttccaggagagacacgaggtggccaagttcatcggcagcccccccggctacgtgggccacgaggagggcggccagctgaccaagaagctgaagcagtgccccaacgccgtggtgctgttcgacgaggtggacaaggcccaccccgacgtgctgaccatcatgctgcagctgttcgacgagggcagactgaccgacggcaagggcaagaccatcgactgcaaggacgccatcttcatcatgaccagcaacgtggccagcgacgagatcgcccagcacgccctgcagctgagacaggaggccctggagatgagcagaaacagaatcgccgagaacctgggcgacgtgcagatcagcgacaagatcaccatcagcaagaacttcaaggagaacgtgatcagacccatcctgaaggcccacttcagaagagacgagttcctgggcagaatcaacgagatcgtgtacttcctgcccttctgccacagcgagctgatccagctggtgaacaaggagctgaacttctgggccaagagagccaagcagagacacaacatcaccctgctgtgggacagagaggtggccgacgtgctggtggacggctacaacgtgcactacggcgccagaagcatcaagcacgaggtggagagaagagtggtgaaccagctggccgccgcctacgagcaggacctgctgcccggcggctgcaccctgagaatcaccgtggaggacagcgacaagcagctgctgaagagccccgagctgcccagcccccaggccgagaagagactgcccaagctgagactggagatcatcgacaaggacagcaagaccagaagactggacatcagagcccccctgcaccccgagaaggtgtgcaacaccatctag

SEQ ID NO: 17570 - DNA, 1902 bp, Artificial Sequence
  Description of Artificial Sequence: Synthetic coding sequence
atgcccagctgcggcgcctgcacctgcggcgccgccgccgtgagactgatcaccagcagcctggccagcgcccagagaggcatcagcggcggcagaatccacatgagcgtgctgggcagactgggcaccttcgagacccagatcctgcagagagcccccctgagaagcttcaccgagacccccgcctacttcgccagcaaggacggcatcagcaaggacggcagcggcgacggcaacaagaagagcgccagcgagggcagcagcaagaagagcggcagcggcaacagcggcaagggcggcaaccagctgagatgccccaagtgcggcgacctgtgcacccacgtggagaccttcgtgagcagcaccagattcgtgaagtgcgagaagtgccaccacttcttcgtggtgctgagcgaggccgacagcaagaagagcatcatcaaggagcccgagagcgccgccgaggccgtgaagctggccttccagcagaagcccccccccccccccaagaagatctacaactacctggacaagtacgtggtgggccagagcttcgccaagaaggtgctgagcgtggccgtgtacaaccactacaagagaatctacaacaacatccccgccaacctgagacagcaggccgaggtggagaagcagaccagcctgacccccagagagctggagatcagaagaagagaggacgagtacagattcaccaagctgctgcagatcgccggcatcagcccccacggcaacgccctgggcgccagcatgcagcagcaggtgaaccagcagatcccccaggagaagagaggcggcgaggtgctggacagcagccacgacgacatcaagctggagaagagcaacatcctgctgctgggccccaccggcagcggcaagaccctgctggcccagaccctggccaagtgcctggacgtgcccttcgccatctgcgactgcaccaccctgacccaggccggctacgtgggcgaggacatcgagagcgtgatcgccaagctgctgcaggacgccaactacaacgtggagaaggcccagcagggcatcgtgttcctggacgaggtggacaagatcggcagcgtgcccggcatccaccagctgagagacgtgggcggcgagggcgtgcagcagggcctgctgaagctgctggagggcaccatcgtgaacgtgcccgagaagaacagcagaaagctgagaggcgagaccgtgcaggtggacaccaccaacatcctgttcgtggccagcggcgccttcaacggcctggacagaatcatcagcagaagaaagaacgagaagtacctgggcttcggcacccccagcaacctgggcaagggcagaagagccgccgccgccgccgacctggccaacagaagcggcgagagcaacacccaccaggacatcgaggagaaggacagactgctgagacacgtggaggccagagacctgatcgagttcggcatgatccccgagttcgtgggcagactgcccgtggtggtgcccctgcacagcctggacgagaagaccctggtgcagatcctgaccgagcccagaaacgccgtgatcccccagtaccaggccctgttcagcatggacaagtgcgagctgaacgtgaccgaggacgccctgaaggccatcgccagactggccctggagagaaagaccggcgccagaggcctgagaagcatcatggagaagctgctgctggagcccatgttcgaggtgcccaacagcgacatcgtgtgcgtggaggtggacaaggaggtggtggagggcaagaaggagcccggctacatcagagcccccaccaaggagagcagcgaggaggagtacgacagcggcgtggaggaggagggctggcccagacaggccgacgccgccaacagctag

SEQ ID NO: 17571 - DNA, 1602 bp, Artificial Sequence
  Description of Artificial Sequence: Synthetic coding sequence
atgcccagctgcggcgcctgcacctgcggcgccgccgccgtgagactgatcaccagcagcctggccagcgcccagagaggcatcagcggcggcagaatccacatgagcgtgctgggcagactgggcaccttcgagacccagatcctgcagagagcccccctgagaagcttcaccgagacccccgcctacttcgccagcaaggacggcatcagcaaggacggcagcggcgacggcaacaagaagagcgccagcgagggcagcagcaagaagagcggcagcggcaacagcggcaagggcggcaaccagctgagatgccccaagtgcggcgacctgtgcacccacgtggagaccttcgtgagcagcaccagattcgtgaagtgcgagaagtgccaccacttcttcgtggtgctgagcgaggccgacagcaagaagagcatcatcaaggagcccgagagcgccgccgaggccgtgaagctggccttccagcagaagcccccccccccccccaagaagatctacaactacctggacaagtacgtggtgggccagagcttcgccaagaaggtgctgagcgtggccgtgtacaaccactacaagagaatctacaacaacatccccgccaacctgagacagcaggccgaggtggagaagcagaccagcctgacccccagagagctggagatcagaagaagagaggacgagtacagattcaccaagctgctgcagatcgccggcatcagcccccacggcaacgccctgggcgccagcatgcagcagcaggtgaaccagcagatcccccaggagaagagaggcggcgaggtgctggacagcagccacgacgacatcaagctggagaagagcaacatcctgctgctgggccccaccggcagcggcaagaccctgctggcccagaccctggccaagtgcctggacgtgcccttcgccatctgcgactgcaccaccctgacccaggccggctacgtgggcgaggacatcgagagcgtgatcgccaagctgctgcaggacgccaactacaacgtggagaaggcccagcagggcatcgtgttcctggacgaggtggacaagatcggcagcgtgcccggcatccaccagctgagagacgtgggcggcgagggcgtgcagcagggcctgctgaagctgctggagggcaccatcgtgaacgtgcccgagaagaacagcagaaagctgagaggcgagaccgtgcaggtggacaccaccaacatcctgttcgtggccagcggcgccttcaacggcctggacagaatcatcagcagaagaaagaacgagaagtacctgggcttcggcacccccagcaacctgggcaagggcagaagagccgccgccgccgccgacctggccaacagaagcggcgagagcaacacccaccaggacatcgaggagaaggacagactgctgagacacgtggaggccagagacctgatcgagttcggcatgatccccgagttcgtgggcagactgcccgtggtggtgcccctgcacagcctggacgagaagaccctggtgcagatcctgaccgagcccccccaccccgccctgttcaccatcttcaaccccttctag

SEQ ID NO: 17572 - DNA, 2625 bp, Artificial Sequence
  Description of Artificial Sequence: Synthetic coding sequence
atgctgaagaagttcgacaagaaggacgaggagagcggcggcggcagcaaccccttccagcacctggagaagagcgccgtgctgcaggaggccagagtgttcaacgagacccccatcaaccccagaaagtgcgcccacatcctgaccaagatcctgtacctgatcaaccagggcgagcacctgggcaccaccgaggccaccgaggccttcttcgccatgaccaagctgttccagagcaacgaccccaccctgagaagaatgtgctacctgaccatcaaggagatgagctgcatcgccgaggacgtgatcatcgtgaccagcagcctgaccaaggacatgaccggcaaggaggacaactacagaggccccgccgtgagagccctgtgccagatcaccgacagcaccatgctgcaggccatcgagagatacatgaagcaggccatcgtggacaaggtgcccagcgtgagcagcagcgccctggtgagcagcctgcacctgctgaagtgcagcttcgacgtggtgaagagatgggtgaacgaggcccaggaggccgccagcagcgacaacatcatggtgcagtaccacgccctgggcctgctgtaccacgtgagaaagaacgacagactggccgtgaacaagatgatcagcaaggtgaccagacacggcctgaagagccccttcgcctactgcatgatgatcagagtggccagcaagcagctggaggaggaggacggcagcagagacagccccctgttcgacttcatcgagagctgcctgagaaacaagcacgagatggtggtgtacgaggccgccagcgccatcgtgaacctgcccggctgcagcgccaaggagctggcccccgccgtgagcgtgctgcagctgttctgcagcagccccaaggccgccctgagatacgccgccgtgagaaccctgaacaaggtggccatgaagcaccccagcgccgtgaccgcctgcaacctggacctggagaacctggtgaccgacagcaacagaagcatcgccaccctggccatcaccaccctgctgaagaccggcagcgagagcagcatcgacagactgatgaagcagatcagcagcttcatgagcgagatcagcgacgagttcaaggtggtggtggtgcaggccatcagcgccctgtgccagaagtaccccagaaagcacgccgtgctgatgaacttcctgttcaccatgctgagagaggagggcggcttcgagtacaagagagccatcgtggactgcatcatcagcatcatcgaggagaacagcgagagcaaggagaccggcctgagccacctgtgcgagttcatcgaggactgcgagttcaccgtgctggccaccagaatcctgcacctgctgggccaggagggccccaagaccaccaaccccagcaagtacatcagattcatctacaacagagtggtgctggagcacgaggaggtgagagccggcgccgtgagcgccctggccaagttcggcgcccagaacgaggagatgctgcccagcatcctggtgctgctgaagagatgcgtgatggacgacgacaacgaggtgagagacagagccaccttctacctgaacgtgctggagcagaagcagaaggccctgaacgccggctacatcctgaacggcctgaccgtgagcatccccggcctggagagagccctgcagcagtacaccctggagcccagcgagaagcccttcgacctgaagagcgtgcccctggccaccgcccccatggccgagcagagaaccgagagcacccccatcaccgccgtgaagcagcccgagaaggtggccgccaccagacaggagatcttccaggagcagctggccgccgtgcccgagttcagaggcctgggccccctgttcaagagcagccccgagcccgtggccctgaccgagagcgagaccgagtacgtgatcagatgcaccaagcacaccttcaccaaccacatggtgttccagttcgactgcaccaacaccctgaacgaccagaccctggagaacgtgaccgtgcagatggagcccaccgaggcctacgaggtgctgtgctacgtgcccgccagaagcctgccctacaaccagcccggcacctgctacaccctggtggccctgcccaaggaggaccccaccgccgtggcctgcaccttcagctgcatgatgaagttcaccgtgaaggactgcgaccccaccaccggcgagaccgacgacgagggctacgaggacgagtacgtgctggaggacctggaggtgaccgtggccgaccacatccagaaggtgatgaagctgaacttcgaggccgcctgggacgaggtgggcgacgagttcgagaaggaggagaccttcaccctgagcaccatcaagaccctggaggaggccgtgggcaacatcgtgaagttcctgggcatgcacccctgcgagagaagcgacaaggtgcccgacaacaagaacacccacaccctgctgctggccggcgtgttcagaggcggccacgacatcctggtgagaagcagactgctgctgctggacaccgtgaccatgcaggtgaccgccagaagcctggaggagctgcccgtggacatcatcctggccagcgtgggctag

SEQ ID NO: 17573 - DNA, 534 bp, Artificial Sequence
  Description of Artificial Sequence: Synthetic coding sequence
atggaggccctgatcctggagcccagcctgtacaccgtgaaggccatcctgatcctggacaacgacggcgacagactgttcgccaagtactacgacgacacctaccccagcgtgaaggagcagaaggccttcgagaagaacatcttcaacaagacccacagaaccgacagcgagatcgccctgctggagggcctgaccgtggtgtacaagagcagcatcgacctgtacttctacgtgatcggcagcagctacgagaacgagctgatgctgatggccgtgctgaactgcctgttcgacagcctgagccagatgctgagaaagaacgtggagaagagagccctgctggagaacatggagggcctgttcctggccgtggacgagatcgtggacggcggcgtgatcctggagagcgacccccagcaggtggtgcacagagtggccctgagaggcgaggacgtgcccctgaccgagcagaccgtgagccaggtgctgcagagcgccaaggagcagatcaagtggagcctgctgagatag

SEQ ID NO: 17574 - DNA, 381 bp, Artificial Sequence
  Description of Artificial Sequence: Synthetic coding sequence
atgatggagatcgacttcctgcccagcaccatgaccacccccacccccgtgagcagaagcaagagacccctgagaagaaccttcagcaccagacccatcggcctgaccctgatgctgatggccgtgctgaactgcctgttcgacagcctgagccagatgctgagaaagaacgtggagaagagagccctgctggagaacatggagggcctgttcctggccgtggacgagatcgtggacggcggcgtgatcctggagagcgacccccagcaggtggtgcacagagtggccctgagaggcgaggacgtgcccctgaccgagcagaccgtgagccaggtgctgcagagcgccaaggagcagatcaagtggagcctgctgagatag

SEQ ID NO: 17575 - DNA, 465 bp, Artificial Sequence
  Description of Artificial Sequence: Synthetic coding sequence
atggaggccctgatcctgtactacgacgacacctaccccagcgtgaaggagcagaaggccttcgagaagaacatcttcaacaagacccacagaaccgacagcgagatcgccctgctggagggcctgaccgtggtgtacaagagcagcatcgacctgtacttctacgtgatcggcagcagctacgagaacgagctgatgctgatggccgtgctgaactgcctgttcgacagcctgagccagatgctgagaaagaacgtggagaagagagccctgctggagaacatggagggcctgttcctggccgtggacgagatcgtggacggcggcgtgatcctggagagcgacccccagcaggtggtgcacagagtggccctgagaggcgaggacgtgcccctgaccgagcagaccgtgagccaggtgctgcagagcgccaaggagcagatcaagtggagcctgctgagatag

SEQ ID NO: 17576 - DNA, 279 bp, Artificial Sequence
  Description of Artificial Sequence: Synthetic coding sequence
atggaggccctgatcctggagcccagcctgtacaccgtgaaggccatcctgatcctggacaacgacggcgacagactgttcgccaagtactacgacgacacctaccccagcgtgaaggagcagaaggccttcgagaagaacatcttcaacaagacccacagaaccgacagcgagatcgccctgctggagggcctgaccgtggtgtacaagagcagcatcgacctgtacttctacgtgatcggcagcagctacgagaacgagctgatgctgatggcctag

SEQ ID NO: 17577 - DNA, 744 bp, Artificial Sequence
  Description of Artificial Sequence: Synthetic coding sequence
atggcctgggccggcagcagaagagtgcccgccggcaccagagccgccgccgagagatgctgcagactgagcctgagccccggcgcccagcccgcccccccccccggccccctgcccccccccagacccatgagattcctgaccagctgcagcctgctgctgcccagagccgcccagatcctggccgccgaggccggcctgcccagcagcagaagcttcatgggcttcgccgcccccttcaccaacaagagaaaggcctacagcgagagaagaatcatgggctacagcatgcaggagatgtacgaggtggtgagcaacgtgcaggagtacagagagttcgtgccctggtgcaagaagagcctggtggtgagcagcagaaagggccacctgaaggcccagctggaggtgggcttcccccccgtgatggagagatacaccagcgccgtgagcatggtgaagccccacatggtgaaggccgtgtgcaccgacggcaagctgttcaaccacctggagaccatctggagattcagccccggcatccccgcctaccccagaacctgcaccgtggacttcagcatcagcttcgagttcagaagcctgctgcacagccagctggccaccatgttcttcgacgaggtggtgaagcagaacgtggccgccttcgagagaagagccgccaccaagttcggccccgagaccgccatccccagagagctgatgttccacgaggtgcaccagacctag

SEQ ID NO: 17578 - DNA, 648 bp, Artificial Sequence
  Description of Artificial Sequence: Synthetic coding sequence
atgctgctgcaggtggtgagagagggcaagttcagcggcttcctgaccagctgcagcctgctgctgcccagagccgcccagatcctggccgccgaggccggcctgcccagcagcagaagcttcatgggcttcgccgcccccttcaccaacaagagaaaggcctacagcgagagaagaatcatgggctacagcatgcaggagatgtacgaggtggtgagcaacgtgcaggagtacagagagttcgtgccctggtgcaagaagagcctggtggtgagcagcagaaagggccacctgaaggcccagctggaggtgggcttcccccccgtgatggagagatacaccagcgccgtgagcatggtgaagccccacatggtgaaggccgtgtgcaccgacggcaagctgttcaaccacctggagaccatctggagattcagccccggcatccccgcctaccccagaacctgcaccgtggacttcagcatcagcttcgagttcagaagcctgctgcacagccagctggccaccatgttcttcgacgaggtggtgaagcagaacgtggccgccttcgagagaagagccgccaccaagttcggccccgagaccgccatccccagagagctgatgttccacgaggtgcaccagacctag

SEQ ID NO: 17579 - DNA, 693 bp, Artificial Sequence
  Description of Artificial Sequence: Synthetic coding sequence
atgcacagcagcagccccagccccaccaacgacagaggcctgagaagaaccatcagactggcccccctgagcttcggcctgagattcctgaccagctgcagcctgctgctgcccagagccgcccagatcctggccgccgaggccggcctgcccagcagcagaagcttcatgggcttcgccgcccccttcaccaacaagagaaaggcctacagcgagagaagaatcatgggctacagcatgcaggagatgtacgaggtggtgagcaacgtgcaggagtacagagagttcgtgccctggtgcaagaagagcctggtggtgagcagcagaaagggccacctgaaggcccagctggaggtgggcttcccccccgtgatggagagatacaccagcgccgtgagcatggtgaagccccacatggtgaaggccgtgtgcaccgacggcaagctgttcaaccacctggagaccatctggagattcagccccggcatccccgcctaccccagaacctgcaccgtggacttcagcatcagcttcgagttcagaagcctgctgcacagccagctggccaccatgttcttcgacgaggtggtgaagcagaacgtggccgccttcgagagaagagccgccaccaagttcggccccgagaccgccatccccagagagctgatgttccacgaggtgcaccagacctag

SEQ ID NO: 17580 - DNA, 195 bp, Artificial Sequence
  Description of Artificial Sequence: Synthetic coding sequence
tgaagaacctgcaccgtggacttcagcatcagcttcgagttcagaagcctgctgcacagccagctggccaccatgttcttcgacgaggtggtgaagcagaacgtggccgccttcgagagaagagccgccaccaagttcggccccgagaccgccatccccagagagctgatgttccacgaggtgcaccagacctag

SEQ ID NO: 17581 - DNA, 717 bp, Artificial Sequence
  Description of Artificial Sequence: Synthetic coding sequence
atggccgccagaaccggccacaccgccctgagaagagtggtgagcggctgcagacccaagagcgccaccgccgccggcgcccaggcccccgtgagaaacggcagatacctggccagctgcggcatcctgatgagcagaaccctgcccctgcacaccagcatcctgcccaaggagatctgcgccagaaccttcttcaagatcaccgcccccctgatcaacaagagaaaggagtacagcgagagaagaatcctgggctacagcatgcaggagatgtacgacgtggtgagcggcgtggaggactacaagcacttcgtgccctggtgcaagaagagcgacgtgatcagcaagagaagcggctactgcaagaccagactggagatcggcttcccccccgtgctggagagatacaccagcgtggtgaccctggtgaagccccacctggtgaaggccagctgcaccgacggcagactgttcaaccacctggagaccatctggagattcagccccggcctgcccggctaccccagaacctgcaccctggacttcagcatcagcttcgagttcagaagcctgctgcacagccagctggccaccctgttcttcgacgaggtggtgaagcagatggtggccgccttcgagagaagagcctgcaagctgtacggccccgagaccaacatccccagagagctgatgctgcacgaggtgcaccacacctag

SEQ ID NO: 17582 - DNA, 633 bp, Artificial Sequence
  Description of Artificial Sequence: Synthetic coding sequence
atgggcgtgtgcgtgtggagatacctggccagctgcggcatcctgatgagcagaaccctgcccctgcacaccagcatcctgcccaaggagatctgcgccagaaccttcttcaagatcaccgcccccctgatcaacaagagaaaggagtacagcgagagaagaatcctgggctacagcatgcaggagatgtacgacgtggtgagcggcgtggaggactacaagcacttcgtgccctggtgcaagaagagcgacgtgatcagcaagagaagcggctactgcaagaccagactggagatcggcttcccccccgtgctggagagatacaccagcgtggtgaccctggtgaagccccacctggtgaaggccagctgcaccgacggcagactgttcaaccacctggagaccatctggagattcagccccggcctgcccggctaccccagaacctgcaccctggacttcagcatcagcttcgagttcagaagcctgctgcacagccagctggccaccctgttcttcgacgaggtggtgaagcagatggtggccgccttcgagagaagagcctgcaagctgtacggccccgagaccaacatccccagagagctgatgctgcacgaggtgcaccacacctag

SEQ ID NO: 17583 - DNA, 588 bp, Artificial Sequence
  Description of Artificial Sequence: Synthetic coding sequence
atgagcagaaccctgcccctgcacaccagcatcctgcccaaggagatctgcgccagaaccttcttcaagatcaccgcccccctgatcaacaagagaaaggagtacagcgagagaagaatcctgggctacagcatgcaggagatgtacgacgtggtgagcggcgtggaggactacaagcacttcgtgccctggtgcaagaagagcgacgtgatcagcaagagaagcggctactgcaagaccagactggagatcggcttcccccccgtgctggagagatacaccagcgtggtgaccctggtgaagccccacctggtgaaggccagctgcaccgacggcagactgttcaaccacctggagaccatctggagattcagccccggcctgcccggctaccccagaacctgcaccctggacttcagcatcagcttcgagttcagaagcctgctgcacagccagctggccaccctgttcttcgacgaggtggtgaagcagatggtggccgccttcgagagaagagcctgcaagctgtacggccccgagaccaacatccccagagagctgatgctgcacgaggtgcaccacacctag

SEQ ID NO: 17584 - DNA, 984 bp, Artificial Sequence
  Description of Artificial Sequence: Synthetic coding sequence
atggccgcccccggcagctgcgccctgtggagctactgcggcagaggctggagcagagccatgagaggctgccagctgctgggcctgagaagcagctggcccggcgacctgctgagcgccagactgctgagccaggagaagagagccgccgagacccacttcggcttcgagaccgtgagcgaggaggagaagggcggcaaggtgtaccaggtgttcgagagcgtggccaagaagtacgacgtgatgaacgacatgatgagcctgggcatccacagagtgtggaaggacctgctgctgtggaagatgcaccccctgcccggcacccagctgctggacgtggccggcggcaccggcgacatcgccttcagattcctgaactacgtgcagagccagcaccagagaaagcagaagagacagctgagagcccagcagaacctgagctgggaggagatcgccaaggagtaccagaacgaggaggacagcctgggcggcagcagagtggtggtgtgcgacatcaacaaggagatgctgaaggtgggcaagcagaaggccctggcccagggctacagagccggcctggcctgggtgctgggcgacgccgaggagctgcccttcgacgacgacaagttcgacatctacaccatcgccttcggcatcagaaacgtgacccacatcgaccaggccctgcaggaggcccacagagtgctgaagcccggcggcagattcctgtgcctggagttcagccaggtgaacaaccccctgatcagcagactgtacgacctgtacagcttccaggtgatccccgtgctgggcgaggtgatcgccggcgactggaagagctaccagtacctggtggagagcatcagaagattccccagccaggaggagttcaaggacatgatcgaggacgccggcttccacaaggtgacctacgagagcctgaccagcggcatcgtggccatccacagcggcttcaagctgtag

SEQ ID NO: 17585 - DNA, 741 bp, Artificial Sequence
  Description of Artificial Sequence: Synthetic coding sequence
atggccgcccccggcagctgcgccctgtggagctactgcggcagaggctggagcagagccatgagaggctgccagctgctgggcctgagaagcagctggcccggcgacctgctgagcgccagactgctgagccaggagaagagagccgccgagacccacttcggcttcgagaccgtgagcgaggaggagaagggcggcaaggtgtaccaggtgttcgagagcgtggccaagaagtacgacgtgatgaacgacatgatgagcctgggcatccacagagtgtggaaggacctgctgctgtggaagatgcaccccctgcccggcacccagctgctggacgtggccggcggcaccggcgacatcaacaaggagatgctgaaggtgggcaagcagaaggccctggcccagggccacgacagaagatgcagactgagccagggcgacctgagaaagagcaacatcagacactgcggccacagcttctggctgcagaccctgatccccttcctgagctggagcatgaaccagagctaccccgtggagagcctggagctgaaggacaacctggccaacgagaccgccgccgagcacctgctgctgagaatcagagccctggacagctgcctgaacagaaccgtgagcaagtggaagaacaagttcctgagcctgttctacagcttcctgtggagctgcttcagccccagccccagaggcatctggagcgtgagcctgctgaactgctag

SEQ ID NO: 17586 - DNA, 1182 bp, Artificial Sequence
  Description of Artificial Sequence: Synthetic coding sequence
atgatcttcaccttcatgaccagaaagagctgctgcagcaagcaggtgcagagaaagtactggagaaactgccagaagctgaccgccaccggcagcgcccccttccccctggccctgcagagattcagcgtggtgtgggacgcctgcagcgaggccctgatcatgttcgacaaggacaacctggacgacatgggctacatcgtggagaacgacgtgatcatgcacgccctgaccaagcagctggaggccgtgagcgacagagtgaccgtgctgtacagaagcaaggccatcagatacacctggccctgccccttccccatggccgacagcagcccctgggtgcacatcaccctgggcgacggcagcaccttccagaccaagctgctgatcggcgccgacggccacaacagcggcgtgagacaggccgtgggcatccagaacgtgagctggaactacgaccagagcgccgtggtggccaccctgcacctgagcgaggccaccgagaacaacgtggcctggcagagattcctgcccagcggccccatcgccctgctgcccctgagcgacaccctgagcagcctggtgtggagcaccagccacgagcacgccgccgagctggtgagcatggacgaggagaagttcgtggacgccgtgaacagcgccttctggagcgacgccgaccacaccgacttcatcgacaccgccggcgccatgctgcagtacgccgtgagcctgctgaagcccaccaaggtgagcgccagacagctgccccccagcgtggccagagtggacgccaagagcagagtgctgttccccctgggcctgggccacgccgccgagtacgtgagacccagagtggccctgatcggcgacgccgcccacagagtgcaccccctggccggccagggcgtgaacatgggcttcggcgacatcagcagcctggcccaccacctgagcaccgccgccttcaacggcaaggacctgggcagcgtgagccacctgaccggctacgagaccgagagacagagacacaacaccgccctgctggccgccaccgacctgctgaagagactgtacagcaccagcgccagccccctggtgctgctgagaacctggggcctgcaggccaccaacgccgtgagccccctgaaggagcagatcatggccttcgccagcaagtag

SEQ ID NO: 17587 - DNA, 1407 bp, Artificial Sequence
  Description of Artificial Sequence: Synthetic coding sequence
atggccgccagactggtgagcagatgcggcgccgtgagagccgccccccacagcggccccctggtgagctggagaagatggagcggcgccagcaccgacaccgtgtacgacgtggtggtgagcggcggcggcctggtgggcgccgccatggcctgcgccctgggctacgacatccacttccacgacaagaagatcctgctgctggaggccggccccaagaaggtgctggagaagctgagcgagacctacagcaacagagtgagcagcatcagccccggcagcgccaccctgctgagcagcttcggcgcctgggaccacatctgcaacatgagatacagagccttcagaagaatgcaggtgtgggacgcctgcagcgaggccctgatcatgttcgacaaggacaacctggacgacatgggctacatcgtggagaacgacgtgatcatgcacgccctgaccaagcagctggaggccgtgagcgacagagtgaccgtgctgtacagaagcaaggccatcagatacacctggccctgccccttccccatggccgacagcagcccctgggtgcacatcaccctgggcgacggcagcaccttccagaccaagctgctgatcggcgccgacggccacaacagcggcgtgagacaggccgtgggcatccagaacgtgagctggaactacgaccagagcgccgtggtggccaccctgcacctgagcgaggccaccgagaacaacgtggcctggcagagattcctgcccagcggccccatcgccctgctgcccctgagcgacaccctgagcagcctggtgtggagcaccagccacgagcacgccgccgagctggtgagcatggacgaggagaagttcgtggacgccgtgaacagcgccttctggagcgacgccgaccacaccgacttcatcgacaccgccggcgccatgctgcagtacgccgtgagcctgctgaagcccaccaaggtgagcgccagacagctgccccccagcgtggccagagtggacgccaagagcagagtgctgttccccctgggcctgggccacgccgccgagtacgtgagacccagagtggccctgatcggcgacgccgcccacagagtgcaccccctggccggccagggcgtgaacatgggcttcggcgacatcagcagcctggcccaccacctgagcaccgccgccttcaacggcaaggacctgggcagcgtgagccacctgaccggctacgagaccgagagacagagacacaacaccgccctgctggccgccaccgacctgctgaagagactgtacagcaccagcgccagccccctggtgctgctgagaacctggggcctgcaggccaccaacgccgtgagccccctgaaggagcagatcatggccttcgccagcaagtag

SEQ ID NO: 17588 - DNA, 1332 bp, Artificial Sequence
  Description of Artificial Sequence: Synthetic coding sequence
atgagaggccagggcccccccctgagcagcttcggcgtgtggctggccagcagagccgccagcgaccccagcagacccagaagacagggctacgacatccacttccacgacaagaagatcctgctgctggaggccggccccaagaaggtgctggagaagctgagcgagacctacagcaacagagtgagcagcatcagccccggcagcgccaccctgctgagcagcttcggcgcctgggaccacatctgcaacatgagatacagagccttcagaagaatgcaggtgtgggacgcctgcagcgaggccctgatcatgttcgacaaggacaacctggacgacatgggctacatcgtggagaacgacgtgatcatgcacgccctgaccaagcagctggaggccgtgagcgacagagtgaccgtgctgtacagaagcaaggccatcagatacacctggccctgccccttccccatggccgacagcagcccctgggtgcacatcaccctgggcgacggcagcaccttccagaccaagctgctgatcggcgccgacggccacaacagcggcgtgagacaggccgtgggcatccagaacgtgagctggaactacgaccagagcgccgtggtggccaccctgcacctgagcgaggccaccgagaacaacgtggcctggcagagattcctgcccagcggccccatcgccctgctgcccctgagcgacaccctgagcagcctggtgtggagcaccagccacgagcacgccgccgagctggtgagcatggacgaggagaagttcgtggacgccgtgaacagcgccttctggagcgacgccgaccacaccgacttcatcgacaccgccggcgccatgctgcagtacgccgtgagcctgctgaagcccaccaaggtgagcgccagacagctgccccccagcgtggccagagtggacgccaagagcagagtgctgttccccctgggcctgggccacgccgccgagtacgtgagacccagagtggccctgatcggcgacgccgcccacagagtgcaccccctggccggccagggcgtgaacatgggcttcggcgacatcagcagcctggcccaccacctgagcaccgccgccttcaacggcaaggacctgggcagcgtgagccacctgaccggctacgagaccgagagacagagacacaacaccgccctgctggccgccaccgacctgctgaagagactgtacagcaccagcgccagccccctggtgctgctgagaacctggggcctgcaggccaccaacgccgtgagccccctgaaggagcagatcatggccttcgccagcaagtag

SEQ ID NO: 17589 - DNA, 441 bp, Artificial Sequence
  Description of Artificial Sequence: Synthetic coding sequence
atggccgccagactggtgagcagatgcggcgccgtgagagccgccccccacagcggccccctggtgagctggagaagatggagcggcgccagcaccgacaccgtgtacgacgtggtggtgagcggcggcggcctggtgggcgccgccatggcctgcgccctgggctacgacatccacttccacgacaagaagatcctgctgctggaggccggccccaagaaggtgctggagaagctgagcgagacctacagcaacagagtgagcagcatcagccccggcagcgccaccctgctgagcagcttcggcgcctgggaccacatctgcaacatgagatacagagccttcagaagaatgcaggtgcccctgtacctgttcaacttcgtgaagatgagctggagcgtgctgagatacagaagccccctgagccccagcgtgctgtag

SEQ ID NO: 17590 - DNA, 417 bp, Artificial Sequence
  Description of Artificial Sequence: Synthetic coding sequence
atgacctggtggtgcagagtggaggcctggtgggccctgccctggcccgtgccctgggacatgatcttcaccttcatgaccagaaagagctgctgcagcaagcaggtgcagagaaagtactggagaaactgccagaagctgaccgccaccggcagcgcccccttccccctggccctgcagagattcagcgtggtgtgggacgcctgcagcgaggccctgatcatgttcgacaaggacaacctggacgacatgggctacatcgtggagaacgacgtgatcatgcacgccctgaccaagcagctggaggccgtgagcgacagagtgaccgtgctgtacagaagcaaggccatcagatacacctggccctgccccttccccatggccgacagcagcccctgggtgcacatcaccctgtag

SEQ ID NO: 17591 - DNA, 789 bp, Artificial Sequence
  Description of Artificial Sequence: Synthetic coding sequence
atgatcttcaccttcatgaccagaaagagctgctgcagcaagcaggtgcagagaaagtactggagaaactgccagaagctgaccgccaccggcagcgcccccttccccctggccctgcagagattcagcgtggtgtgggacgcctgcagcgaggccctgatcatgttcgacaaggacaacctggacgacatgggctacatcgtggagaacgacgtgatcatgcacgccctgaccaagcagctggaggccgtgagcgacagagtgaccgtgctgtacagaagcaaggccatcagatacacctggccctgccccttccccatggccgacagcagcccctgggtgcacatcaccctgggcgacggcagcaccttccagaccaagctgctgatcggcgccgacggccacaacagcggcgtgagacaggccgtgggcatccagaacgtgagctggaactacgaccagagcgccgtggtggccaccctgcacctgagcgaggccaccgagaacaacgtggcctggcagagattcctgcccagcggccccatcgccctgctgcccctgagcgacaccctgagcagcctggtgtggagcaccagccacgagcacgccgccgagctggtgagcatggacgaggagaagttcgtggacgccgtgaacagcgccttctggagcgacgccgaccacaccgacttcatcgacaccgccggcgccatgctgcagtacgccgtgagcctgctgaagcccaccaaggtgagcgccagacagctgccccccagcgtggccagatag

SEQ ID NO: 17592 - DNA, 1176 bp, Artificial Sequence
  Description of Artificial Sequence: Synthetic coding sequence
atgatcttcaccttcatgaccagaaagagctgctgcagcaagcaggtgcagagaaagtactggagaaactgccagaagctgaccgccaccggcagcgcccccttccccctggccctgcagagattcagcgtggtgtgggacgcctgcagcgaggccctgatcatgttcgacaaggacaacctggacgacatgggctacatcgtggagaacgacgtgatcatgcacgccctgaccaagcagctggaggccgtgagcgacagagtgaccgtgctgtacagaagcaaggccatcagatacacctggccctgccccttccccatggccgacagcagcccctgggtgcacatcaccctgggcgacggcagcaccttccagaccaagctgctgatcggcgccgacggccacaacagcggcgtgagacaggccgtgggcatccagaacgtgagctggaactacgaccagagcgccgtggtggccaccctgcacctgagcgaggccaccgagaacaacgtggcctggcagagattcctgcccagcggccccatcgccctgctgcccctgagcgacaccctgagcagcctggtgtggagcaccagccacgagcacgccgccgagctggtgagcatggacgaggagaagttcgtggacgccgtgaacagcgccttctggagcgacgccgaccacaccgacttcatcgacaccgccggcgccatgctgcagtacgccgtgagcctgctgaagcccaccaaggtgagcgccagacagctgccccccagcgtggccagagtggacgccaagagcagagtgctgttccccctgggcctgggccacgccgccgagtacgtgagacccagagtggccctgatcggcgacgccgcccacagagtgcaccccctggccggccagggcgtgaacatgggcttcggcgacatcagcagcctggcccaccacctgagcaccgccgccttcaacggcaaggacctgggcagcgtgagccacctgaccggctacgagaccgagagacagagacacaacaccgccctgctggccgccaccgacctgctgaagagactgtacagcaccagcgccagccccctggtgctgctgagaacctggggcctgcaggccaccaacgccgtgagccccctgaagatcatggccttcgccagcaagtag

SEQ ID NO: 17593 - DNA, 468 bp, Artificial Sequence
  Description of Artificial Sequence: Synthetic coding sequence
atggccggcgccgtgagcctgctgggcgtggtgggcctgctgctggtgagcgccctgagcggcgtgctgggcgacagagccaaccccgacctgagagcccaccccggcaacgccgcccaccccggcagcggcgccaccgagcccagaagaagaccccccctgaaggaccagagagagagaaccagagccggcagcctgcccctgggcgccctgtacaccgccgccgtggccgccttcgtgctgtacaagtgcctgcagggcaaggacgagaccgccgtgctgcacgaggaggccagcaagcagcagcccctgcagagcgagcagcagctggcccagctgacccagcagctggcccagaccgagcagcacctgaacaacctgatggcccagctggaccccctgttcgagagacccgccggcgccagcgagcacgaggccatggaccaccccagagccgccgccagatag

SEQ ID NO: 17594 - DNA, 414 bp, Artificial Sequence
  Description of Artificial Sequence: Synthetic coding sequence
atggccggcgccgtgagcctgctgggcgtggtgggcctgctgctggtgagcgccctgagcggcgtgctgggcgacagagccaaccccgacctgagagcccaccccggcaacgccgcccaccccggcagcggcgccaccgagcccagaagaagaccccccctgaaggaccagagagagagaaccagagccggcagcctgcccctgggcgccctgtacaccgccgccgtggccgccttcgtgctgtacaagtgcctgcagggcaaggacgagaccgccgtgctgcacgaggaggccagcaagcagcagcccctgcagagcgagcagcagctggcccagctgacccagcagctggcccagaccgagcagcacctgaacaacctgatggcccagctggaccccctgttcgagagatag

SEQ ID NO: 17595 - DNA, 420 bp, Artificial Sequence
  Description of Artificial Sequence: Synthetic coding sequence
atggccggcgccgtgagcctgctgggcgtggtgggcctgctgctggtgagcgccctgagcggcgtgctgggcgacagagccaaccccgacctgagagcccaccccggcaacgccgcccaccccggcagcggcgccaccgagcccagaagaagaccccccctgaaggaccagagagagagaaccagagccggcagcctgcccctgggcgccctgtacaccgccgccgtggccgccttcgtgctgtacaagtgcctgcagggcaaggacgagaccgccgtgctgcacgaggaggccagcaagcagcagcccctgcagagcgagcagcagctggcccagctgacccagcagctggcccagaccgagcagcacctgaacaacctgatggcccagctggaccccctgttcgagagaagcttctag

SEQ ID NO: 17596 - DNA, 771 bp, Artificial Sequence
  Description of Artificial Sequence: Synthetic coding sequence
atggccggcgccgtgagcctgctgggcgtggtgggcctgctgctggtgagcgccctgagcggcgtgctgggcgacagagccaaccccgacctgagagcccaccccggcaacgccgcccaccccggcagcggcgccaccgagcccagaagaagaccccccctgaaggaccagagagagagaaccagagccggcagcctgcccctgggcgccctgtacaccgccgccgtggccgccttcgtgctgtacaagtgcctgcagggcaaggacgagaccgccgtgctgcacgaggaggccagcaagcagcagcccctgcagagcgagcagcagctggcccagctgacccagcagctggcccagaccgagcagcacctgaacaacctgatggcccagctggaccccctgttcgagagagtgaccaccctggccggcgcccagcaggagctgctgaacatgaagctgtggaccatccacgagctgctgcaggacagcaagcccgacaaggacatggaggccagcgagcccgaggccagcagacccctgcccgaggacttctgcctgaaggaggacgaggaggagatcggcgacagccaggcctgggaggagcccaccaactggagcaccgagacctggaacctggccaccagctgggaggtgggcagaggcctgagaagaagatgcagccaggccgtggccaagggccccagccacagcctgggctgggagggcggcaccaccgccgagggcagactgaagcagagcctgttcagctag

SEQ ID NO: 17597 - DNA, 360 bp, Artificial Sequence
  Description of Artificial Sequence: Synthetic coding sequence
atggccggcgccgtgagcctgctgggcgtggtgggcctgctgctggtgagcgccctgagcggcgtgctgggcgacagagccaaccccgacctgagagcccaccccggcaacgccgcccaccccggcagcggcgccaccgagcccagaagaagaccccccctgaaggaccagagagagagaaccagagccggcagcctgcccctgggcgccctgtacaccgccgccgtggccgccttcgtgctgtacaagtgcctgcagggcaaggacgagaccgccgtgctgcacgaggaggccagcaagcagcagcccctgcagagcggcggcttcagcagaagcctgtgctgggtgggcggcgtgtag

SEQ ID NO: 17598 - DNA, 852 bp, Artificial Sequence
  Description of Artificial Sequence: Synthetic coding sequence
atggccggcgccgtgagcctgctgggcgtggtgggcctgctgctggtgagcgccctgagcggcgtgctgggcgacagagccaaccccgacctgagagcccaccccggcaacgccgcccaccccggcagcggcgccaccgagcccagaagaagaccccccctgaaggaccagagagagagaaccagagccggcagcctgcccctgggcgccctgtacaccgccgccgtggccgccttcgtgctgtacaagtgcctgcagggcaaggacgagaccgccgtgctgcacgaggaggccagcaagcagcagcccctgcagagcgagcagcagctggcccagctgacccagcagctggcccagaccgagcagcacctgaacaacctgatggcccagctggaccccctgttcgagagagtgaccaccctggccggcgcccagcaggagctgctgaacatgaagctgtggaccatccacgagctgctgcaggacagcaagcccgacaaggacatggaggccagcgagcccggcgagggcagcggcggcgagagcgccggcggcggcgacaaggtgagcgagaccggcaccttcctgatcagcccccacaccgaggccagcagacccctgcccgaggacttctgcctgaaggaggacgaggaggagatcggcgacagccaggcctgggaggagcccaccaactggagcaccgagacctggaacctggccaccagctgggaggtgggcagaggcctgagaagaagatgcagccaggccgtggccaagggccccagccacagcctgggctgggagggcggcaccaccgccgagggcagactgaagcagagcctgttcagctag

SEQ ID NO: 17599 - DNA, 1011 bp, Artificial Sequence
  Description of Artificial Sequence: Synthetic coding sequence
atgctgcagagaggcctgtggccctggagaaccagactgctgcccacccccggcacctggagacccgccagaccctggcccctgcccccccccccccaggtgctgagagtgaagctgtgcggcaacgtgaagtactaccagagccaccactacagcaccgtggtgccccccgacgagatcaccgtgatctacagacacggcctgcccctggtgaccctgaccctgcccagcagaaaggagagatgccagttcgtggtgaagcccatgctgagcaccgtgggcagcttcctgcaggacctgcagaacgaggacaagggcatcaagaccgccgccatcttcaccgccgacggcaacatgatcagcgccagcaccctgatggacatcctgctgatgaacgacttcaagctggtgatcaacaagatcgcctacgacgtgcagtgccccaagagagagaagcccagcaacgagcacaccgccgagatggagcacatgaagagcctggtgcacagactgttcaccatcctgcacctggaggagagccagaagaagagagagcaccacctgctggagaagatcgaccacctgaaggagcagctgcagcccctggagcaggtgaaggccggcatcgaggcccacagcgaggccaagaccagcggcctgctgtgggccggcctggccctgctgagcatccagggcggcgccctggcctggctgacctggtgggtgtacagctgggacatcatggagcccgtgacctacttcatcaccttcgccaacagcatggtgttcttcgcctacttcatcgtgaccagacaggactacacctacagcgccgtgaagagcagacagttcctgcagttcttccacaagaagagcaagcagcagcacttcgacgtgcagcagtacaacaagctgaaggaggacctggccaaggccaaggagagcctgaagcaggccagacacagcctgtgcctgcagatgcaggtggaggagctgaacgagaagaactag

SEQ ID NO: 17600 - DNA, 1689 bp, Artificial Sequence
  Description of Artificial Sequence: Synthetic coding sequence
atggacctgcccgagggccccgtgggcggccccaccgccgagatgtacctgagagagagacccgaggaggccagactgggcatgcccgtgagcctggaggagcagatcctgaacagcaccttcgaggcctgcgacccccagagaaccggcaccgtggccgtggcccaggtgctggcctacctggaggccgtgaccggccagggcccccaggacgccagactgcagaccctggccaacagcctggaccccaacggcgagggccccaaggccaccgtggacctggacaccttcctggtggtgatgagagactggatcgccgcctgccagctgcacggcggcctggagctggaggaggagaccgccttccagggcgccctgaccagcagacagctgcccagcggctgccccgaggccgaggagcccgccaacctggagagcttcggcggcgaggaccccagacccgagctgcaggccaccgccgacctgctgagcagcctggaggacctggagctgagcaacagaagactggtgggcgagaacgccaagctgcagagaagcatggagaccgccgaggagggcagcgccagactgggcgaggagatcctggccctgagaaagcagctgcacagcacccagcaggccctgcagttcgccaaggccatggacgaggagctggaggacctgaagaccctggccagaagcctggaggagcagaacagaagcctgctggcccaggccagacaggccgagaaggagcagcagcacctggtggccgagatggagaccctgcaggaggagaacggcaagctgctggccgagagagacggcgtgaagaagagaagccaggagctggccatggagaaggacaccctgaagagacagctgttcgagtgcgagcacctgatctgccagagagacaccatcctgagcgagagaaccagagacgtggagagcctggcccagaccctggaggagtacagagtgaccacccaggagctgagactggagatcagcagactggaggagcagctgagccagacctacgagggccccgacgagctgcccgagggcgcccagctgagaagagtgggctggaccgagctgctgccccccagcctgggcctggagatcgaggccatcagacagaagcaggaggtggccaccgccgacctgagcaaccccctgtgcggcgtgtggcagtgggaggaggtgatccacgagaccagcgaggagaccgagttccccagcgaggcccccgccggcggccagagaaacttccagggcgagcccgcccaccccgaggagggcagaaaggagcccagcatgtggctgaccagaagagaggaggaggaggacgccgagagccaggtgaccgccgacctgcccgtgcccctgggcgcccccagacccggcgacatccccgagaacccccccgagagacccgccagaagagagctgcagcaggccctggtgcccgtgatgaagaagctggtgcccgtgagaagaagagcctggggccagctgtgcctgcccccccagagactgagagtgaccagacaccccctgatccccgcccccgtgctgggcctgctgctgctgctgctgctgagcgtgctgctgctgggccccagccccccccccacctggccccacctgcagctgtgctacctgcagcccccccccgtgtag

SEQ ID NO: 17601 - DNA, 357 bp, Artificial Sequence
  Description of Artificial Sequence: Synthetic coding sequence
atgaccaagaagaagagagagaacctgggcgtggccctggagatcgacggcctggaggagaagctgagccagtgcagaagagacctggaggccgtgaacagcagactgcacagcagagagctgagccccgaggccagagagggcaccgaggtgagcagcgccagagagcccgaggagcacgccgccctgtgcggccacctgtacccccccgacgccagactgtgcctgctggaccacgtgagcctggccctgccccacaaccagcacagactgcccctgggccccctgatcagaatcaagcaggccctgcaggccagcatcggccccagatgctggggcgtgcccctgcccacctag

SEQ ID NO: 17602 - DNA, 294 bp, Artificial Sequence
  Description of Artificial Sequence: Synthetic coding sequence
atgaccaagaagaagagagagaacctgggcgtggccctggagatcgacggcctggaggagaagctgagccagtgcagaagagacctggaggccgtgaacagcagactgcacagcagagagctgagccccgaggccagaagaagcctggagaaggagaagaacagcctgatgaacaaggccagcaactacgagaaggagctgaagttcctgagacaggagaacagaaagaacatgctgctgagcgtggccatcttcatcctgctgaccctggtgtacgcctactggaccatgtag

SEQ ID NO: 17603 - DNA, 345 bp, Artificial Sequence
  Description of Artificial Sequence: Synthetic coding sequence
atgaccaagaagaagagagagaacctgggcgtggccctggagatcgacggcctggaggagaagctgagccagtgcagaagagacctggaggccgtgaacagcagactgcacagcagagagctgagccccgaggccagagagggcaccgaggtgagcagcgccagagagcccgaggagcacgccgccctgtgcggccacctgtacccccccgacgccagactgtgcctgctggaccacgtgagcctggccctgccccacaaccagcacagactgcccctgggccccctgatcagaatcaagcaggccctgcaggccagcatcggccccagatgctggggcgtgtag

SEQ ID NO: 17604 - DNA, 753 bp, Artificial Sequence
  Description of Artificial Sequence: Synthetic coding sequence
atggccgccggcaccagcagctactgggaggacctgagaaagcaggccagacagctggagaacgagctggacctgaagctggtgagcttcagcaagctgtgcaccagctacagccacagcagcaccagagacggcagaagagacagatacagcagcgacaccacccccctgctgaacggcagcagccaggacagaatgttcgagaccatggccatcgagatcgagcagctgctggccagactgaccggcgtgaacgacaagatggccgagtacaccaacagcgccggcgtgcccagcctgaacgccgccctgatgcacaccctgcagagacacagagacatcctgcaggactacacccacgagttccacaagaccaaggccaacttcatggccatcagagagagagagaacctgatgggcagcgtgagaaaggacatcgagagctacaagagcggcagcggcgtgaacaacagaagaaccgagctgttcctgaaggagcacgaccacctgagaaacagcgacagactgatcgaggagaccatcagcatcgccatggccaccaaggagaacatgaccagccagagaggcatgctgaagagcatccacagcaagatgaacaccctggccaacagattccccgccgtgaacagcctgatccagagaatcaacctgagaaagagaagagacagcctgatcctgggcggcgtgatcggcatctgcaccatcctgctgctgctgtacgccttccactag

SEQ ID NO: 17605 - DNA, 1452 bp, Artificial Sequence
  Description of Artificial Sequence: Synthetic coding sequence
atgaaggccttccacaccttctgcgtggtgctgctggtgttcggcagcgtgagcgaggccaagttcgacgacttcgaggacgaggaggacatcgtggagtacgacgacaacgacttcgccgagttcgaggacgtgatggaggacagcgtgaccgagagcccccagagagtgatcatcaccgaggacgacgaggacgagaccaccgtggagctggagggccaggacgagaaccaggagggcgacttcgaggacgccgacacccaggagggcgacaccgagagcgagccctacgacgacgaggagttcgagggctacgaggacaagcccgacaccagcagcagcaagaacaaggaccccatcaccatcgtggacgtgcccgcccacctgcagaacagctgggagagctactacctggagatcctgatggtgaccggcctgctggcctacatcatgaactacatcatcggcaagaacaagaacagcagactggcccaggcctggttcaacacccacagagagctgctggagagcaacttcaccctggtgggcgacgacggcaccaacaaggaggccaccagcaccggcaagctgaaccaggagaacgagcacatctacaacctgtggtgcagcggcagagtgtgctgcgagggcatgctgatccagctgagattcctgaagagacaggacctgctgaacgtgctggccagaatgatgagacccgtgagcgaccaggtgcagatcaaggtgaccatgaacgacgaggacatggacacctacgtgttcgccgtgggcaccagaaaggccctggtgagactgcagaaggagatgcaggacctgagcgagttctgcagcgacaagcccaagagcggcgccaagtacggcctgcccgacagcctggccatcctgagcgagatgggcgaggtgaccgacggcatgatggacaccaagatggtgcacttcctgacccactacgccgacaagatcgagagcgtgcacttcagcgaccagttcagcggccccaagatcatgcaggaggagggccagcccctgaagctgcccgacaccaagagaaccctgctgttcaccttcaacgtgcccggcagcggcaacacctaccccaaggacatggaggccctgctgcccctgatgaacatggtgatctacagcatcgacaaggccaagaagttcagactgaacagagagggcaagcagaaggccgacaagaacagagccagagtggaggagaacttcctgaagctgacccacgtgcagagacaggaggccgcccagagcagaagagaggagaagaagagagccgagaaggagagaatcatgaacgaggaggaccccgagaagcagagaagactggaggaggccgccctgagaagagagcagaagaagctggagaagaagcagatgaagatgaagcagatcaaggtgaaggccatgtag

SEQ ID NO: 17606 - DNA, 1236 bp, Artificial Sequence
  Description of Artificial Sequence: Synthetic coding sequence
atgatgggcagaagccccggcttcgccatgcagcacatcgtgggcgtgccccacgtgctggtgagaagaggcctgctgggcagagacctgttcatgaccagaaccctgtgcagccccggccccagccagcccggcgagaagagacccgaggaggtggccctgggcctgcaccacagactgcccgccctgggcagagccctgggccacagcatccagcagagagccaccagcaccgccaagacctggtgggacagatacgaggagttcgtgggcctgaacgaggtgagagaggcccagggcaaggtgaccgaggccgagaaggtgttcatggtggccagaggcctggtgagagaggccagagaggacctggaggtgcaccaggccaagctgaaggaggtgagagacagactggacagagtgagcagagaggacagccagtacctggagctggccaccctggagcacagaatgctgcaggaggagaagagactgagaaccgcctacctgagagccgaggacagcgagagagagaagttcagcctgttcagcgccgccgtgagagagagccacgagaaggagagaaccagagccgagagaaccaagaactggagcctgatcggcagcgtgctgggcgccctgatcggcgtggccggcagcacctacgtgaacagagtgagactgcaggagctgaaggccctgctgctggaggcccagaagggccccgtgagcctgcaggaggccatcagagagcaggccagcagctacagcagacagcagagagacctgcacaacctgatggtggacctgagaggcctggtgcacgccgccggccccggccaggacagcggcagccaggccggcagcccccccaccagagacagagacgtggacgtgctgagcgccgccctgaaggagcagctgagccacagcagacaggtgcacagctgcctggagggcctgagagagcagctggacggcctggagaagacctgcagccagatggccggcgtggtgcagctggtgaagagcgccgcccaccccggcctggtggagcccgccgacggcgccatgcccagcttcctgctggagcagggcagcatgatcctggccctgagcgacaccgagcagagactggaggcccaggtgaacagaaacaccatctacagcaccctggtgacctgcgtgaccttcgtggccaccctgcccgtgctgtacatgctgttcaaggccagctag

SEQ ID NO: 17607 - DNA, 1236 bp, Artificial Sequence; identical to SEQ ID NO: 17606
  Description of Artificial Sequence: Synthetic coding sequence

SEQ ID NO: 17608 - DNA, 909 bp, Artificial Sequence
  Description of Artificial Sequence: Synthetic coding sequence
atggtggccagaggcctggtgagagaggccagagaggacctggaggtgcaccaggccaagctgaaggaggtgagagacagactggacagagtgagcagagaggacagccagtacctggagctggccaccctggagcacagaatgctgcaggaggagaagagactgagaaccgcctacctgagagccgaggacagcgagagagagaagttcagcctgttcagcgccgccgtgagagagagccacgagaaggagagaaccagagccgagagaaccaagaactggagcctgatcggcagcgtgctgggcgccctgatcggcgtggccggcagcacctacgtgaacagagtgagactgcaggagctgaaggccctgctgctggaggcccagaagggccccgtgagcctgcaggaggccatcagagagcaggccagcagctacagcagacagcagagagacctgcacaacctgatggtggacctgagaggcctggtgcacgccgccggccccggccaggacagcggcagccaggccggcagcccccccaccagagacagagacgtggacgtgctgagcgccgccctgaaggagcagctgagccacagcagacaggtgcacagctgcctggagggcctgagagagcagctggacggcctggagaagacctgcagccagatggccggcgtggtgcagctggtgaagagcgccgcccaccccggcctggtggagcccgccgacggcgccatgcccagcttcctgctggagcagggcagcatgatcctggccctgagcgacaccgagcagagactggaggcccaggtgaacagaaacaccatctacagcaccctggtgacctgcgtgaccttcgtggccaccctgcccgtgctgtacatgctgttcaaggccagctag

SEQ ID NO: 17609 - DNA, 189 bp, Artificial Sequence
  Description of Artificial Sequence: Synthetic coding sequence
atgatgggcagaagccccggcttcgccatgcagcacatcgtgggcgtgccccacgtgctggtgagaagaggcctgctgggcagagacctgttcatgaccagaaccctgtgcagccccggccccagccagcccggcgagaagagacccgaggaggtggccctgggcctgcaccacagactgcccgcctag

SEQ ID NO: 17610 - DNA, 909 bp, Artificial Sequence; identical to SEQ ID NO: 17608
  Description of Artificial Sequence: Synthetic coding sequence

SEQ ID NO: 17611 - DNA, 480 bp, Artificial Sequence
  Description of Artificial Sequence: Synthetic coding sequence
atgatgggcagaagccccggcttcgccatgcagcacatcgtgggcgtgccccacgtgctggtgagaagaggcctgctgggcagagacctgttcatgaccagaaccctgtgcagccccggccccagccagcccggcgagaagagacccgaggaggtggccctgggcctgcaccacagactgcccgccctgggcagagccctgggccacagcatccagcagagagccaccagcaccgccaagacctggtgggacagatacgaggagttcgtgggcctgaacgaggtgagagaggcccagggcaaggtgaccgaggccgagaaggtgttcatggtggccagaggcctggtgagagaggccagagaggacctggaggtgcaccaggccaagctgaaggaggtgagagacagactggacagagtgagcagagaggacagccagtacctggagctggccaccctggagcacagaatgctgcagtag

SEQ ID NO: 17612 - DNA, 909 bp, Artificial Sequence; identical to SEQ ID NO: 17608
  Description of Artificial Sequence: Synthetic coding sequence

SEQ ID NO: 17613 - DNA, 321 bp, Artificial Sequence
  Description of Artificial Sequence: Synthetic coding sequence
atggccagcagcggcgccggcgaccccctggacagcaagagaggcgaggcccccttcgcccagagaatcgaccccaccagagagaagctgacccccgagcagctgcacagcatgagacaggccgagctggcccagtggcagaaggtgctgcccagaagaagaaccagaaacatcgtgaccggcctgggcatcggcgccctggtgctggccatctacggctacaccttctacagcatcagccaggagagattcctggacgagctggaggacgaggccaaggccgccagagccagagccctggccagagccagcggcagctag

SEQ ID NO: 17614 - DNA, 435 bp, Artificial Sequence
  Description of Artificial Sequence: Synthetic coding sequence
atggccgcccccagcggcggcgtgaactgcgaggagttcgccgagttccaggagctgctgaaggtgatgagaaccatcgacgacagaatcgtgcacgagctgaacaccaccgtgcccaccgccagcttcgccggcaagatcgacgccagccagacctgcaagcagctgtacgagagcctgatggccgcccacgccagcagagacagagtgatcaagaactgcatcgcccagaccagcgccgtggtgaagaacctgagagaggagagagagaagaacctggacgacctgaccctgctgaagcagctgagaaaggagcagaccaagctgaagtggatgcagagcgagctgaacgtggaggaggtggtgaacgacagaagctggaaggtgttcaacgagagatgcagaatccacttcaagccccccaagaacgagtag

SEQ ID NO: 17615 - DNA, 774 bp, Artificial Sequence
  Description of Artificial Sequence: Synthetic coding sequence
atggactgcggcagcgtgggcggccagagaacccagagactgcccggcagacagagactgctgttcctgcccgtgggcctgagcggcagacccggcggcagcgagaccagcgccagaagatgcctgagcgccctgagcgacggcctgggcgccctgagacccagagcccccgccgccagaggcggcgtgagcagagccagccccctgctgctgctgctgctggtgcccagccccagactggccgccgccgcccccagaagacagctgggcgactgggagagaagcagactgggctacgccgccccccccgccggcagaagcagcgcctggagatgcagccccggcgtggccgccgccgccggcgccctgccccagtaccacggccccgcccccgccctggtgagctgcagaagagagctgagcctgagcgccggcagcctgcagctggagagaaagagaagagacttcaccagcagcggcagcagaaagctgtacttcgacacccacgccctggtgtgcctgctggaggacaacgagagccacagcttcatccaggccggcgtgcagtggcacagcctgggcctgctgcagccccccccccccggcttcaagagaagcagccacctgatcctgctgagcagctgggactacagacacgcccccccccacctggacaacttcagcgtgttcctgctggagaccggcttccaccacgtgggccaggccggcctgaagctgctgaccagcagcgacccccccaccctggccagctag

SEQ ID NO: 17616 - DNA, 1080 bp, Artificial Sequence
  Description of Artificial Sequence: Synthetic coding sequence
atggactgcggcagcgtgggcggccagagaacccagagactgcccggcagacagagactgctgttcctgcccgtgggcctgagcggcagacccggcggcagcgagaccagcgccagaagatgcctgagcgccctgagcgacggcctgggcgccctgagacccagagcccccgccgccagaggcggcgtgagcagagccagccccctgctgctgctgctgctggtgcccagccccagactggccgccgccgcccccagaagacagctgggcgactgggagagaagcagactgggctacgccgccccccccgccggcagaagcagcgcctggagatgcagccccggcgtggccgccgccgccggcgccctgccccagtaccacggccccgcccccgccctggtgagctgcagaagagagctgagcctgagcgccggcagcctgcagctggagagaaagagaagagacttcaccagcagcggcagcagaaagctgtacttcgacacccacgccctggtgtgcctgctggaggacaacggcttcgccacccagcaggccgagatcatcgtgagcgccctggtgaagatcctggaggccaacatggacatcgtgtacaaggacatggtgaccaagatgcagcaggagatcaccttccagcaggtgatgagccagatcgccaacgtgaagaaggacatgatcatcctggagaagagcgagttcagcgccctgagagccgagaacgagaagatcaagctggagctgcaccagctgaagcagcaggtgatggacgaggtgatcaaggtgagaaccgacaccaagctggacttcaacctggagaagagcagagtgaaggagctgtacagcctgaacgagaagaagctgctggagctgagaaccgagatcgtggccctgcacgcccagcaggacagagccctgacccagaccgacagaaagatcgagaccgaggtggccggcctgaagaccatgctggagagccacaagctggacaacatcaagtacctggccggcagcatcttcacctgcctgaccgtggccctgggcttctacagactgtggatctag

SEQ ID NO: 17617 - DNA, 738 bp, Artificial Sequence
  Description of Artificial Sequence: Synthetic coding sequence
atgctggccaactgcggcagcgtgtgcgaggagacccagttcagaggcaccaccgtggcccccgccctgggcgagttcttcaccaccaccaccaaggagggctacgacagaagacccgtggacatcacccccctggagcagagaaagctgaccttcgacacccacgccctggtgcaggacctggagacccacggcttcgacaagacccaggccgagaccatcgtgagcgccctgaccgccctgagcaacgtgagcctggacaccatctacaaggagatggtgacccaggcccagcaggagatcaccgtgcagcagctgatggcccacctggacgccatcagaaaggacatggtgatcctggagaagagcgagttcgccaacctgagagccgagaacgagaagatgaagatcgagctggaccaggtgaagcagcagctgatgcacgagaccagcagaatcagagccgacaacaagctggacatcaacctggagagaagcagagtgaccgacatgttcaccgaccaggagaagcagctgatggagaccaccaccgagttcaccaagaaggacacccagaccaagagcatcatcagcgagaccagcaacaagatcgacgccgagatcgccagcctgaagaccctgatggagagcaacaagctggagaccatcagatacctggccgccagcgtgttcacctgcctggccatcgccctgggcttctacagattctggaagtag

SEQ ID NO: 17618 - DNA, 462 bp, Artificial Sequence
  Description of Artificial Sequence: Synthetic coding sequence
atggtgacccaggcccagcaggagatcaccgtgcagcagctgatggcccacctggacgccatcagaaaggacatggtgatcctggagaagagcgagttcgccaacctgagagccgagaacgagaagatgaagatcgagctggaccaggtgaagcagcagctgatgcacgagaccagcagaatcagagccgacaacaagctggacatcaacctggagagaagcagagtgaccgacatgttcaccgaccaggagaagcagctgatggagaccaccaccgagttcaccaagaaggacacccagaccaagagcatcatcagcgagaccagcaacaagatcgacgccgagatcgccagcctgaagaccctgatggagagcaacaagctggagaccatcagatacctggccgccagcgtgttcacctgcctggccatcgccctgggcttctacagattctggaagtag

SEQ ID NO: 17619 - DNA, 462 bp, Artificial Sequence; identical to SEQ ID NO: 17618
  Description of Artificial Sequence: Synthetic coding sequence

SEQ ID NO: 17620 - DNA, 765 bp, Artificial Sequence
  Description of Artificial Sequence: Synthetic coding sequence
atgaacagcagacaggcctggagactgttcctgagccagggcagaggcgacagatgggtgagcagacccagaggccacttcagccccgccctgagaagagagttcttcaccaccaccaccaaggagggctacgacagaagacccgtggacatcacccccctggagcagagaaagctgaccttcgacacccacgccctggtgcaggacctggagacccacggcttcgacaagacccaggccgagaccatcgtgagcgccctgaccgccctgagcaacgtgagcctggacaccatctacaaggagatggtgacccaggcccagcaggagatcaccgtgcagcagctgatggcccacctggacgccatcagaaaggacatggtgatcctggagaagagcgagttcgccaacctgagagccgagaacgagaagatgaagatcgagctggaccaggtgaagcagcagctgatgcacgagaccagcagaatcagagccgacaacaagctggacatcaacctggagagaagcagagtgaccgacatgttcaccgaccaggagaagcagctgatggagaccaccaccgagttcaccaagaaggacacccagaccaagagcatcatcagcgagaccagcaacaagatcgacgccgagatcgccagcctgaagaccctgatggagagcaacaagctggagaccatcagatacctggccgccagcgtgttcacctgcctggccatcgccctgggcttctacagattctggaagtag

SEQ ID NO: 17621 - DNA, 1236 bp, Artificial Sequence
  Description of Artificial Sequence: Synthetic coding sequence
atgcccatgtggaacaaggtgagcggcgtgcacctgagccccagcagccccgagatcgtgctggacagagaccacagcagcagcatcggctgcctgagcagcgacgccatcatcagcagccccgagaacacccacgccgccaacagcatcgtgagccagaccatccccaaggcccagatccagcagagcacccacacccacctggacatcagcctgttccccctgggcctgaccgacgagaagagcaacggcaccatcgccctggtggacgacagcgaggaccccggcgccaacgtgagcaacatccagctgcagcagaagatcagcagcctggagatcaagctgaaggtgagcgaggaggagaagcagagaatcaagcaggacgtggagagcctgatggagaagcacaacgtgctggagaagggcttcctgaaggagaaggagcaggaggccatcagcttccaggacagatacaaggagctgcaggagaagcacaagcaggagctggaggacatgagaaaggccggccacgaggccctgagcatcatcgtggacgagtacaaggccctgctgcagagcagcgtgaagcagcaggtggaggccatcgagaagcagtacatcagcgccatcgagaagcaggcccacaagtgcgaggagctgctgaacgcccagcaccagagactgctggagatgctggacaccgagaaggagctgctgaaggagaagatcaaggaggccctgatccagcagagccaggagcagaaggagatcctggagaagtgcctggaggaggagagacagagaaacaaggaggccctggtgagcgccgccaagctggagaaggaggccgtgaaggacgccgtgctgaaggtggtggaggaggagagaaagaacctggagaaggcccacgccgaggagagagagctgtggaagaccgagcacgccaaggaccaggagaaggtgagccaggagatccagaaggccatccaggagcagagaaagatcagccaggagaccgtgaaggccgccatcatcgaggagcagaagagaagcgagaaggccgtggaggaggccgtgaagagaaccagagacgagctgatcgagtacatcaaggagcagaagagactggaccaggtgatcagacagagaagcctgagcagcctggagctgttcctgagctgcgcccagaagcagctgagcgccctgatcgccaccgagcccgtggacatcgagtag

SEQ ID NO: 17622 - DNA, 1218 bp, Artificial Sequence
  Description of Artificial Sequence: Synthetic coding sequence
atggacgacgacgacttcggcggcttcgaggccgccgagaccttcgacggcggcagcggcgagacccagaccaccagccccgccatcccctgggccgccttccccgccgtgagcggcgtgcacctgagccccagcagccccgagatcgtgctggacagagaccacagcagcagcatcggctgcctgagcagcgacgccatcatcagcagccccgagaacacccacgccgccaacagcatcgtgagccagaccatccccaaggcccagatccagcagagcacccacacccacctggacatcagcctgttccccctgggcctgaccgacgagaagagcaacggcaccatcgccctggtggacgacagcgaggaccccggcgccaacgtgagcaacatccagctgcagcagaagatcagcagcctggagatcaagctgaaggtgagcgaggaggagaagcagagaatcaagcaggacgtggagagcctgatggagaagcacaacgtgctggagaagggcttcctgaaggagaaggagcaggaggccatcagcttccaggacagatacaaggagctgcaggagaagcacaagcaggagctggaggacatgagaaaggccggccacgaggccctgagcatcatcgtggacgagtacaagcaccagagactgctggagatgctggacaccgagaaggagctgctgaaggagaagatcaaggaggccctgatccagcagagccaggagcagaaggagatcctggagaagtgcctggaggaggagagacagagaaacaaggaggccctggtgagcgccgccaagctggagaaggaggccgtgaaggacgccgtgctgaaggtggtggaggaggagagaaagaacctggagaaggcccacgccgaggagagagagctgtggaagaccgagcacgccaaggaccaggagaaggtgagccaggagatccagaaggccatccaggagcagagaaagatcagccaggagaccgtgaaggccgccatcatcgaggagcagaagagaagcgagaaggccgtggaggaggccgtgaagagaaccagagacgagctgatcgagtacatcaaggagcagaagagactggaccaggtgatcagacagagaagcctgagcagcctggagctgttcctgagctgcgcccagaagcagctgagcgccctgatcgccaccgagcccgtggacatcgagtag

SEQ ID NO: 17623 - DNA, 1326 bp, Artificial Sequence
  Description of Artificial Sequence: Synthetic coding sequence
atggacgacgacgacttcggcggcttcgaggccgccgagaccttcgacggcggcagcggcgagacccagaccaccagccccgccatcccctgggccgccttccccgccgtgagcggcgtgcacctgagccccagcagccccgagatcgtgctggacagagaccacagcagcagcatcggctgcctgagcagcgacgccatcatcagcagccccgagaacacccacgccgccaacagcatcgtgagccagaccatccccaaggcccagatccagcagagcacccacacccacctggacatcagcctgttccccctgggcctgaccgacgagaagagcaacggcaccatcgccctggtggacgacagcgaggaccccggcgccaacgtgagcaacatccagctgcagcagaagatcagcagcctggagatcaagctgaaggtgagcgaggaggagaagcagagaatcaagcaggacgtggagagcctgatggagaagcacaacgtgctggagaagggcttcctgaaggagaaggagcaggaggccatcagcttccaggacagatacaaggagctgcaggagaagcacaagcaggagctggaggacatgagaaaggccggccacgaggccctgagcatcatcgtggacgagtacaaggccctgctgcagagcagcgtgaagcagcaggtggaggccatcgagaagcagtacatcagcgccatcgagaagcaggcccacaagtgcgaggagctgctgaacgcccagcaccagagactgctggagatgctggacaccgagaaggagctgctgaaggagaagatcaaggaggccctgatccagcagagccaggagcagaaggagatcctggagaagtgcctggaggaggagagacagagaaacaaggaggccctggtgagcgccgccaagctggagaaggaggccgtgaaggacgccgtgctgaaggtggtggaggaggagagaaagaacctggagaaggcccacgccgaggagagagagctgtggaagaccgagcacgccaaggaccaggagaaggtgagccaggagatccagaaggccatccaggagcagagaaagatcagccaggagaccgtgaaggccgccatcatcgaggagcagaagagaagcgagaaggccgtggaggaggccgtgaagagaaccagagacgagctgatcgagtacatcaaggagcagaagagactggaccaggtgatcagacagagaagcctgagcagcctggagctgttcctgagctgcgcccagaagcagctgagcgccctgatcgccaccgagcccgtggacatcgagtag

SEQ ID NO: 17624 - DNA, 1086 bp, Artificial Sequence
  Description of Artificial Sequence: Synthetic coding sequence
atggacgacgacgacttcggcggcttcgaggccgccgagaccttcgacggcggcagcggcgagacccagaccaccagccccgccatcccctgggccgccttccccgccgtgagcggcgtgcacctgagccccagcagccccgagatcgtgctggacagagaccacagcagcagcatcggctgcctgagcagcgacgccatcatcagcagccccgagaacacccacgccgccaacagcatcgtgagccagaccatccccaaggcccagatccagcagagcacccacacccacctggacatcagcctgttccccctgggcctgaccgacgagaagagcaacggcaccatcgccctggtggacgacagcgaggaccccggcgccaacgtgagcaacatccagctgcagcagaagatcagcagcctggagatcaagctgaaggtgagcgaggaggagaagcagagaatcaagcaggacgtggagagcctgatggagaagcacaacgtgctggagaagggcttcctgaaggagaaggagcaggaggccatcagcttccaggacagatacaaggagctgcaggagaagcacaagcaggagctggaggacatgagaaaggccggccacgaggccctgagcatcatcgtggacgagtacaaggccctgctgcagagcagcgtgaagcagcaggtggaggccatcgagaagcagtacatcagcgccatcgagaagcaggcccacaagtgcgaggagctgctgaacgcccagcaccagagactgctggagatgctggacaccgagaaggagctgctgaaggagaagatcaaggaggccctgatccagcagagccaggagcagaaggagatcctggagaagtgcctggaggaggagagacagagaaacaaggaggccctggtgagcgccgccaagctggagaaggaggccgtgaaggacgccgtgctgaaggtggtggaggaggagagaaagaacctggagaaggcccacgccgaggagagagagctgtggaagaccgagcacgccaaggaccaggagaaggtgagccaggagatccagaaggccatccaggagtag

SEQ ID NO: 17625 - DNA, 258 bp, Artificial Sequence
  Description of Artificial Sequence: Synthetic coding sequence
atggacgacgacgacttcggcggcttcgaggccgccgagaccttcgacggcggcagcggcgagacccagaccaccagccccgccatcccctgggccgccttccccgccgtgagcggcgtgcacctgagccccagcagccccgagatcgtgctggacagagaccacagcagcagcatcggctgcctgagcagcgacgccatcatcagcagccccgagaacacccacgccgccaacagcatcgtgagccagaccatctag

SEQ ID NO: 17626 - DNA, 1218 bp, Artificial Sequence; identical to SEQ ID NO: 17622
  Description of Artificial Sequence: Synthetic coding sequence

SEQ ID NO: 17627 - DNA, 276 bp, Artificial Sequence
  Description of Artificial Sequence: Synthetic coding sequence
atggacgacgacgacttcggcggcttcgaggccgccgagaccttcgacggcggcagcggcgagacccagaccaccagccccgccatcccctgggccgccttccccgccgtgagcggcgtgcacctgagccccagcagccccgagatcgtgctggacagagaccacagcagcagcatcggctgcctgagcagcgacgccatcatcagcagccccgagaacacccacgccgccaacagcatcgtgagccagaccatccccaaggcccagatccagtag

SEQ ID NO: 17628 - DNA, 1326 bp, Artificial Sequence; identical to SEQ ID NO: 17623
  Description of Artificial Sequence: Synthetic coding sequence

SEQ ID NO: 17629 - DNA, 357 bp, Artificial Sequence
  Description of Artificial Sequence: Synthetic coding sequence
atggccacccccagcctgagaggcagactggccagattcggcaaccccagaaagcccgtgctgaagcccaacaagcccctgatcctggccaacagagtgggcgagagaagaagagagaagggcgaggccacctgcatcaccgagatgagcgtgatgatggcctgctggaagcagaacgagttcagagacgacgcctgcagaaaggagatccagggcttcctggactgcgccgccagagcccaggaggccagaaagatgagaagcatccaggagaccctgggcgagagcggcagcctgctgcccaacaagctgaacaagctgctgcagagattccccaacaagccctacctgagctag

SEQ ID NO: 17630 - DNA, 294 bp, Artificial Sequence
  Description of Artificial Sequence: Synthetic coding sequence
atggccacccccagcctgagaggcagactggccagattcggcaaccccagaaagcccgtgctgaagcccaacaagcccctgatcctggccaacagagtgggcgagagaagaagagagaagggcgaggccacctgcatcaccgagatgagcgtgatgatggcctgctggaagcagaacgagttcagagacgacgcctgcagaaaggagatccagggcttcctggactgcgccgccagagcccaggtgaccgacggcagctggggcgccttcagcggcaaggagtggggcagatag

SEQ ID NO: 17631 - DNA, 429 bp, Artificial Sequence
  Description of Artificial Sequence: Synthetic coding sequence
atgcccagaggcagcagaagcgccgccagcagacccgccagcagacccgccgcccccagcgcccacccccccgcccaccccccccccagcgccgccgcccccgcccccgcccccagcggccagcccggcctgatggcccagatggccaccaccgccgccggcgtggccgtgggcagcgccgtgggccacgtgatgggcagcgccctgaccggcgccttcagcggcggcagcagcgagcccagccagcccgccgtgcagcaggcccccacccccgccgccccccagcccctgcagatgggcccctgcgcctacgagatcagacagttcctggactgcagcaccacccagagcgacctgagcctgtgcgagggcttcagcgaggccctgaagcagtgcaagtactaccacggcctgagcagcctgccctag

SEQ ID NO: 17632 - DNA, 456 bp, Artificial Sequence
  Description of Artificial Sequence: Synthetic coding sequence
atgcccagaggcagcagaagcagaaccagcagaatggccccccccgccagcagagccccccagatgagagccgcccccagacccgcccccgtggcccagccccccgccgccgccccccccagcgccgtgggcagcagcgccgccgcccccagacagcccggcctgatggcccagatggccaccaccgccgccggcgtggccgtgggcagcgccgtgggccacaccctgggccacgccatcaccggcggcttcagcggcggcagcaacgccgagcccgccagacccgacatcacctaccaggagccccagggcacccagcccgcccagcagcagcagccctgcctgtacgagatcaagcagttcctggagtgcgcccagaaccagggcgacatcaagctgtgcgagggcttcaacgaggtgctgaagcagtgcagactggccaacggcctggcctag

SEQ ID NO: 17633 - DNA, 468 bp, Artificial Sequence
  Description of Artificial Sequence: Synthetic coding sequence
atgcccgtgagctacagcagcgtgaccaccagatactaccacagagccggcgccgaggagggcaaggacagaatcatcttcgtgaccaaggaggaccacgagacccccagcagcgccgagctggtggccgacgaccccaacgacccctacgaggagcacggcctgatcctgcccaacggcaacatcaactggaactgcccctgcctgggcggcatggccagcggcccctgcggcgagcagttcaagagcgccttcagctgcttccactacagcaccgaggagatcaagggcagcgactgcgtggaccagttcagagccatgcaggagtgcatgcagaagtaccccgacctgtacccccaggaggacgaggacgaggaggaggagagagagaagaagcccgccgagcaggccgaggagaccgcccccatcgaggccaccgccaccaaggaggaggagggcagcagctag

SEQ ID NO: 17634 - DNA, 429 bp, Artificial Sequence
  Description of Artificial Sequence: Synthetic coding sequence
atgagctactgcagacaggagggcaaggacagaatcatcttcgtgaccaaggaggaccacgagacccccagcagcgccgagctggtggccgacgaccccaacgacccctacgaggagcacggcctgatcctgcccaacggcaacatcaactggaactgcccctgcctgggcggcatggccagcggcccctgcggcgagcagttcaagagcgccttcagctgcttccactacagcaccgaggagatcaagggcagcgactgcgtggaccagttcagagccatgcaggagtgcatgcagaagtaccccgacctgtacccccaggaggacgaggacgaggaggaggagagagagaagaagcccgccgagcaggccgaggagaccgcccccatcgaggccaccgccaccaaggaggaggagggcagcagctag

SEQ ID NO: 17635 - DNA, 1449 bp, Artificial Sequence
  Description of Artificial Sequence: Synthetic coding sequence
atggccagcttcagcgccgagaccaacagcaccgacctgctgagccagccctggaacgagccccccgtgatcctgagcatggtgatcctgagcctgaccttcctgctgggcctgcccggcaacggcctggtgctgtgggtggccggcctgaagatgcagagaaccgtgaacaccatctggttcctgcacctgaccctggccgacctgctgtgctgcctgagcctgcccttcagcctggcccacctggccctgcagggccagtggccctacggcagattcctgtgcaagctgatccccagcatcatcgtgctgaacatgttcgccagcgtgttcctgctgaccgccatcagcctggacagatgcctggtggtgttcaagcccatctggtgccagaaccacagaaacgtgggcatggcctgcagcatctgcggctgcatctgggtggtggccttcgtgatgtgcatccccgtgttcgtgtacagagagatcttcaccaccgacaaccacaacagatgcggctacaagttcggcctgagcagcagcctggactaccccgacttctacggcgaccccctggagaacagaagcctggagaacatcgtgcagccccccggcgagatgaacgacagactggaccccagcagcttccagaccaacgaccacccctggaccgtgcccaccgtgttccagccccagaccttccagagacccagcgccgacagcctgcccagaggcagcgccagactgaccagccagaacctgtacagcaacgtgttcaagcccgccgacgtggtgagccccaagatccccagcggcttccccatcgaggaccacgagaccagccccctggacaacagcgacgccttcctgagcacccacctgaagctgttccccagcgccagcagcaacagcttctacgagagcgagctgccccagggcttccaggactactacaacctgggccagttcaccgacgacgaccaggtgcccacccccctggtggccatcaccatcaccagactggtggtgggcttcctgctgcccagcgtgatcatgatcgcctgctacagcttcatcgtgttcagaatgcagagaggcagattcgccaagagccagagcaagaccttcagagtggccgtggtggtggtggccgtgttcctggtgtgctggaccccctaccacatcttcggcgtgctgagcctgctgaccgaccccgagacccccctgggcaagaccctgatgagctgggaccacgtgtgcatcgccctggccagcgccaacagctgcttcaaccccttcctgtacgccctgctgggcaaggacttcagaaagaaggccagacagagcatccagggcatcctggaggccgccttcagcgaggagctgaccagaagcacccactgccccagcaacaacgtgatcagcgagagaaacagcaccaccgtgtag

SEQ ID NO: 17636 - DNA, 441 bp, Artificial Sequence
  Description of Artificial Sequence: Synthetic coding sequence
atggccagcttcagcgccgagaccaacagcaccgacctgctgagccagccctggaacgagccccccgtgatcctgagcatggtgatcctgagcctgaccttcctgctgggcctgcccggcaacggcctggtgctgtgggtggccggcctgaagatgcagagaaccgtgaacaccatctggttcctgcacctgaccctggccgacctgctgtgctgcctgagcctgcccttcagcctggcccacctggccctgcagggccagtggccctacggcagattcctgtgcaagctgatccccagcatcatcgtgctgaacatgttcgccagcgtgttcctgctgaccgccatcagcctggacagatgcctggtggtgttcaagcccatctggtgccagaaccacagaaacgtgggcatggcctgcagcatctgcggctgcatctag

SEQ ID NO: 17637 - DNA, 1053 bp, Artificial Sequence
  Description of Artificial Sequence: Synthetic coding sequence
atggacagcttcaactacaccacccccgactacggccactacgacgacaaggacaccctggacctgaacacccccgtggacaagaccagcaacaccctgagagtgcccgacatcctggccctggtgatcttcgccgtggtgttcctggtgggcgtgctgggcaacgccctggtggtgtgggtgaccgccttcgaggccaagagaaccatcaacgccatctggttcctgaacctggccgtggccgacttcctgagctgcctggccctgcccatcctgttcaccagcatcgtgcagcaccaccactggcccttcggcggcgccgcctgcagcatcctgcccagcctgatcctgctgaacatgtacgccagcatcctgctgctggccaccatcagcgccgacagattcctgctggtgttcaagcccatctggtgccagaacttcagaggcgccggcctggcctggatcgcctgcgccgtggcctggggcctggccctgctgctgaccatccccagcttcctgtacagagtggtgagagaggagtacttcccccccaaggtgctgtgcggcgtggactacagccacgacaagagaagagagagagccgtggccatcgtgagactggtgctgggcttcctgtggcccctgctgaccctgaccatctgctacaccttcatcctgctgagaacctggagcagaagagccaccagaagcaccaagaccctgaaggtggtggtggccgtggtggccagcttcttcatcttctggctgccctaccaggtgaccggcatcatgatgagcttcctggagcccagcagccccaccttcctgctgctgaagaagctggacagcctgtgcgtgagcttcgcctacatcaactgctgcatcaaccccatcatctacgtggtggccggccagggcttccagggcagactgagaaagagcctgcccagcctgctgagaaacgtgctgaccgaggagagcgtggtgagagagagcaagagcttcaccagaagcaccgtggacaccatggcccagaagacccaggccgtgtag

SEQ ID NO: 17638 - DNA, 477 bp, Artificial Sequence
  Description of Artificial Sequence: Synthetic coding sequence
atggccttcatggtgaagaccatggtgggcggccagctgaagaacctgaccggcagcctgggcggcggcgaggacaagggcgacggcgacaagagcgccgccgaggcccagggcatgagcagagaggagtacgaggagtaccagaagcagctggtggaggagaagatggagagagacgcccagttcacccagagaaaggccgagagagccaccctgagaagccacttcagagacaagtacagactgcccaagaacgagaccgacgagagccagatccagatggccggcggcgacgtggagctgcccagagagctggccaagatgatcgaggaggacaccgaggaggaggaggagaaggccagcgtgctgggccagctggccagcctgcccggcctgaacctgggcagcctgaaggacaaggcccaggccaccctgggcgacctgaagcagagcgccgagaagtgccacgtgatgtag

SEQ ID NO: 17639 - DNA, 2142 bp, Artificial Sequence
  Description of Artificial Sequence: Synthetic coding sequence
atggagcccgtggagacctggacccccggcaaggtggccacctggctgagaggcctggacgacagcctgcaggactaccccttcgaggactggcagctgcccggcaagaacctgctgcagctgtgcccccagagcctggaggccctggccgtgagaagcctgggccaccaggagctgatcctgggcggcgtggagcagctgcaggccctgagcagcagactgcagaccgagaacctgcagagcctgaccgagggcctgctgggcgccacccacgacttccagagcatcgtgcagggctgcctgggcgactgcgccaagacccccatcgacgtgctgtgcgccgccgtggagctgctgcacgaggccgacgccctgctgttctggctgagcagatacctgttcagccacctgaacgacttcagcgcctgccaggagatcagagacctgctggaggagctgagccaggtgctgcacgaggacggccccgccgccgagaaggagggcaccgtgctgagaatctgcagccacgtggccggcatctgccacaacatcctggtgtgctgccccaaggagctgctggagcagaaggccgtgctggagcaggtgcagctggacagccccctgggcctggagatccacaccaccagcaactgccagcacttcgtgagccaggtggacacccaggtgcccaccgacagcagactgcagatccagcccggcgacgaggtggtgcagatcaacgagcaggtggtggtgggctggcccagaaagaacatggtgagagagctgctgagagagcccgccggcctgagcctggtgctgaagaagatccccatccccgagacccccccccagacccccccccaggtgctggacagcccccaccagagaagccccagcctgagcctggcccccctgagccccagagcccccagcgaggacgtgttcgccttcgacctgagcagcaaccccagccccggccccagccccgcctggaccgacagcgccagcctgggccccgagcccctgcccatcccccccgagccccccgccatcctgcccgccggcgtggccggcacccccggcctgcccgagagccccgacaagagccccgtgggcagaaagaagagcaagggcctggccaccagactgagcagaagaagagtgagctgcagagagctgggcagacccgactgcgacggctggctgctgctgagaaaggcccccggcggcttcatgggccccagatggagaagaagatggttcgtgctgaagggccacaccctgtactggtacagacagccccaggacgagaaggccgagggcctgatcaacgtgagcaactacagcctggagagcggccacgaccagaagaagaagtacgtgttccagctgacccacgacgtgtacaagcccttcatcttcgccgccgacaccctgaccgacctgagcatgtgggtgagacacctgatcacctgcatcagcaagtaccagagccccggcagagcccccccccccagagaggaggactgctacagcgagaccgaggccgaggaccccgacgacgaggccggcagccacagcgccagccccagccccgcccaggccggcagccccctgcacggcgacaccagccccgccgccacccccacccagagaagccccagaaccagcttcggcagcctgaccgacagcagcgaggaggccctggagggcatggtgagaggcctgagacagggcggcgtgagcctgctgggccagccccagcccctgacccaggagcagtggagaagcagcttcatgagaagaaacagagacccccagctgaacgagagagtgcacagagtgagagccctgcagagcaccctgaaggccaagctgcaggagctgcaggtgctggaggaggtgctgggcgaccccgagctgaccggcgagaagttcagacagtggaaggagcagaacagagagctgtacagcgagggcctgggcgcctggggcgtggcccaggccgagggcagcagccacatcctgaccagcgacagcaccgagcagagcccccacagcctgcccagcgaccccgaggagcacagccacctgtgccccctgaccagcgagagcagcctgagaccccccgacctgtag

SEQ ID NO: 17640 - DNA, 2163 bp, Artificial Sequence
  Description of Artificial Sequence: Synthetic coding sequence
atggagcccgtggagacctggacccccggcaaggtggccacctggctgagaggcctggacgacagcctgcaggactaccccttcgaggactggcagctgcccggcaagaacctgctgcagctgtgcccccagagcctggaggccctggccgtgagaagcctgggccaccaggagctgatcctgggcggcgtggagcagctgcaggccctgagcagcagactgcagaccgagaacctgcagagcctgaccgagggcctgctgggcgccacccacgacttccagagcatcgtgcagggctgcctgggcgactgcgccaagacccccatcgacgtgctgtgcgccgccgtggagctgctgcacgaggccgacgccctgctgttctggctgagcagatacctgttcagccacctgaacgacttcagcgcctgccaggagatcagagacctgctggaggagctgagccaggtgctgcacgaggacggccccgccgccgagaaggagggcaccgtgctgagaatctgcagccacgtggccggcatctgccacaacatcctggtgtgctgccccaaggagctgctggagcagaaggccgtgctggagcaggtgcagctggacagccccctgggcctggagatccacaccaccagcaactgccagcacttcgtgagccaggtggacacccaggtgcccaccgacagcagactgcagatccagcccggcgacgaggtggtgcagatcaacgagcaggtggtggtgagagaggagagagacatggtgggctggcccagaaagaacatggtgagagagctgctgagagagcccgccggcctgagcctggtgctgaagaagatccccatccccgagacccccccccagacccccccccaggtgctggacagcccccaccagagaagccccagcctgagcctggcccccctgagccccagagcccccagcgaggacgtgttcgccttcgacctgagcagcaaccccagccccggccccagccccgcctggaccgacagcgccagcctgggccccgagcccctgcccatcccccccgagccccccgccatcctgcccgccggcgtggccggcacccccggcctgcccgagagccccgacaagagccccgtgggcagaaagaagagcaagggcctggccaccagactgagcagaagaagagtgagctgcagagagctgggcagacccgactgcgacggctggctgctgctgagaaaggcccccggcggcttcatgggccccagatggagaagaagatggttcgtgctgaagggccacaccctgtactggtacagacagccccaggacgagaaggccgagggcctgatcaacgtgagcaactacagcctggagagcggccacgaccagaagaagaagtacgtgttccagctgacccacgacgtgtacaagcccttcatcttcgccgccgacaccctgaccgacctgagcatgtgggtgagacacctgatcacctgcatcagcaagtaccagagccccggcagagcccccccccccagagaggaggactgctacagcgagaccgaggccgaggaccccgacgacgaggccggcagccacagcgccagccccagccccgcccaggccggcagccccctgcacggcgacaccagccccgccgccacccccacccagagaagccccagaaccagcttcggcagcctgaccgacagcagcgaggaggccctggagggcatggtgagaggcctgagacagggcggcgtgagcctgctgggccagccccagcccctgacccaggagcagtggagaagcagcttcatgagaagaaacagagacccccagctgaacgagagagtgcacagagtgagagccctgcagagcaccctgaaggccaagctgcaggagctgcaggtgctggaggaggtgctgggcgaccccgagctgaccggcgagaagttcagacagtggaaggagcagaacagagagctgtacagcgagggcctgggcgcctggggcgtggcccaggccgagggcagcagccacatcctgaccagcgacagcaccgagcagagcccccacagcctgcccagcgaccccgaggagcacagccacctgtgccccctgaccagcgagagcagcctgagaccccccgacctgtag

SEQ ID NO: 17641 - DNA, 936 bp, Artificial Sequence
  Description of Artificial Sequence: Synthetic coding sequence
atggagcccgtggagacctggacccccggcaaggtggccacctggctgagaggcctggacgacagcctgcaggactaccccttcgaggactggcagctgcccggcaagaacctgctgcagctgtgcccccagagcctggaggccctggccgtgagaagcctgggccaccaggagctgatcctgggcggcgtggagcagctgcaggccctgagcagcagactgcagaccgagaacctgcagagcctgaccgagggcctgctgggcgccacccacgacttccagagcatcgtgcagggctgcctgggcgactgcgccaagacccccatcgacgtgctgtgcgccgccgtggagctgctgcacgaggccgacgccctgctgttctggctgagcagatacctgttcagccacctgaacgacttcagcgcctgccaggagatcagagacctgctggaggagctgagccaggtgctgcacgaggacctgcagcccagaggctgggacctgccccagcaccccggcctgctgccccagggcgccgccggcaccgagggcagagccagagccggcgccgccggccagagcatcggccccagaaacagccaccaccacccccacacctgcctgcagaccccccccaacagacacctgcccctgctgagaccccccagcagcctgcagacccccccccaggtgcccgcccccgccgcccccctgcccctgctgccccccaacctgctgagcgacccctgcctgcactgcttcgtgcccggctgcagccccgacgcccccagcggccccggcctgcccgcccccgaggagcccatcaccgtgagcggccccaccgtgagccaggtgaccggcagcgtgcaggtgtgcctgggcggcgagaccgtgggcagcagccaccccccctgccccccccagggccccatctag

SEQ ID NO: 17642 - DNA, 4155 bp, Artificial Sequence
  Description of Artificial Sequence: Synthetic coding sequence
atgatgcacctgagactgttctgcatcctgctggccgccgtgagcggcgccgagggctggggctactacggctgcgacgaggagctggtgggccccctgtacgccagaagcctgggcgccagcagctactacagcctgctgaccgcccccagattcgccagactgcacggcatcagcggctggagccccagaatcggcgaccccaacccctggctgcagatcgacctgatgaagaagcacagaatcagagccgtggccacccagggcagcttcaacagctgggactgggtgaccagatacatgctgctgtacggcgacagagtggacagctggacccccttctaccagagaggccacaacagcaccttcttcggcaacgtgaacgagagcgccgtggtgagacacgacctgcacttccacttcaccgccagatacatcagaatcgtgcccctggcctggaaccccagaggcaagatcggcctgagactgggcctgtacggctgcccctacaaggccgacatcctgtacttcgacggcgacgacgccatcagctacagattccccagaggcgtgagcagaagcctgtgggacgtgttcgccttcagcttcaagaccgaggagaaggacggcctgctgctgcacgccgagggcgcccagggcgactacgtgaccctggagctggagggcgcccacctgctgctgcacatgagcctgggcagcagccccatccagcccagacccggccacaccaccgtgagcgccggcggcgtgctgaacgaccagcactggcactacgtgagagtggacagattcggcagagacgtgaacttcaccctggacggctacgtgcagagattcatcctgaacggcgacttcgagagactgaacctggacaccgagatgttcatcggcggcctggtgggcgccgccagaaagaacctggcctacagacacaacttcagaggctgcatcgagaacgtgatcttcaacagagtgaacatcgccgacctggccgtgagaagacacagcagaatcaccttcgagggcaaggtggccttcagatgcctggaccccgtgccccaccccatcaacttcggcggcccccacaacttcgtgcaggtgcccggcttccccagaagaggcagactggccgtgagcttcagattcagaacctgggacctgaccggcctgctgctgttcagcagactgggcgacggcctgggccacgtggagctgaccctgagcgagggccaggtgaacgtgagcatcgcccagagcggcagaaagaagctgcagttcgccgccggctacagactgaacgacggcttctggcacgaggtgaacttcgtggcccaggagaaccacgccgtgatcagcatcgacgacgtggagggcgccgaggtgagagtgagctaccccctgctgatcagaaccggcaccagctacttcttcggcggctgccccaagcccgccagcagatgggactgccacagcaaccagaccgccttccacggctgcatggagctgctgaaggtggacggccagctggtgaacctgaccctggtggagggcagaagactgggcttctacgccgaggtgctgttcgacacctgcggcatcaccgacagatgcagccccaacatgtgcgagcacgacggcagatgctaccagagctgggacgacttcatctgctactgcgagctgaccggctacaagggcgagacctgccacacccccctgtacaaggagagctgcgaggcctacagactgagcggcaagaccagcggcaacttcaccatcgaccccgacggcagcggccccctgaagcccttcgtggtgtactgcgacatcagagagaacagagcctggaccgtggtgagacacgacagactgtggaccaccagagtgaccggcagcagcatggagagacccttcctgggcgccatccagtactggaacgccagctgggaggaggtgagcgccctggccaacgccagccagcactgcgagcagtggatcgagttcagctgctacaacagcagactgctgaacaccgccggcggctacccctacagcttctggatcggcagaaacgaggagcagcacttctactggggcggcagccagcccggcatccagagatgcgcctgcggcctggacagaagctgcgtggaccccgccctgtactgcaactgcgacgccgaccagccccagtggagaaccgacaagggcctgctgaccttcgtggaccacctgcccgtgacccaggtggtgatcggcgacaccaacagaagcaccagcgaggcccagttcttcctgagacccctgagatgctacggcgacagaaacagctggaacaccatcagcttccacaccggcgccgccctgagattcccccccatcagagccaaccacagcctggacgtgagcttctacttcagaaccagcgcccccagcggcgtgttcctggagaacatgggcggcccctactgccagtggagaagaccctacgtgagagtggagctgaacaccagcagagacgtggtgttcgccttcgacgtgggcaacggcgacgagaacctgaccgtgcacagcgacgacttcgagttcaacgacgacgagtggcacctggtgagagccgagatcaacgtgaagcaggccagactgagagtggaccacagaccctgggtgctgagacccatgcccctgcagacctacatctggatggagtacgaccagcccctgtacgtgggcagcgccgagctgaagagaagacccttcgtgggctgcctgagagccatgagactgaacggcgtgaccctgaacctggagggcagagccaacgccagcgagggcaccagccccaactgcaccggccactgcgcccaccccagactgccctgcttccacggcggcagatgcgtggagagatacagctactacacctgcgactgcgacctgaccgccttcgacggcccctactgcaaccacgacatcggcggcttcttcgagcccggcacctggatgagatacaacctgcagagcgccctgagaagcgccgccagagagttcagccacatgctgagcagacccgtgcccggctacgagcccggctacatccccggctacgacacccccggctacgtgcccggctaccacggccccggctacagactgcccgactaccccagacccggcagacccgtgcccggctacagaggccccgtgtacaacgtgaccggcgaggaggtgagcttcagcttcagcaccagcagcgcccccgccgtgctgctgtacgtgagcagcttcgtgagagactacatggccgtgctgatcaaggacgacggcaccctgcagctgagataccagctgggcaccagcccctacgtgtaccagctgaccaccagacccgtgaccgacggccagccccacagcatcaacatcaccagagtgtacagaaacctgttcatccaggtggactacttccccctgaccgagcagaagttcagcctgctggtggacagccagctggacagccccaaggccctgtacctgggcagagtgatggagaccggcgtgatcgaccccgagatccagagatacaacacccccggcttcagcggctgcctgagcggcgtgagattcaacaacgtggcccccctgaagacccacttcagaacccccagacccatgaccgccgagctggccgaggccctgagagtgcagggcgagctgagcgagagcaactgcggcgccatgcccagactggtgagcgaggtgccccccgagctggacccctggtacctgccccccgacttcccctactaccacgacgagggctgggtggccatcctgctgggcttcctggtggccttcctgctgctgggcctggtgggcatgctggtgctgttctacctgcagaaccacagatacaagggcagctaccacaccaacgagcccaaggccgcccacgagtaccaccccggcagcaagccccccctgcccaccagcggccccgcccaggtgcccacccccaccgccgcccccaaccaggcccccgccagcgcccccgcccccgcccccacccccgcccccgcccccggccccagagaccagaacctgccccagatcctggaggagagcagaagcgagtag

SEQ ID NO: 17643 - DNA, 1143 bp, Artificial Sequence
  Description of Artificial Sequence: Synthetic coding sequence
atggccagcgtggcctgggccgtgctgaaggtgctgctgctgctgcccacccagacctggagccccgtgggcgccggcaacccccccgactgcgacagccccctggccagcgccctgcccagaagcagcttcagcagcagcagcgagctgagcagcagccacggccccggcttcagcagactgaacagaagagacggcgccggcggctggacccccctggtgagcaacaagtaccagtggctgcagatcgacctgggcgagagaatggaggtgaccgccgtggccacccagggcggctacggcagcagcgactgggtgaccagctacctgctgatgttcagcgacggcggcagaaactggaagcagtacagaagagaggagagcatctggggcttccccggcaacaccaacgccgacagcgtggtgcactacagactgcagccccccttcgaggccagattcctgagattcctgcccctggcctggaaccccagaggcagaatcggcatgagaatcgaggtgtacggctgcgcctacaagagcgaggtggtgtacttcgacggccagagcgccctgctgtacaccctggacaagaagcccctgaagcccatcagagacgtgatcagcctgaagttcaaggccatgcagagcaacggcatcctgctgcacagagagggccagcacggcaaccacatcaccctggagctgatcaagggcaagctggtgttcttcctgaacagcggcaacgccaagctgcccagcaccatcgcccccgtgaccctgaccctgggcagcctgctggacgaccagcactggcacagcgtgctgatcgagctgctggacacccaggtgaacttcaccgtggacaagcacacccaccacttccaggccaagggcgacagcagcaacctggacctgaacttcgagatcagcttcggcggcatcctgagccccggcagaagcagagccttcaccagaaagagcttccacggctgcctggagaacctgtactacaacggcgtggacgtgaccgagctggccaagaagcacaagccccagatcctgatgatggagctggcccacggcctgcaggaccagaacctgaagatcagcctgaccgtgtgccaccagaccacccagtag

SEQ ID NO: 17644 - DNA, 2241 bp, Artificial Sequence
  Description of Artificial Sequence: Synthetic coding sequence
atggccagcgtggcctgggccgtgctgaaggtgctgctgctgctgcccacccagacctggagccccgtgggcgccggcaacccccccgactgcgacagccccctggccagcgccctgcccagaagcagcttcagcagcagcagcgagctgagcagcagccacggccccggcttcagcagactgaacagaagagacggcgccggcggctggacccccctggtgagcaacaagtaccagtggctgcagatcgacctgggcgagagaatggaggtgaccgccgtggccacccagggcggctacggcagcagcgactgggtgaccagctacctgctgatgttcagcgacggcggcagaaactggaagcagtacagaagagaggagagcatctggggcttccccggcaacaccaacgccgacagcgtggtgcactacagactgcagccccccttcgaggccagattcctgagattcctgcccctggcctggaaccccagaggcagaatcggcatgagaatcgaggtgtacggctgcgcctacaagagcgaggtggtgtacttcgacggccagagcgccctgctgtacaccctggacaagaagcccctgaagcccatcagagacgtgatcagcctgaagttcaaggccatgcagagcaacggcatcctgctgcacagagagggccagcacggcaaccacatcaccctggagctgatcaagggcaagctggtgttcttcctgaacagcggcaacgccaagctgcccagcaccatcgcccccgtgaccctgaccctgggcagcctgctggacgaccagcactggcacagcgtgctgatcgagctgctggacacccaggtgaacttcaccgtggacaagcacacccaccacttccaggccaagggcgacagcagcaacctggacctgaacttcgagatcagcttcggcggcatcctgagccccggcagaagcagagccttcaccagaaagagcttccacggctgcctggagaacctgtactacaacggcgtggacgtgaccgagctggccaagaagcacaagccccagatcctgatgatgggcaacgtgagcttcagctgcccccagccccagaccgtgcccgtgaccttcctgagcagcagaagctacctggccctgcccggcaacagcggcgaggacaaggtgagcgtgaccttccagttcagaacctggaacagagccggccacctgctgttcggcgagctgcagagaggcagcggcagcttcgtgctgttcctgaaggacggcaagctgaagctgagcctgttccaggccggccagagccccagaaacgtgaccgccggcgccggcctgaacgacggccagtggcacagcgtgagcttcagcgccaagtggagccacatgaacgtggtggtggacgacgacaccgccgtgcagcccctggtggccgtgctgatcgacagcggcgacacctactacttcggcggctgcctgggcaacagcagcggcagcggctgcaagagccccctgggcggcttccagggctgcctgagactgatcaccatcggcgacaaggccgtggaccccatcctggtgcagcagggcgccctgggcagcttcagagacctgcagatcgacagctgcggcatcaccgacagatgcctgcccagctactgcgagcacggcggcgagtgcagccagagctgggacaccttcagctgcgactgcctgggcaccggctacaccggcgagacctgccacagcagcctgtacgagcagagctgcgaggcccacaagcacagaggcaaccccagcggcctgtactacatcgacgccgacggcagcggccccctgggccccttcctggtgtactgcaacatgaccgccgacagcgcctggaccgtggtgagacacggcggccccgacgccgtgaccctgagaggcgcccccagcggccaccccctgagcgccgtgagcttcgcctacgccgccggcgccggccagctgagagccgccgtgaacctggccgagagatgcgagcagagactggccctgagatgcggcaccgccagaagacccgacagcagagacggcacccccctgagctggtgggtgggcagaaccaacgagacccacaccagctggggcggcagcctgcccgacgcccagaagtgcacctgcggcctggagggcaactgcatcgacagccagtactactgcaactgcgacgccggccagaacgagtggtag

SEQ ID NO: 17645 - DNA, 609 bp, Artificial Sequence
  Description of Artificial Sequence: Synthetic coding sequence
atgacctaccacttccaggagcactacaccctgagcgagaacagcagcagcctggtgagcagcctgtacagagacgtgaccctgaccagagagatgatcaccctgagcttcagaaccaccagaagccccagcctgctgctgtacgtgagcagcttctacgaggagtacctgagcgtgatcctggccaacaacggcagcctgcagatcagatacaagctggacagacaccagaaccccgacgccttcaccttcgacttcaagaacatggccgacggccagctgcaccaggtgaagatcaacagagaggaggccgtggtgatggtggaggtgaaccagagcgccaagaagcaggtgatcctgagcagcggcaccgagttcaacgccgtgaagagcctgatcctgggcaaggtgctgggcagaagcggccccgtggacgagggcgagcccctggtgaacgccgacagaagagacagcgccgtgatgggcggcgtgatcgccgtggtgatcttcatcctgctgtgcatcaccgccatcgccatcagaatctaccagcagagaaagctgagaaaggagaacgagagcaaggtgagcaagaaggaggagtgctag

SEQ ID NO: 17646 - DNA, 3531 bp, Artificial Sequence
  Description of Artificial Sequence: Synthetic coding sequence
tgaggcagagagctggagaccggccagggcagacagagcagcgtgggcgccgcccagggcaccggcgtgagagccggcgtgagagccggcaccacccagagcggcagaagaagagccagagtgagcggcagactggccgaggtgagcatggccagcgtggcctgggccgtgctgaaggtgctgctgctgctgcccacccagacctggagccccgtgggcgccggcaacccccccgactgcgacagccccctggccagcgccctgcccagaagcagcttcagcagcagcagcgagctgagcagcagccacggccccggcttcagcagactgaacagaagagacggcgccggcggctggacccccctggtgagcaacaagtaccagtggctgcagatcgacctgggcgagagaatggaggtgaccgccgtggccacccagggcggctacggcagcagcgactgggtgaccagctacctgctgatgttcagcgacggcggcagaaactggaagcagtacagaagagaggagagcatctggggcttccccggcaacaccaacgccgacagcgtggtgcactacagactgcagccccccttcgaggccagattcctgagattcctgcccctggcctggaaccccagaggcagaatcggcatgagaatcgaggtgtacggctgcgcctacaagagcgaggtggtgtacttcgacggccagagcgccctgctgtacaccctggacaagaagcccctgaagcccatcagagacgtgatcagcctgaagttcaaggccatgcagagcaacggcatcctgctgcacagagagggccagcacggcaaccacatcaccctggagctgatcaagggcaagctggtgttcttcctgaacagcggcaacgccaagctgcccagcaccatcgcccccgtgaccctgaccctgggcagcctgctggacgaccagcactggcacagcgtgctgatcgagctgctggacacccaggtgaacttcaccgtggacaagcacacccaccacttccaggccaagggcgacagcagcaacctggacctgaacttcgagatcagcttcggcggcatcctgagccccggcagaagcagagccttcaccagaaagagcttccacggctgcctggagaacctgtactacaacggcgtggacgtgaccgagctggccaagaagcacaagccccagatcctgatgatgggcaacgtgagcttcagctgcccccagccccagaccgtgcccgtgaccttcctgagcagcagaagctacctggccctgcccggcaacagcggcgaggacaaggtgagcgtgaccttccagttcagaacctggaacagagccggccacctgctgttcggcgagctgcagagaggcagcggcagcttcgtgctgttcctgaaggacggcaagctgaagctgagcctgttccaggccggccagagccccagaaacgtgaccgccggcgccggcctgaacgacggccagtggcacagcgtgagcttcagcgccaagtggagccacatgaacgtggtggtggacgacgacaccgccgtgcagcccctggtggccgtgctgatcgacagcggcgacacctactacttcggcggctgcctgggcaacagcagcggcagcggctgcaagagccccctgggcggcttccagggctgcctgagactgatcaccatcggcgacaaggccgtggaccccatcctggtgcagcagggcgccctgggcagcttcagagacctgcagatcgacagctgcggcatcaccgacagatgcctgcccagctactgcgagcacggcggcgagtgcagccagagctgggacaccttcagctgcgactgcctgggcaccggctacaccggcgagacctgccacagcagcctgtacgagcagagctgcgaggcccacaagcacagaggcaaccccagcggcctgtactacatcgacgccgacggcagcggccccctgggccccttcctggtgtactgcaacatgaccgccgacagcgcctggaccgtggtgagacacggcggccccgacgccgtgaccctgagaggcgcccccagcggccaccccctgagcgccgtgagcttcgcctacgccgccggcgccggccagctgagagccgccgtgaacctggccgagagatgcgagcagagactggccctgagatgcggcaccgccagaagacccgacagcagagacggcacccccctgagctggtgggtgggcagaaccaacgagacccacaccagctggggcggcagcctgcccgacgcccagaagtgcacctgcggcctggagggcaactgcatcgacagccagtactactgcaactgcgacgccggccagaacgagtggaccagcgacaccatcgtgctgagccagaaggagcacctgcccgtgacccagatcgtgatgaccgacaccggccagccccacagcgaggccgactacaccctgggccccctgctgtgcagaggcgacaagagcttctggaacagcgccagcttcaacaccgagaccagctacctgcacttccccgccttccacggcgagctgaccgccgacgtgtgcttcttcttcaagaccaccgtgagcagcggcgtgttcatggagaacctgggcatcaccgacttcatcagaatcgagctgagagcccccaccgaggtgaccttcagcttcgacgtgggcaacggcccctgcgaggtgaccgtgcagagccccacccccttcaacgacaaccagtggcaccacgtgagagccgagagaaacgtgaagggcgccagcctgcaggtggaccagctgccccagaagatgcagcccgcccccgccgacggccacgtgagactgcagctgaacagccagctgttcatcggcggcaccgccaccagacagagaggcttcctgggctgcatcagaagcctgcagctgaacggcgtggccctggacctggaggagagagccaccgtgacccccggcgtggagcccggctgcgccggccactgcagcacctacggccacctgtgcagaaacggcggcagatgcagagagaagagaagaggcgtgacctgcgactgcgccttcagcgcctacgacggccccttctgcagcaacgagatcagcgcctacttcgccaccggcagcagcatgacctaccacttccaggagcactacaccctgagcgagaacagcagcagcctggtgagcagcctgtacagagacgtgaccctgaccagagagatgatcaccctgagcttcagaaccaccagaagccccagcctgctgctgtacgtgagcagcttctacgaggagtacctgagcgtgatcctggccaacaacggcagcctgcagatcagatacaagctggacagacaccagaaccccgacgccttcaccttcgacttcaagaacatggccgacggccagctgcaccaggtgaagatcaacagagaggaggccgtggtgatggtggaggtgatcccccagatgcagaagagcaactag

SEQ ID NO: 17647 - DNA, 3867 bp, Artificial Sequence
  Description of Artificial Sequence: Synthetic coding sequence
atggccagcgtggcctgggccgtgctgaaggtgctgctgctgctgcccacccagacctggagccccgtgggcgccggcaacccccccgactgcgacagccccctggccagcgccctgcccagaagcagcttcagcagcagcagcgagctgagcagcagccacggccccggcttcagcagactgaacagaagagacggcgccggcggctggacccccctggtgagcaacaagtaccagtggctgcagatcgacctgggcgagagaatggaggtgaccgccgtggccacccagggcggctacggcagcagcgactgggtgaccagctacctgctgatgttcagcgacggcggcagaaactggaagcagtacagaagagaggagagcatctggggcttccccggcaacaccaacgccgacagcgtggtgcactacagactgcagccccccttcgaggccagattcctgagattcctgcccctggcctggaaccccagaggcagaatcggcatgagaatcgaggtgtacggctgcgcctacaagagcgaggtggtgtacttcgacggccagagcgccctgctgtacaccctggacaagaagcccctgaagcccatcagagacgtgatcagcctgaagttcaaggccatgcagagcaacggcatcctgctgcacagagagggccagcacggcaaccacatcaccctggagctgatcaagggcaagctggtgttcttcctgaacagcggcaacgccaagctgcccagcaccatcgcccccgtgaccctgaccctgggcagcctgctggacgaccagcactggcacagcgtgctgatcgagctgctggacacccaggtgaacttcaccgtggacaagcacacccaccacttccaggccaagggcgacagcagcaacctggacctgaacttcgagatcagcttcggcggcatcctgagccccggcagaagcagagccttcaccagaaagagcttccacggctgcctggagaacctgtactacaacggcgtggacgtgaccgagctggccaagaagcacaagccccagatcctgatgatgggcaacgtgagcttcagctgcccccagccccagaccgtgcccgtgaccttcctgagcagcagaagctacctggccctgcccggcaacagcggcgaggacaaggtgagcgtgaccttccagttcagaacctggaacagagccggccacctgctgttcggcgagctgcagagaggcagcggcagcttcgtgctgttcctgaaggacggcaagctgaagctgagcctgttccaggccggccagagccccagaaacgtgaccgccggcgccggcctgaacgacggccagtggcacagcgtgagcttcagcgccaagtggagccacatgaacgtggtggtggacgacgacaccgccgtgcagcccctggtggccgtgctgatcgacagcggcgacacctactacttcggcggctgcctgggcaacagcagcggcagcggctgcaagagccccctgggcggcttccagggctgcctgagactgatcaccatcggcgacaaggccgtggaccccatcctggtgcagcagggcgccctgggcagcttcagagacctgcagatcgacagctgcggcatcaccgacagatgcctgcccagctactgcgagcacggcggcgagtgcagccagagctgggacaccttcagctgcgactgcctgggcaccggctacaccggcgagacctgccacagcagcctgtacgagcagagctgcgaggcccacaagcacagaggcaaccccagcggcctgtactacatcgacgccgacggcagcggccccctgggccccttcctggtgtactgcaacatgaccgccgacagcgcctggaccgtggtgagacacggcggccccgacgccgtgaccctgagaggcgcccccagcggccaccccctgagcgccgtgagcttcgcctacgccgccggcgccggccagctgagagccgccgtgaacctggccgagagatgcgagcagagactggccctgagatgcggcaccgccagaagacccgacagcagagacggcacccccctgagctggtgggtgggcagaaccaacgagacccacaccagctggggcggcagcctgcccgacgcccagaagtgcacctgcggcctggagggcaactgcatcgacagccagtactactgcaactgcgacgccggccagaacgagtggaccagcgacaccatcgtgctgagccagaaggagcacctgcccgtgacccagatcgtgatgaccgacaccggccagccccacagcgaggccgactacaccctgggccccctgctgtgcagaggcgacaagagcttctggaacagcgccagcttcaacaccgagaccagctacctgcacttccccgccttccacggcgagctgaccgccgacgtgtgcttcttcttcaagaccaccgtgagcagcggcgtgttcatggagaacctgggcatcaccgacttcatcagaatcgagctgagagcccccaccgaggtgaccttcagcttcgacgtgggcaacggcccctgcgaggtgaccgtgcagagccccacccccttcaacgacaaccagtggcaccacgtgagagccgagagaaacgtgaagggcgccagcctgcaggtggaccagctgccccagaagatgcagcccgcccccgccgacggccacgtgagactgcagctgaacagccagctgttcatcggcggcaccgccaccagacagagaggcttcctgggctgcatcagaagcctgcagctgaacggcgtggccctggacctggaggagagagccaccgtgacccccggcgtggagcccggctgcgccggccactgcagcacctacggccacctgtgcagaaacggcggcagatgcagagagaagagaagaggcgtgacctgcgactgcgccttcagcgcctacgacggccccttctgcagcaacgagatcagcgcctacttcgccaccggcagcagcatgacctaccacttccaggagcactacaccctgagcgagaacagcagcagcctggtgagcagcctgtacagagacgtgaccctgaccagagagatgatcaccctgagcttcagaaccaccagaagccccagcctgctgctgtacgtgagcagcttctacgaggagtacctgagcgtgatcctggccaacaacggcagcctgcagatcagatacaagctggacagacaccagaaccccgacgccttcaccttcgacttcaagaacatggccgacggccagctgcaccaggtgaagatcaacagagaggaggccgtggtgatggtggaggtgaaccagagcgccaagaagcaggtgatcctgagcagcggcaccgagttcaacgccgtgaagagcctgatcctgggcaaggtgctggaggccgccggcgccgaccccgacaccagaagagccgccaccagcggcttcaccggctgcctgagcgccgtgagattcggcagagccgcccccctgaaggccgccctgagacccagcggccccagcagagtgaccgtgagaggccacgtggcccccatggccagatgcgccgccggcgccgccagcggcagccccgccagagagctggcccccagactggccggcggcgccggcagaagcggccccgtggacgagggcgagcccctggtgaacgccgacagaagagacagcgccgtgatgggcggcgtgatcgccgtggtgatcttcatcctgctgtgcatcaccgccatcgccatcagaatctaccagcagagaaagctgagaaaggagaacgagagcaaggtgagcaagaaggaggagtgctag

SEQ ID NO: 17648 - DNA, 1803 bp, Artificial Sequence
  Description of Artificial Sequence: Synthetic coding sequence
atggccagcgtggcctgggccgtgctgaaggtgctgctgctgctgcccacccagacctggagccccgtgggcgccggcaacccccccgactgcgacagccccctggccagcgccctgcccagaagcagcttcagcagcagcagcgagctgagcagcagccacggccccggcttcagcagactgaacagaagagacggcgccggcggctggacccccctggtgagcaacaagtaccagtggctgcagatcgacctgggcgagagaatggaggtgaccgccgtggccacccagggcggctacggcagcagcgactgggtgaccagctacctgctgatgttcagcgacggcggcagaaactggaagcagtacagaagagaggagagcatctggggcttccccggcaacaccaacgccgacagcgtggtgcactacagactgcagccccccttcgaggccagattcctgagattcctgcccctggcctggaaccccagaggcagaatcggcatgagaatcgaggtgtacggctgcgcctacaagagcgaggtggtgtacttcgacggccagagcgccctgctgtacaccctggacaagaagcccctgaagcccatcagagacgtgatcagcctgaagttcaaggccatgcagagcaacggcatcctgctgcacagagagggccagcacggcaaccacatcaccctggagctgatcaagggcaagctggtgttcttcctgaacagcggcaacgccaagctgcccagcaccatcgcccccgtgaccctgaccctgggcagcctgctggacgaccagcactggcacagcgtgctgatcgagctgctggacacccaggtgaacttcaccgtggacaagcacacccaccacttccaggccaagggcgacagcagcaacctggacctgaacttcgagatcagcttcggcggcatcctgagccccggcagaagcagagccttcaccagaaagagcttccacggctgcctggagaacctgtactacaacggcgtggacgtgaccgagctggccaagaagcacaagccccagatcctgatgatgggcaacgtgagcttcagctgcccccagccccagaccgtgcccgtgaccttcctgagcagcagaagctacctggccctgcccggcaacagcggcgaggacaaggtgagcgtgaccttccagttcagaacctggaacagagccggccacctgctgttcggcgagctgcagagaggcagcggcagcttcgtgctgttcctgaaggacggcaagctgaagctgagcctgttccaggccggccagagccccagaaacgtgaccgccggcgccggcctgaacgacggccagtggcacagcgtgagcttcagcgccaagtggagccacatgaacgtggtggtggacgacgacaccgccgtgcagcccctggtggccgtgctgatcgacagcggcgacacctactacttcggcgccctgtacgagcagagctgcgaggcccacaagcacagaggcaaccccagcggcctgtactacatcgacgccgacggcagcggccccctgggccccttcctggtgtactgcaacatgaccgacagcgcctggaccgtggtgagacacggcggccccgacgccgtgaccctgagaggcgcccccagcggccaccccctgagcgccgtgagcttcgcctacgccgccggcgccggccagctgagagccgccgtgaacctggccgagagatgcgagcagagactggccctgagatgcggcaccgccagaagacccgacagcagaggctag

SEQ ID NO: 17649 - DNA, 3921 bp, Artificial Sequence
  Description of Artificial Sequence: Synthetic coding sequence
atggacagcctgcccagactgaccagcgtgctgaccctgctgttcagcggcctgtggcacctgggcctgaccgccaccaactacaactgcgacgaccccctggccagcctgctgagccccatggccttcagcagcagcagcgacctgaccggcacccacagccccgcccagctgaactggagagtgggcaccggcggctggagccccgccgacagcaacgcccagcagtggctgcagatggacctgggcaacagagtggagatcaccgccgtggccacccagggcagatacggcagcagcgactgggtgaccagctacagcctgatgttcagcgacaccggcagaaactggaagcagtacaagcaggaggacagcatctggaccttcgccggcaacatgaacgccgacagcgtggtgcaccacaagctgctgcacagcgtgagagccagattcgtgagattcgtgcccctggagtggaaccccagcggcaagatcggcatgagagtggaggtgtacggctgcagctacaagagcgacgtggccgacttcgacggcagaagcagcctgctgtacagattcaaccagaagctgatgagcaccctgaaggacgtgatcagcctgaagttcaagagcatgcagggcgacggcgtgctgttccacggcgagggccagagaggcgaccacatcaccctggagctgcagaagggcagactggccctgcacctgaacctgggcgacagcaaggccagactgagcagcagcctgcccagcgccaccctgggcagcctgctggacgaccagcactggcacagcgtgctgatcgagagagtgggcaagcaggtgaacttcaccgtggacaagcacacccagcacttcagaaccaagggcgagaccgacgccctggacatcgactacgagctgagcttcggcggcatccccgtgcccggcaagcccggcaccttcctgaagaagaacttccacggctgcatcgagaacctgtactacaacggcgtgaacatcatcgacctggccaagagaagaaagcaccagatctacaccggcaacgtgaccttcagctgcagcgagccccagatcgtgcccatcaccttcgtgaacagcagcggcagctacctgctgctgcccggcaccccccagatcgacggcctgagcgtgagcttccagttcagaacctggaacaaggacggcctgctgctgagcaccgagctgagcgagggcagcggcaccctgctgctgagcctggagggcggcatcctgagactggtgatccagaagatgaccgagagagtggccgagatcctgaccggcagcaacctgaacgacggcctgtggcacagcgtgagcatcaacgccagaagaaacagaatcaccctgaccctggacgacgaggccgccccccccgcccccgacagcacctgggtgcagatctacagcggcaacagctactacttcggcggctgccccgacaacctgaccgacagccagtgcctgaaccccatcaaggccttccagggctgcatgagactgatcttcatcgacaaccagcccaaggacctgatcagcgtgcagcagggcagcctgggcaacttcagcgacctgcacatcgacctgtgcagcatcaaggacagatgcctgcccaactactgcgagcacggcggcagctgcagccagagctggaccaccttctactgcaactgcagcgacaccagctacaccggcgccacctgccacaacagcatctacgagcagagctgcgaggtgtacagacaccagggcaacaccgccggcttcttctacatcgacagcgacggcagcggccccctgggccccctgcaggtgtactgcaacatcaccgaggacaagatctggaccagcgtgcagcacaacaacaccgagctgaccagagtgagaggcgccaaccccgagaagccctacgccatggccctggactacggcggcagcatggagcagctggaggccgtgatcgacggcagcgagcactgcgagcaggaggtggcctaccactgcagaagaagcagactgctgaacacccccgacggcacccccttcacctggtggatcggcagaagcaacgagagacacccctactggggcggcagcccccccggcgtgcagcagtgcgagtgcggcctggacgagagctgcctggacatccagcacttctgcaactgcgacgccgacaaggacgagtggaccaacgacaccggcttcctgagcttcaaggaccacctgcccgtgacccagatcgtgatcaccgacaccgacagaagcaacagcgaggccgcctggagaatcggccccctgagatgctacggcgacagaagattctggaacgccgtgagcttctacaccgaggccagctacctgcacttccccaccttccacgccgagttcagcgccgacatcagcttcttcttcaagaccaccgccctgagcggcgtgttcctggagaacctgggcatcaaggacttcatcagactggagatcagcagccccagcgagatcaccttcgccatcgacgtgggcaacggccccgtggagctggtggtgcagagccccagcctgctgaacgacaaccagtggcactacgtgagagccgagagaaacctgaaggagaccagcctgcaggtggacaacctgcccagaagcaccagagagaccagcgaggagggccacttcagactgcagctgaacagccagctgttcgtgggcggcaccagcagcagacagaagggcttcctgggctgcatcagaagcctgcacctgaacggccagaagatggacctggaggagagagccaaggtgaccagcggcgtgagacccggctgccccggccactgcagcagctacggcagcatctgccacaacggcggcaagtgcgtggagaagcacaacggctacctgtgcgactgcaccaacagcccctacgagggccccttctgcaagaaggaggtgagcgccgtgttcgaggccggcaccagcgtgacctacatgttccaggagccctaccccgtgaccaagaacatcagcctgagcagcagcgccatctacaccgacagcgcccccagcaaggagaacatcgccctgagcttcgtgaccacccaggcccccagcctgctgctgttcatcaacagcagcagccaggacttcgtggtggtgctgctgtgcaagaacggcagcctgcaggtgagataccacctgaacaaggaggagacccacgtgttcaccatcgacgccgacaacttcgccaacagaagaatgcaccacctgaagatcaacagagagggcagagagctgaccatccagatggaccagcagctgagactgagctacaacttcagccccgaggtggagttcagagtgatcagaagcctgaccctgggcaaggtgaccgagaacctgggcctggacagcgaggtggccaaggccaacgccatgggcttcgccggctgcatgagcagcgtgcagtacaaccacatcgcccccctgaaggccgccctgagacacgccaccgtggcccccgtgaccgtgcacggcaccctgaccgagagcagctgcggcttcatggtggacagcgacgtgaacgccgtgaccaccgtgcacagcagcagcgaccccttcggcaagaccgacgagagagagcccctgaccaacgccgtgagaagcgacagcgccgtgatcggcggcgtgatcgccgtggtgatcttcatcatcttctgcatcatcggcatcatgaccagattcctgtaccagcacaagcagagccacagaaccagccagatgaaggagaaggagtaccccgagaacctggacagcagcttcagaaacgagatcgacctgcagaacaccgtgagcgagtgcaagagagagtacttcatctag

SEQ ID NO: 17650 - DNA, 3129 bp, Artificial Sequence
  Description of Artificial Sequence: Synthetic coding sequence
atgaagcagagccccgccctggcccccgaggagagatgcagaagagccggcagccccaagcccgtgctgagagccgacgacaacaacatgggcaacggctgcagccagaagctggccaccgccaacctgctgagattcctgctgctggtgctgatcccctgcatctgcgccctggtgctgctgctggtgatcctgctgagctacgtgggcaccctgcagaaggtgtacttcaagagcaacggcagcgagcccctggtgaccgacggcgagatccagggcagcgacgtgatcctgaccaacaccatctacaaccagagcaccgtggtgagcaccgcccaccccgaccagcacgtgcccgcctggaccaccgacgccagcctgcccggcgaccagagccacagaaacaccagcgcctgcatgaacatcacccacagccagtgccagatgctgccctaccacgccaccctgacccccctgctgagcgtggtgagaaacatggagatggagaagttcctgaagttcttcacctacctgcacagactgagctgctaccagcacatcatgctgttcggctgcaccctggccttccccgagtgcatcatcgacggcgacgacagccacggcctgctgccctgcagaagcttctgcgaggccgccaaggagggctgcgagagcgtgctgggcatggtgaactacagctggcccgacttcctgagatgcagccagttcagaaaccagaccgagagcagcaacgtgagcagaatctgcttcagcccccagcaggagaacggcaagcagctgctgtgcggcagaggcgagaacttcctgtgcgccagcggcatctgcatccccggcaagctgcagtgcaacggctacaacgactgcgacgactggagcgacgaggcccactgcaactgcagcgagaacctgttccactgccacaccggcaagtgcctgaactacagcctggtgtgcgacggctacgacgactgcggcgacctgagcgacgagcagaactgcgactgcaaccccaccaccgagcacagatgcggcgacggcagatgcatcgccatggagtgggtgtgcgacggcgaccacgactgcgtggacaagagcgacgaggtgaactgcagctgccacagccagggcctggtggagtgcagaaacggccagtgcatccccagcaccttccagtgcgacggcgacgaggactgcaaggacggcagcgacgaggagaactgcagcgtgatccagaccagctgccaggagggcgaccagagatgcctgtacaacccctgcctggacagctgcggcggcagcagcctgtgcgaccccaacaacagcctgaacaactgcagccagtgcgagcccatcaccctggagctgtgcatgaacctgccctacaacagcaccagctaccccaactacttcggccacagaacccagaaggaggccagcatcagctgggagagcagcctgttccccgccctggtgcagaccaactgctacaagtacctgatgttcttcagctgcaccatcctggtgcccaagtgcgacgtgaacaccggcgagcacatccccccctgcagagccctgtgcgagcacagcaaggagagatgcgagagcgtgctgggcatcgtgggcctgcagtggcccgaggacaccgactgcagccagttccccgaggagaacagcgacaaccagacctgcctgatgcccgacgagtacgtggaggagtgcagccccagccacttcaagtgcagaagcggccagtgcgtgctggccagcagaagatgcgacggccaggccgactgcgacgacgacagcgacgaggagaactgcggctgcaaggagagagacctgtgggagtgccccagcaacaagcagtgcctgaagcacaccgtgatctgcgacggcttccccgactgccccgactacatggacgagaagaactgcagcttctgccaggacgacgagctggagtgcgccaaccacgcctgcgtgagcagagacctgtggtgcgacggcgaggccgactgcagcgacagcagcgacgagtgggactgcgtgaccctgagcatcaacgtgaacagcagcagcttcctgatggtgcacagagccgccaccgagcaccacgtgtgcgccgacggctggcaggagatcctgagccagctggcctgcaagcagatgggcctgggcgagcccagcgtgaccaagctgatccaggagcaggagaaggagcccagatggctgaccctgcacagcaactgggagagcctgaacggcaccaccctgcacgagctgctggtgaacggccagagctgcgagagcagaagcaagatcagcctgctgtgcaccaagcaggactgcggcagaagacccgccgccagaatgaacaagagaatcctgggcggcagaaccagcagacccggcagatggccctggcagtgcagcctgcagagcgagcccagcggccacatctgcggctgcgtgctgatcgccaagaagtgggtgctgaccgtggcccactgcttcgagggcagagagaacgccgccgtgtggaaggtggtgctgggcatcaacaacctggaccaccccagcgtgttcatgcagaccagattcgtgaagaccatcatcctgcaccccagatacagcagagccgtggtggactacgacatcagcatcgtggagctgagcgaggacatcagcgagaccggctacgtgagacccgtgtgcctgcccaaccccgagcagtggctggagcccgacacctactgctacatcaccggctggggccacatgggcaacaagatgcccttcaagctgcaggagggcgaggtgagaatcatcagcctggagcactgccagagctacttcgacatgaagaccatcaccaccagaatgatctgcgccggctacgagagcggcaccgtggacagctgcatgggcgacagcggcggccccctggtgtgcgagaagcccggcggcagatggaccctgttcggcctgaccagctggggcagcgtgtgcttcagcaaggtgctgggccccggcgtgtacagcaacgtgagctacttcgtggagtggatcaagagacagatctacatccagaccttcctgctgaactag

SEQ ID NO: 17651 - DNA, 2928 bp, Artificial Sequence
  Description of Artificial Sequence: Synthetic coding sequence
atgaagcagagccccgccctggcccccgaggagagatgcagaagagccggcagccccaagcccgtgctgagagccgacgacaacaacatgggcaacggctgcagccagaagctggccaccgccaacctgctgagattcctgctgctggtgctgatcccctgcatctgcgccctggtgctgctgctggtgatcctgctgagctacgtgggcgcctgcatgaacatcacccacagccagtgccagatgctgccctaccacgccaccctgacccccctgctgagcgtggtgagaaacatggagatggagaagttcctgaagttcttcacctacctgcacagactgagctgctaccagcacatcatgctgttcggctgcaccctggccttccccgagtgcatcatcgacggcgacgacagccacggcctgctgccctgcagaagcttctgcgaggccgccaaggagggctgcgagagcgtgctgggcatggtgaactacagctggcccgacttcctgagatgcagccagttcagaaaccagaccgagagcagcaacgtgagcagaatctgcttcagcccccagcaggagaacggcaagcagctgctgtgcggcagaggcgagaacttcctgtgcgccagcggcatctgcatccccggcaagctgcagtgcaacggctacaacgactgcgacgactggagcgacgaggcccactgcaactgcagcgagaacctgttccactgccacaccggcaagtgcctgaactacagcctggtgtgcgacggctacgacgactgcggcgacctgagcgacgagcagaactgcgactgcaaccccaccaccgagcacagatgcggcgacggcagatgcatcgccatggagtgggtgtgcgacggcgaccacgactgcgtggacaagagcgacgaggtgaactgcagctgccacagccagggcctggtggagtgcagaaacggccagtgcatccccagcaccttccagtgcgacggcgacgaggactgcaaggacggcagcgacgaggagaactgcagcgtgatccagaccagctgccaggagggcgaccagagatgcctgtacaacccctgcctggacagctgcggcggcagcagcctgtgcgaccccaacaacagcctgaacaactgcagccagtgcgagcccatcaccctggagctgtgcatgaacctgccctacaacagcaccagctaccccaactacttcggccacagaacccagaaggaggccagcatcagctgggagagcagcctgttccccgccctggtgcagaccaactgctacaagtacctgatgttcttcagctgcaccatcctggtgcccaagtgcgacgtgaacaccggcgagcacatccccccctgcagagccctgtgcgagcacagcaaggagagatgcgagagcgtgctgggcatcgtgggcctgcagtggcccgaggacaccgactgcagccagttccccgaggagaacagcgacaaccagacctgcctgatgcccgacgagtacgtggaggagtgcagccccagccacttcaagtgcagaagcggccagtgcgtgctggccagcagaagatgcgacggccaggccgactgcgacgacgacagcgacgaggagaactgcggctgcaaggagagagacctgtgggagtgccccagcaacaagcagtgcctgaagcacaccgtgatctgcgacggcttccccgactgccccgactacatggacgagaagaactgcagcttctgccaggacgacgagctggagtgcgccaaccacgcctgcgtgagcagagacctgtggtgcgacggcgaggccgactgcagcgacagcagcgacgagtgggactgcgtgaccctgagcatcaacgtgaacagcagcagcttcctgatggtgcacagagccgccaccgagcaccacgtgtgcgccgacggctggcaggagatcctgagccagctggcctgcaagcagatgggcctgggcgagcccagcgtgaccaagctgatccaggagcaggagaaggagcccagatggctgaccctgcacagcaactgggagagcctgaacggcaccaccctgcacgagctgctggtgaacggccagagctgcgagagcagaagcaagatcagcctgctgtgcaccaagcaggactgcggcagaagacccgccgccagaatgaacaagagaatcctgggcggcagaaccagcagacccggcagatggccctggcagtgcagcctgcagagcgagcccagcggccacatctgcggctgcgtgctgatcgccaagaagtgggtgctgaccgtggcccactgcttcgagggcagagagaacgccgccgtgtggaaggtggtgctgggcatcaacaacctggaccaccccagcgtgttcatgcagaccagattcgtgaagaccatcatcctgcaccccagatacagcagagccgtggtggactacgacatcagcatcgtggagctgagcgaggacatcagcgagaccggctacgtgagacccgtgtgcctgcccaaccccgagcagtggctggagcccgacacctactgctacatcaccggctggggccacatgggcaacaagatgcccttcaagctgcaggagggcgaggtgagaatcatcagcctggagcactgccagagctacttcgacatgaagaccatcaccaccagaatgatctgcgccggctacgagagcggcaccgtggacagctgcatgggcgacagcggcggccccctggtgtgcgagaagcccggcggcagatggaccctgttcggcctgaccagctggggcagcgtgtgcttcagcaaggtgctgggccccggcgtgtacagcaacgtgagctacttcgtggagtggatcaagagacagatctacatccagaccttcctgctgaactag

SEQ ID NO: 17652 - DNA, 3018 bp, Artificial Sequence
  Description of Artificial Sequence: Synthetic coding sequence
atgaagcagagccccgccctggcccccgaggagagatgcagaagagccggcagccccaagcccgtgctgagagccgacgacaacaacatgggcaacggctgcagccagaagctggccaccgccaacctgctgagattcctgctgctggtgctgatcccctgcatctgcgccctggtgctgctgctggtgatcctgctgagctacgtgggcaccctgcagaaggtgtacttcaagagcaacggcagcgagcccctggtgaccgacggcgagatccagggcagcgacgtgatcctgaccaacaccatctacaaccagagcaccgtggtgagcaccgcccaccccgaccagcacgtgcccgcctggaccaccgacgccagcctgcccggcgaccagagccacagaaacaccagcgcctgcatgaacatcacccacagccagtgccagatgctgccctaccacgccaccctgacccccctgctgagcgtggtgagaaacatggagatggagaagttcctgaagttcttcacctacctgcacagactgagctgctaccagcacatcatgctgttcggctgcaccctggccttccccgagtgcatcatcgacggcgacgacagccacggcctgctgccctgcagaagcttctgcgaggccgccaaggagggctgcgagagcgtgctgggcatggtgaactacagctggcccgacttcctgagatgcagccagttcagaaaccagaccgagagcagcaacgtgagcagaatctgcttcagcccccagcaggagaacggcaagcagctgctgtgcggcagaggcgagaacttcctgtgcgccagcggcatctgcatccccggcaagctgcagtgcaacggctacaacgactgcgacgactggagcgacgaggcccactgcaactgcagcgagaacctgttccactgccacaccggcaagtgcctgaactacagcctggtgtgcgacggctacgacgactgcggcgacctgagcgacgagcagaactgcgcctgccacagccagggcctggtggagtgcagaaacggccagtgcatccccagcaccttccagtgcgacggcgacgaggactgcaaggacggcagcgacgaggagaactgcagcgtgatccagaccagctgccaggagggcgaccagagatgcctgtacaacccctgcctggacagctgcggcggcagcagcctgtgcgaccccaacaacagcctgaacaactgcagccagtgcgagcccatcaccctggagctgtgcatgaacctgccctacaacagcaccagctaccccaactacttcggccacagaacccagaaggaggccagcatcagctgggagagcagcctgttccccgccctggtgcagaccaactgctacaagtacctgatgttcttcagctgcaccatcctggtgcccaagtgcgacgtgaacaccggcgagcacatccccccctgcagagccctgtgcgagcacagcaaggagagatgcgagagcgtgctgggcatcgtgggcctgcagtggcccgaggacaccgactgcagccagttccccgaggagaacagcgacaaccagacctgcctgatgcccgacgagtacgtggaggagtgcagccccagccacttcaagtgcagaagcggccagtgcgtgctggccagcagaagatgcgacggccaggccgactgcgacgacgacagcgacgaggagaactgcggctgcaaggagagagacctgtgggagtgccccagcaacaagcagtgcctgaagcacaccgtgatctgcgacggcttccccgactgccccgactacatggacgagaagaactgcagcttctgccaggacgacgagctggagtgcgccaaccacgcctgcgtgagcagagacctgtggtgcgacggcgaggccgactgcagcgacagcagcgacgagtgggactgcgtgaccctgagcatcaacgtgaacagcagcagcttcctgatggtgcacagagccgccaccgagcaccacgtgtgcgccgacggctggcaggagatcctgagccagctggcctgcaagcagatgggcctgggcgagcccagcgtgaccaagctgatccaggagcaggagaaggagcccagatggctgaccctgcacagcaactgggagagcctgaacggcaccaccctgcacgagctgctggtgaacggccagagctgcgagagcagaagcaagatcagcctgctgtgcaccaagcaggactgcggcagaagacccgccgccagaatgaacaagagaatcctgggcggcagaaccagcagacccggcagatggccctggcagtgcagcctgcagagcgagcccagcggccacatctgcggctgcgtgctgatcgccaagaagtgggtgctgaccgtggcccactgcttcgagggcagagagaacgccgccgtgtggaaggtggtgctgggcatcaacaacctggaccaccccagcgtgttcatgcagaccagattcgtgaagaccatcatcctgcaccccagatacagcagagccgtggtggactacgacatcagcatcgtggagctgagcgaggacatcagcgagaccggctacgtgagacccgtgtgcctgcccaaccccgagcagtggctggagcccgacacctactgctacatcaccggctggggccacatgggcaacaagatgcccttcaagctgcaggagggcgaggtgagaatcatcagcctggagcactgccagagctacttcgacatgaagaccatcaccaccagaatgatctgcgccggctacgagagcggcaccgtggacagctgcatgggcgacagcggcggccccctggtgtgcgagaagcccggcggcagatggaccctgttcggcctgaccagctggggcagcgtgtgcttcagcaaggtgctgggccccggcgtgtacagcaacgtgagctacttcgtggagtggatcaagagacagatctacatccagaccttcctgctgaactag

SEQ ID NO: 17653 - DNA, 555 bp, Artificial Sequence
  Description of Artificial Sequence: Synthetic coding sequence
atgaagcccgacgagacccccatgttcgaccccagcctgctgaaggaggtggactggagccagaacaccgccaccttcagccccgccatcagccccacccaccccggcgagggcctggtgctgagacccctgtgcaccgccgacctgaacagaggcttcttcaaggtgctgggccagctgaccgagaccggcgtggtgagccccgagcagttcatgaagagcttcgagcacatgaagaagagcggcgactactacgtgaccgtggtggaggacgtgaccctgggccagatcgtggccaccgccaccctgatcatcgagcacaagttcatccacagctgcgccaagagaggcagagtggaggacgtggtggtgagcgacgagtgcagaggcaagcagctgggcaagctgctgctgagcaccctgaccctgctgagcaagaagctgaactgctacaagatcaccctggagtgcctgccccagaacgtgggcttctacaagaagttcggctacaccgtgagcgaggagaactacatgtgcagaagattcctgaagtag

SEQ ID NO: 17654 - DNA, 291 bp, Artificial Sequence
  Description of Artificial Sequence: Synthetic coding sequence
atggccttcaccttcgccgccttctgctacatgctggccctgctgctgaccgccgccctgatcttcttcgccatctggcacatcatcgccttcgacgagctgaagaccgactacaagaaccccatcgaccagtgcaacaccctgaaccccctggtgctgcccgagtacctgatccacgccttcttctgcgtgatgttcctgtgcgccgccgagtggctgaccctgggcctgaacatgcccctgctggcctaccacatctggagcatgatctacgtgctggtgagcagctag

SEQ ID NO: 17655 - DNA, 483 bp, Artificial Sequence
  Description of Artificial Sequence: Synthetic coding sequence
atggccttcaccttcgccgccttctgctacatgctgaccctggtgctgtgcgccagcctgatcttcttcgtgatctggcacatcatcgccttcgacgagctgagaaccgacttcaagaaccccatcgaccagggcaaccccgccagagccagagagagactgaagaacatcgagagaatctgctgcctgctgagaaagctggtggtgcccgagtacagcatccacggcctgttctgcctgatgttcctgtgcgccgccgagtgggtgaccctgggcctgaacatccccctgctgttctaccacctgtggagatacttccacagacccgccgacggcagcgaggtgatgtacgacgccgtgagcatcatgaacgccgacatcctgaactactgccagaaggagagctggtgcaagctggccttctacctgctgagcttcttctactacctgtacagcatggtgtacaccctggtgagcttctag

SEQ ID NO: 17656 - DNA, 483 bp, Artificial Sequence
  Description of Artificial Sequence: Synthetic coding sequence
atggccttcaccttcgccgccttctgctacatgctgagcctggtgctgtgcgccgccctgatcttcttcgccatctggcacatcatcgccttcgacgagctgagaaccgacttcaagagccccatcgaccagtgcaaccccgtgcacgccagagagagactgagaaacatcgagagaatctgcttcctgctgagaaagctggtgctgcccgagtacagcatccacagcctgttctgcatcatgttcctgtgcgcccaggagtggctgaccctgggcctgaacgtgcccctgctgttctaccacttctggagatacttccactgccccgccgacagcagcgagctggcctacgacccccccgtggtgatgaacgccgacaccctgagctactgccagaaggaggcctggtgcaagctggccttctacctgctgagcttcttctactacctgtactgcatgatctacaccctggtgagcagctag

SEQ ID NO: 17657 - DNA, 414 bp, Artificial Sequence
  Description of Artificial Sequence: Synthetic coding sequence
atggaggccgtggtgttcgtgttcagcctgctggactgctgcgccctgatcttcctgagcgtgtacttcatcatcaccctgagcgacctggagtgcgactacatcaacgccagaagctgctgcagcaagctgaacaagtgggtgatccccgagctgatcggccacaccatcgtgaccgtgctgctgctgatgagcctgcactggttcatcttcctgctgaacctgcccgtggccacctggaacatctacagatacatcatggtgcccagcggcaacatgggcgtgttcgaccccaccgagatccacaacagaggccagctgaagagccacatgaaggaggccatgatcaagctgggcttccacctgctgtgcttcttcatgtacctgtacagcggcagcaactgcccctgctag

SEQ ID NO: 17658 - DNA, 279 bp, Artificial Sequence
  Description of Artificial Sequence: Synthetic coding sequence
atggaggccgtggtgttcgtgttcagcctgctggactgctgcgccctgatcttcctgagcgtgtacttcatcatcaccctgagcgacctggagtgcgactacatcaacgccagaagctgctgcagcaagctgaacaagtgggtgatccccgagctgatcggccacaccatcgtgaccgtgctgctgctgatgagcctgcactggttcatcttcctgctgaacctgcccgtggccacctggaacatctacagaatgatcctggccctgatcaacgactag

SEQ ID NO: 17659 - DNA, 273 bp, Artificial Sequence
  Description of Artificial Sequence: Synthetic coding sequence
atggaggccgtggtgttcgtgttcagcctgctggactgctgcgccctgatcttcctgagcgtgtacttcatcatcaccctgagcgacctggagtgcgactacatcaacgccagaagctgctgcagcaagctgaacaagtgggtgatccccgagctgatcggccacaccatcgtgaccgtgctgctgctgatgagcctgcactggttcatcttcctgctgaacctgcccgtggccacctggaacatctacagaggcagcaactgcccctgctag

SEQ ID NO: 17660 - DNA, 420 bp, Artificial Sequence
  Description of Artificial Sequence: Synthetic coding sequence
atggaggccgtggtgttcgtgttcagcctgctggactgctgcgccctgatcttcctgagcgtgtacttcatcatcaccctgagcgacctggagtgcgactacatcaacgccagaagctgctgcagcaagctgaacaagtgggtgatccccgagctgatcggccacaccatcgtgaccgtgctgctgctgatgagcctgcactggttcatcttcctgctgaacctgcccgtggccacctggaacatctacagatacatcatggtgcccagcggcaacatgggcgtgttcgaccccaccgagatccacaacagaggccagctgaagagccacatgaaggaggccatgatcaagctgggcttccacctgctgtgcttcttcatgtacctgtacagcatgatcctggccctgatcaacgactag

SEQ ID NO: 17661 - DNA, 246 bp, Artificial Sequence
  Description of Artificial Sequence: Synthetic coding sequence
atggacggcggccagcccatccccagcagcctggtgcccctgggcaacgagagcgccgacagcagcatgagcctggagcagaagatgaccttcgtgttcgtgatcctgctgttcatcttcctgggcatcctgatcgtgagatgcttcagaatcctgctggacccctacagaagcatgcccaccagcacctgggccgacggcctggagggcctggagaagggccagttcgaccacgccctggcctag

SEQ ID NO: 17662 - DNA, 246 bp, Artificial Sequence; identical to SEQ ID NO: 17661
  Description of Artificial Sequence: Synthetic coding sequence

SEQ ID NO: 17663 - DNA, 114 bp, Artificial Sequence
  Description of Artificial Sequence: Synthetic coding sequence
gtgtacaccgactacatctacttcaacagcttcctggagagcttccagggcttcttcgtgagcgtgttctactgcttcctgaacagcgaggtgagaagcgccatcagaaagtag

SEQ ID NO: 17664 - DNA, 723 bp, Artificial Sequence
  Description of Artificial Sequence: Synthetic coding sequence
atgagccccgaggtgcaccagagcaacgtgggctggtgcagactggtgaccgccgcctacaactacttccacgtgaccaacttcttctggatgttcggcgagggctgctacctgcacaccgccatcgtgctgacctacagcaccgacagactgagaaagtggatgttcatctgcatcggctggggcgtgcccttccccatcatcgtggcctgggccatcggcaagctgtactacgacaacgagaagtgctggttcggcaagagacccggcgtgtacaccgactacatctaccagggccccatgatcctggtgctgctgatcaacttcatcttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgaggtgagcagagtggtgttcatctacttcaacagcttcctggagagcttccagggcttcttcgtgagcgtgttctactgcttcctgaacagcgaggtgagaagcgccatcagaaagagatggcacagatggcaggacaagcacagcatcagagccagagtggccagagccatgagcatccccaccagccccaccagagtgagcttccacagcatcaagcagagcaccgccgtgtag

SEQ ID NO: 17665 - DNA, 1206 bp, Artificial Sequence
  Description of Artificial Sequence: Synthetic coding sequence
atgggcggccacccccagctgagactggtgaaggccctgctgctgctgggcctgaaccccgtgagcgccagcctgcaggaccagcactgcgagagcctgagcctggccagcaacatcagcggcctgcagtgcaacgccagcgtggacctgatcggcacctgctggcccagaagccccgccggccagctggtggtgagaccctgccccgccttcttctacggcgtgagatacaacaccaccaacaacggctacagagagtgcctggccaacggcagctgggccgccagagtgaactacagcgagtgccaggagatcctgaacgaggagaagaagagcaaggtgcactaccacgtggccgtgatcatcaactacctgggccactgcatcagcctggtggccctgctggtggccttcgtgctgttcctgagactgagaagcatcagatgcctgagaaacatcatccactggaacctgatcagcgccttcatcctgagaaacgccacctggttcgtggtgcagctgaccatgagccccgaggtgcaccagagcaacgtgggctggtgcagactggtgaccgccgcctacaactacttccacgtgaccaacttcttctggatgttcggcgagggctgctacctgcacaccgccatcgtgctgacctacagcaccgacagactgagaaagtggatgttcatctgcatcggctggggcgtgcccttccccatcatcgtggcctgggccatcggcaagctgtactacgacaacgagaagtgctggttcggcaagagacccggcgtgtacaccgactacatctaccagggccccatgatcctggtgctgctgatcaacttcatcttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgaggtgagcagagtggtgttcatctacttcaacagcttcctggagagcttccaggtgagaagcgccatcagaaagagatggcacagatggcaggacaagcacagcatcagagccagagtggccagagccatgagcatccccaccagccccaccagagtgagcttccacagcatcaagcagagcaccgccgtgtag

SEQ ID NO: 17666 - DNA, 1128 bp, Artificial Sequence
  Description of Artificial Sequence: Synthetic coding sequence
atgggcggccacccccagctgagactggtgaaggccctgctgctgctgggcctgaaccccgtgagcgccagcctgcaggaccagcactgcgagagcctgagcctggccagcaacatcagcgacaacggctacagagagtgcctggccaacggcagctgggccgccagagtgaactacagcgagtgccaggagatcctgaacgaggagaagaagagcaaggtgcactaccacgtggccgtgatcatcaactacctgggccactgcatcagcctggtggccctgctggtggccttcgtgctgttcctgagactgagaagcatcagatgcctgagaaacatcatccactggaacctgatcagcgccttcatcctgagaaacgccacctggttcgtggtgcagctgaccatgagccccgaggtgcaccagagcaacgtgggctggtgcagactggtgaccgccgcctacaactacttccacgtgaccaacttcttctggatgttcggcgagggctgctacctgcacaccgccatcgtgctgacctacagcaccgacagactgagaaagtggatgttcatctgcatcggctggggcgtgcccttccccatcatcgtggcctgggccatcggcaagctgtactacgacaacgagaagtgctggttcggcaagagacccggcgtgtacaccgactacatctaccagggccccatgatcctggtgctgctgatcaacttcatcttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgaggtgagcagagtggtgttcatctacttcaacagcttcctggagagcttccagggcttcttcgtgagcgtgttctactgcttcctgaacagcgaggtgagaagcgccatcagaaagagatggcacagatggcaggacaagcacagcatcagagccagagtggccagagccatgagcatccccaccagccccaccagagtgagcttccacagcatcaagcagagcaccgccgtgtag

SEQ ID NO: 17667 - DNA, 378 bp, Artificial Sequence
  Description of Artificial Sequence: Synthetic coding sequence
atgggcggccacccccagctgagactggtgaaggccctgctgctgctgggcctgaaccccgtgagcgccagcctgcaggaccagcactgcgagagcctgagcctggccagcaacatcagcggcctgcagtgcaacgccagcgtggacctgatcggcacctgctggcccagaagccccgccggccagctggtggtgagaccctgccccgccttcttctacggcgtgagatacaacaccaccaacaacggctacagagagtgcctggccaacggcagctgggccgccagagtgaactacagcgagtgccaggagatcctgaacgaggaggagcccggcacccaggcccagcccggcagagcccacagaggcggcacctag

SEQ ID NO: 17668 - DNA, 1248 bp, Artificial Sequence
  Description of Artificial Sequence: Synthetic coding sequence
atgggcggccacccccagctgagactggtgaaggccctgctgctgctgggcctgaaccccgtgagcgccagcctgcaggaccagcactgcgagagcctgagcctggccagcaacatcagcggcctgcagtgcaacgccagcgtggacctgatcggcacctgctggcccagaagccccgccggccagctggtggtgagaccctgccccgccttcttctacggcgtgagatacaacaccaccaacaacggctacagagagtgcctggccaacggcagctgggccgccagagtgaactacagcgagtgccaggagatcctgaacgaggagaagaagagcaaggtgcactaccacgtggccgtgatcatcaactacctgggccactgcatcagcctggtggccctgctggtggccttcgtgctgttcctgagactgagaagcatcagatgcctgagaaacatcatccactggaacctgatcagcgccttcatcctgagaaacgccacctggttcgtggtgcagctgaccatgagccccgaggtgcaccagagcaacgtgggctggtgcagactggtgaccgccgcctacaactacttccacgtgaccaacttcttctggatgttcggcgagggctgctacctgcacaccgccatcgtgctgacctacagcaccgacagactgagaaagtggatgttcatctgcatcggctggggcgtgcccttccccatcatcgtggcctgggccatcggcaagctgtactacgacaacgagaagtgctggttcggcaagagacccggcgtgtacaccgactacatctaccagggccccatgatcctggtgctgctgatcaacttcatcttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgaggtgagcagagtggtgttcatctacttcaacagcttcctggagagcttccagggcttcttcgtgagcgtgttctactgcttcctgaacagcgaggtgagaagcgccatcagaaagagatggcacagatggcaggacaagcacagcatcagagccagagtggccagagccatgagcatccccaccagccccaccagagtgagcttccacagcatcaagcagagcaccgccgtgtag

SEQ ID NO: 17669 - DNA, 858 bp, Artificial Sequence
  Description of Artificial Sequence: Synthetic coding sequence
atggtgagcgccaccatcccccagaagaagagcaaggtgcactaccacgtggccgtgatcatcaactacctgggccactgcatcagcctggtggccctgctggtggccttcgtgctgttcctgagactgagaagcatcagatgcctgagaaacatcatccactggaacctgatcagcgccttcatcctgagaaacgccacctggttcgtggtgcagctgaccatgagccccgaggtgcaccagagcaacgtgggctggtgcagactggtgaccgccgcctacaactacttccacgtgaccaacttcttctggatgttcggcgagggctgctacctgcacaccgccatcgtgctgacctacagcaccgacagactgagaaagtggatgttcatctgcatcggctggggcgtgcccttccccatcatcgtggcctgggccatcggcaagctgtactacgacaacgagaagtgctggttcggcaagagacccggcgtgtacaccgactacatctaccagggccccatgatcctggtgctgctgatcaacttcatcttcctgttcaacatcgtgagaatcctgatgaccaagctgagagccagcaccaccagcgagaccatccagtacagagccagcctgtgcctgtgcagcaccgtgagcagcatcgtgagaagcgtgctgcccagcggcagaggcggcaccggcggcagaaccagcaccagaagcgtgcccgagtggcccgtgccctgccccagcccccccccccagcccgtgagcgccttcaccgccagcagcagcccccagcagagcgagctggccggccacggcgccgcccccaagcagctgtggctgggcggctag

SEQ ID NO: 17670 - DNA, 1335 bp, Artificial Sequence
  Description of Artificial Sequence: Synthetic coding sequence
atgggcggccacccccagctgagactggtgaaggccctgctgctgctgggcctgaaccccgtgagcgccagcctgcaggaccagcactgcgagagcctgagcctggccagcaacatcagcggcctgcagtgcaacgccagcgtggacctgatcggcacctgctggcccagaagccccgccggccagctggtggtgagaccctgccccgccttcttctacggcgtgagatacaacaccaccaacaacggctacagagagtgcctggccaacggcagctgggccgccagagtgaactacagcgagtgccaggagatcctgaacgaggagaagaagagcaaggtgcactaccacgtggccgtgatcatcaactacctgggccactgcatcagcctggtggccctgctggtggccttcgtgctgttcctgagactgagacccggctgcacccactggggcgaccaggccgacggcgccctggaggtgggcgccccctggagcggcgcccccttccaggtgagaagaagcatcagatgcctgagaaacatcatccactggaacctgatcagcgccttcatcctgagaaacgccacctggttcgtggtgcagctgaccatgagccccgaggtgcaccagagcaacgtgggctggtgcagactggtgaccgccgcctacaactacttccacgtgaccaacttcttctggatgttcggcgagggctgctacctgcacaccgccatcgtgctgacctacagcaccgacagactgagaaagtggatgttcatctgcatcggctggggcgtgcccttccccatcatcgtggcctgggccatcggcaagctgtactacgacaacgagaagtgctggttcggcaagagacccggcgtgtacaccgactacatctaccagggccccatgatcctggtgctgctgatcaacttcatcttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgaggtgagcagagtggtgttcatctacttcaacagcttcctggagagcttccagggcttcttcgtgagcgtgttctactgcttcctgaacagcgaggtgagaagcgccatcagaaagagatggcacagatggcaggacaagcacagcatcagagccagagtggccagagccatgagcatccccaccagccccaccagagtgagcttccacagcatcaagcagagcaccgccgtgtag

SEQ ID NO: 17671 - DNA, 321 bp, Artificial Sequence
  Description of Artificial Sequence: Synthetic coding sequence
atggccctggaccccgccgaccagcacctgagacacgtggagaaggacgtgctgatccccaagatcatgagagagaaggccaaggagagatgcagcgagcaggtgcaggacttcaccaagtgctgcaagaacagcggcgtgctgatggtggtgaagtgcagaaaggagaacagcgccctgaaggagtgcctgaccgcctactacaacgaccccgccttctacgaggagtgcaagatggagtacctgaaggagagagaggagttcagaaagaccggcatccccaccaagaagagactgcagaagctgcccaccagcatgtag

SEQ ID NO: 17672 - DNA, 321 bp, Artificial Sequence
  Description of Artificial Sequence: Synthetic coding sequence
atgttcgcccccgccgtgatgagagccttcagaaagaacaagaccctgggctacggcgtgcccatgctgctgctgatcgtgggcggcagcttcggcctgagagagttcagccagatcagatacgacgccgtgaagagcaagatggaccccgagctggagaagaagctgaaggagaacaagatcagcctggagagcgagtacgagaagatcaaggacagcaagttcgacgactggaagaacatcagaggccccagaccctgggaggaccccgacctgctgcagggcagaaaccccgagagcctgaagaccaagaccacctag

SEQ ID NO: 17673 - DNA, 1002 bp, Artificial Sequence
  Description of Artificial Sequence: Synthetic coding sequence
atgctgtgcagactgggcggcagatggctgagacccctgcccgccctgcagctgtgggccagagacctgcccctggcccccgtgcccaccagcggcgccaagagacccaccctgcccgtgtgggccgtggcccccgtgagcgccgtgcacgccaacggctggtacgaggccctggccgccagcagccccgtgagagtggccgaggaggtgctgctgggcgtgcacgccgccaccggcctgccctggtggggcagcatcctgctgagcaccgtggccctgagaggcgccgtgaccctgcccctggccgcctaccagcactacatcctggccaaggtggagaacctgcagcccgagatcaagaccatcgccagacacctgaaccaggaggtggccgtgagagccaaccagctgggctggagcaagagagacgccagactgacctacctgaagaacatgagaagactgatcagcgagctgtacgtgagagacaactgccaccccttcaaggccaccgtgctggtgtggatccagctgcccatgtggatcttcatgagcttcgccctgagaaacctgagcaccggcgccgcccacagcgagggcttcagcgtgcaggagcagctggccaccggcggcatcctgtggttccccgacctgaccgcccccgacagcacctggatcctgcccatcagcgtgggcgtgatcaacctgctgatcgtggagatctgcgccctgcagaagatcggcatgagcagattccagacctacatcacctacttcgtgagagccatgagcgtgctgatgatccccatcgccgccaccgtgcccagcagcatcgtgctgtactggctgtgcagcagcttcgtgggcctgagccagaacctgctgctgagaagccccggcttcagacagctgtgcagaatccccagcaccaagagcgacagcgagaccccctacaaggacatcttcgccgccttcaacaccaagttcatcagcagaaagtag

SEQ ID NO: 17674 - DNA, 1005 bp, Artificial Sequence
  Description of Artificial Sequence: Synthetic coding sequence
atgctgtgcagactgggcggcagatggctgagacccctgcccgccctgcagctgtgggccagagacctgcccctggcccccgtgcccaccagcggcgccaagagacccaccctgcccgtgtgggccgtggcccccgtgagcgccgtgcacgccaacggctggtacgaggccctggccgccagcagccccgtgagagtggccgaggaggtgctgctgggcgtgcacgccgccaccggcctgccctggtggggcagcatcctgctgagcaccgtggccctgagaggcgccgtgaccctgcccctggccgcctaccagcactacatcctggccaaggtggagaacctgcagcccgagatcaagaccatcgccagacacctgaaccaggaggtggccgtgagagccaaccagctgggctggagcaagagagacgccagactgacctacctgaagaacatgagaagactgatcagcgagctgtacgtgagagacaactgccaccccttcaaggccaccgtgctggtgtggatccagctgcccatgtggatcttcatgagcttcgccctgagaaacctgagcaccggcgccgcccacagcgaggccggcttcagcgtgcaggagcagctggccaccggcggcatcctgtggttccccgacctgaccgcccccgacagcacctggatcctgcccatcagcgtgggcgtgatcaacctgctgatcgtggagatctgcgccctgcagaagatcggcatgagcagattccagacctacatcacctacttcgtgagagccatgagcgtgctgatgatccccatcgccgccaccgtgcccagcagcatcgtgctgtactggctgtgcagcagcttcgtgggcctgagccagaacctgctgctgagaagccccggcttcagacagctgtgcagaatccccagcaccaagagcgacagcgagaccccctacaaggacatcttcgccgccttcaacaccaagttcatcagcagaaagtag

SEQ ID NO: 17675 - DNA, 2334 bp, Artificial Sequence
  Description of Artificial Sequence: Synthetic coding sequence
atggaggagcccggcgccaccccccagccctacctgggcctggtgctggaggagctgagaagagtggtggccgccctgcccgagagcatgagacccgacgagaacccctacggcttccccagcgagctggtggtgtgcgccgccgtgatcggcttcttcgtggtgctgctgttcctgtggagaagcttcagaagcgtgagaagcagactgtacgtgggcagagagcagaagctgggcgccaccctgagcggcctgatcgaggagaagtgcaagctgctggagaagttcagcctgatccagaaggagtacgagggctacgaggtggagagcagcctggaggacgccagcttcgagaaggccgccgccgaggaggccagaagcctggaggccacctgcgagaagctgaacagaagcaacagcgagctggaggacgagatcctgtgcctggagaaggacctgaaggaggagaagagcaagcacagccagcaggacgagctgatggccgacatcagcaagagcatccagagcctggaggacgagagcaagagcctgaagagccagatcgccgaggccaagatcatctgcaagaccttcaagatgagcgaggagagaagagccatcgccatcaaggacgccctgaacgagaacagccagctgcagaccagccacaagcagctgttccagcaggaggccgaggtgtggaagggcgaggtgagcgagctgaacaagcagaagatcaccttcgaggacagcaaggtgcacgccgagcaggtgctgaacgacaaggagaaccacatcaagaccctgaccggccacctgcccatgatgaaggaccaggccgccgtgctggaggaggacaccaccgacgacgacaacctggagctggaggtgaacagccagtgggagaacggcgccaacctggacgaccccctgaagggcgccctgaagaagctgatccacgccgccaagctgaacgtgagcctgaagagcctggagggcgagagaaaccacatcatcatccagctgagcgaggtggacaagaccaaggaggagctgaccgagcacatcaagaacctgcagacccagcaggccagcctgcagagcgagaacatctacttcgagagcgagaaccagaagctgcagcagaagctgaagatcatgaccgagttctaccaggagaacgagatgaagctgtacagaaagctgaccgtggaggagaactacagaatcgaggaggaggagaagctgagcagagtggaggagaagatcagcagagccaccgagggcctggagacctacagaaagctggccaaggacctggaggaggagctggagagaaccgtgcacttctaccagaagcaggtgatcagctacgagaagagaggccacgacaactggctggccgccagaaccgccgagagaaacctgagcgacctgagaaaggagaacgcccacaacaagcagaagctgaccgagaccgagctgaagttcgagctgctggagaaggaccccaacgccctggacgtgagcaacaccgccttcggcagagagcacagcccctgcagccccagccccctgggcagacccagcagcgagaccagagccttccccagcccccagaccctgctggaggaccccctgagactgagccccgtgctgcccggcggcggcggcagaggccccagcagccccggcaaccccctggaccaccagatcaccaacgagagaggcgagcccagctacgacagactgatcgacccccacagagcccccagcgacaccggcagcctgagcagccccgtggagcaggacagaagaatgatgttccccccccccggccagagctaccccgacagcaccctgcccccccagagagaggacagattctacagcaacagcgagagactgagcggccccgccgagcccagaagcttcaagatgaccagcctggacaagatggacagaagcatgcccagcgagatggagagcagcagaaacgacgccaaggacgacctgggcaacctgaacgtgcccgacagcagcctgcccgccgagaacgaggccaccggccccggcctgatccccccccccctggcccccatcagcggccccctgttccccgtggacaccagaggccccttcatgagaagaggcccccccttccccccccccccccccggcaccatgttcggcgccagcagaggctacttcccccccagagacttccccggccccccccacgcccccttcgccatgagaaacatctacccccccagaggcctgcccccctacctgcaccccagacccggcttctaccccaaccccaccttctag

SEQ ID NO: 17676 - DNA, 2334 bp, Artificial Sequence
  Description of Artificial Sequence: Synthetic coding sequence
atggaggagcccggcgccaccccccagccctacctgggcctggtgctggaggagctgagaagagtggtggccgccctgcccgagagcatgagacccgacgagaacccctacggcttccccagcgagctggtggtgtgcgccgccgtgatcggcttcttcgtggtgctgctgttcctgtggagaagcttcagaagcgtgagaagcagactgtacgtgggcagagagcagaagctgggcgccaccctgagcggcctgatcgaggagaagtgcaagctgctggagaagttcagcctgatccagaaggagtacgagggctacgaggtggagagcagcctggaggacgccagcttcgagaaggccgccgccgaggaggccagaagcctggaggccacctgcgagaagctgaacagaagcaacagcgagctggaggacgagatcctgtgcctggagaaggacctgaaggaggagaagagcaagcacagccagcaggacgagctgatggccgacatcagcaagagcatccagagcctggaggacgagagcaagagcctgaagagccagatcgccgaggccaagatcatctgcaagaccttcaagatgagcgaggagagaagagccatcgccatcaaggacgccctgaacgagaacagccagctgcagaccagccacaagcagctgttccagcaggaggccgaggtgtggaagggccaggtgagcgagctgaacaagcagaagatcaccttcgaggacagcaaggtgcacgccgagcaggtgctgaacgacaaggagaaccacatcaagaccctgaccggccacctgcccatgatgaaggaccaggccgccgtgctggaggaggacaccaccgacgacgacaacctggagctggaggtgaacagccagtgggagaacggcgccaacctggacgaccccctgaagggcgccctgaagaagctgatccacgccgccaagctgaacgtgagcctgaagagcctggagggcgagagaaaccacatcatcatccagctgagcgaggtggacaagaccaaggaggagctgaccgagcacatcaagaacctgcagacccagcaggccagcctgcagagcgagaacatctacttcgagagcgagaaccagaagctgcagcagaagctgaagatcatgaccgagttctaccaggagaacgagatgaagctgtacagaaagctgaccgtggaggagaactacagaatcgaggaggaggagaagctgagcagagtggaggagaagatcagcagagccaccgagggcctggagacctacagaaagctggccaaggacctggaggaggagctggagagaaccgtgcacttctaccagaagcaggtgatcagctacgagaagagaggccacgacaactggctggccgccagaaccgccgagagaaacctgagcgacctgagaaaggagaacgcccacaacaagcagaagctgaccgagaccgagctgaagttcgagctgctggagaaggaccccaacgccctggacgtgagcaacaccgccttcggcagagagcacagcccctgcagccccagccccctgggcagacccagcagcgagaccagagccttccccagcccccagaccctgctggaggaccccctgagactgagccccgtgctgcccggcggcggcggcagaggccccagcagccccggcaaccccctggaccaccagatcaccaacgagagaggcgagcccagctacgacagactgatcgacccccacagagcccccagcgacaccggcagcctgagcagccccgtggagcaggacagaagaatgatgttccccccccccggccagagctaccccgacagcaccctgcccccccagagagaggacagattctacagcaacagcgagagactgagcggccccgccgagcccagaagcttcaagatgaccagcctggacaagatggacagaagcatgcccagcgagatggagagcagcagaaacgacgccaaggacgacctgggcaacctgaacgtgcccgacagcagcctgcccgccgagaacgaggccaccggccccggcttcatccccccccccctggcccccgtgagaggccccctgttccccgtggacaccagaggccccttcatgagaagaggcccccccttccccccccccccccccggcaccatgttcggcgccagcagaggctacttcccccccagagacttccccggccccccccacgcccccttcgccatgagaaacatctacccccccagaggcctgcccccctacctgcaccccagacccggcttctaccccaaccccaccttctag

SEQ ID NO: 17677 - DNA, 2334 bp, Artificial Sequence
  Description of Artificial Sequence: Synthetic coding sequence
atggaggagcccggcgccaccccccagccctacctgggcctggtgctggaggagctgggcagagtggtggccgccctgcccgagagcatgagacccgacgagaacccctacggcttccccagcgagctggtggtgtgcgccgccgtgatcggcttcttcgtggtgctgctgttcctgtggagaagcttcagaagcgtgagaagcagactgtacgtgggcagagagcagaagctgggcgccaccctgagcggcctgatcgaggagaagtgcaagctgctggagaagttcagcctgatccagaaggagtacgagggctacgaggtggagagcagcctggaggacgccagcttcgagaaggccgccgccgaggaggccagaagcctggaggccacctgcgagaagctgagcagaagcaacagcgagctggaggacgagatcctgtgcctggagaaggacctgaaggaggagaagagcaagcacagccagcaggacgagctgatggccgacatcagcaagagcatccagagcctggaggacgagagcaagagcctgaagagccagatcgccgaggccaagatcatctgcaagaccttcaagatgagcgaggagagaagagccatcgccatcaaggacgccctgaacgagaacagccagctgcagaccagccacaagcagctgttccagcaggaggccgaggtgtggaagggccaggtgagcgagctgaacaagcagaagatcaccttcgaggacagcaaggtgcacgccgagcaggtgctgaacgacaaggagaaccacatcaagaccctgaccggccacctgcccatgatgaaggaccaggccgccgtgctggaggaggacaccaccgacgacgacaacctggagctgaaggtgaacagccagtgggagaacggcgccaacctggacgacccccccaagggcgccctgaagaagctgatccacgccgccaagctgaacgtgagcctgaagagcctggagggcgagagaaaccacatcatcatccagctgagcgaggtggacaagaccaaggaggagctgaccgagcacatcaagaacctgcagacccagcaggccagcctgcagagcgagaacatctacttcgagagcgagaaccagaagctgcagcagaagctgaagatcatgaccgagttctaccaggagaacgagatgaagctgtacagaaagctgaccgtggaggagaactacagaatcgaggaggaggagaagctgagcagagtggaggagaagatcagccacgccaccgaggagctggagacctacagaaagctggccaaggacctggaggaggagctggagagaaccgtgcacttctaccagaagcaggtgatcagctacgagaagagaggccacgacaactggctggccgccagaaccgccgagagaaacctgagcgacctgagaaaggagaacgcccacaacaagcagaagctgaccgagagagagctgaagttcgagctgctggagaaggaccccaacgccctggacgtgagcaacaccgccttcggcagagagcacagcccctgcagccccagccccctgggcagacccagcagcgagaccagagccttccccagcccccagaccctgctggaggaccccctgagactgagccccgtgctgcccggcggcggcggcagaggccccagcagccccggcaaccccctggaccaccagatcaccaacgagagaggcgagcccagctacgacagactgatcgacccccacagagcccccagcgacaccggcagcctgagcagccccgtggagcaggacagaagaatgatgttccccccccccggccagagctaccccgacagcaccctgcccccccagagagaggacagattctacagcaacagcgagagactgagcggccccgccgagcccagaagcttcaagatgaccagcctggacaagatggacagaagcatgcccagcgagatggagagcagcagaaacgacgccaaggacgacctgggcaacctgaacgtgcccgacagcagcctgcccgccgagaacgaggccaccggccccggcctgatccccccccccctggcccccatcagcggccccctgttccccgtggacaccagaggccccttcatgagaagaggcccccccttccccccccccccccccggcaccatgttcggcgccagcagaggctacttcccccccagagacttccccggccccccccacgcccccttcgccatgagaaacatctacccccccagaggcctgcccccctacctgcaccccagacccggcttctaccccaaccccaccttctag

SEQ ID NO: 17678 - DNA, 735 bp, Artificial Sequence
  Description of Artificial Sequence: Synthetic coding sequence
atgatgagaacccagtgcctgctgggcctgagaaccttcgtggccttcgccgccaagctgtggagcttcttcatctacctgctgagaagacagatcagaaccgtgatccagtaccagaccgtgagatacgacatcctgcccctgagccccgtgagcagaaacagactggcccaggtgaagagaaagatcctggtgctggacctggacgagaccctgatccacagccaccacgacggcgtgctgagacccaccgtgagacccggcaccccccccgacttcatcctgaaggtggtgatcgacaagcaccccgtgagattcttcgtgcacaagagaccccacgtggacttcttcctggaggtggtgagccagtggtacgagctggtggtgttcaccgccagcatggagatctacggcagcgccgtggccgacaagctggacaacagcagaagcatcctgaagagaagatactacagacagcactgcaccctggagctgggcagctacatcaaggacctgagcgtggtgcacagcgacctgagcagcatcgtgatcctggacaacagccccggcgcctacagaagccaccccgacaacgccatccccatcaagagctggttcagcgaccccagcgacaccgccctgctgaacctgctgcccatgctggacgccctgagattcaccgccgacgtgagaagcgtgctgagcagaaacctgcaccagcacagactgtggtag

SEQ ID NO: 17679 - DNA, 735 bp, Artificial Sequence; identical to SEQ ID NO: 17678
  Description of Artificial Sequence: Synthetic coding sequence

SEQ ID NO: 17680 - DNA, 690 bp, Artificial Sequence
  Description of Artificial Sequence: Synthetic coding sequence
atgcaggacgaggacggctacatcaccctgaacatcaagaccagaaagcccgccctgatcagcgtgggcagcgccagcagcagctggtggagagtgatggccctgatcctgctgatcctgtgcgtgggcatggtggtgggcctggtggccctgggcatctggagcgtgatgcagagaaactacctgcagggcgagaacgagaacagaaccggcaccctgcagcagctggccaagagattctgccagtacgtggtgaagcagagcgagctgaagggcaccttcaagggccacaagtgcagcccctgcgacaccaactggagatactacggcgacagctgctacggcttcttcagacacaacctgacctgggaggagagcaagcagtactgcaccgacatgaacgccaccctgctgaagatcgacaacagaaacatcgtggagtacatcaaggccagaacccacctgatcagatgggtgggcctgagcagacagaagagcaacgaggtgtggaagtgggaggacggcagcgtgatcagcgagaacatgttcgagttcctggaggacggcaagggcaacatgaactgcgcctacttccacaacggcaagatgcaccccaccttctgcgagaacaagcactacctgatgtgcgagagaaaggccggcatgaccaaggtggaccagctgccctag

SEQ ID NO: 17681 - DNA, 591 bp, Artificial Sequence
  Description of Artificial Sequence: Synthetic coding sequence
atgcaggacgaggacggctacatcaccctgaacatcaagaccagaaagcccgccctgatcagcgccgtgatgcagagaaactacctgcagggcgagaacgagaacagaaccggcaccctgcagcagctggccaagagattctgccagtacgtggtgaagcagagcgagctgaagggcaccttcaagggccacaagtgcagcccctgcgacaccaactggagatactacggcgacagctgctacggcttcttcagacacaacctgacctgggaggagagcaagcagtactgcaccgacatgaacgccaccctgctgaagatcgacaacagaaacatcgtggagtacatcaaggccagaacccacctgatcagatgggtgggcctgagcagacagaagagcaacgaggtgtggaagtgggaggacggcagcgtgatcagcgagaacatgttcgagttcctggaggacggcaagggcaacatgaactgcgcctacttccacaacggcaagatgcaccccaccttctgcgagaacaagcactacctgatgtgcgagagaaaggccggcatgaccaaggtggaccagctgccctag

SEQ ID NO: 17682 - DNA, 417 bp, Artificial Sequence
  Description of Artificial Sequence: Synthetic coding sequence
cacaagtgcagcccctgcgacaccaactggagatactacggcgacagctgctacggcttcttcagacacaacctgacctgggaggagagcaagcagtactgcaccgacatgaacgccaccctgctgaagatcgacagcaaggaggagaagctgttcctgaccagcttcagaatcctgaccatcgtgttcatctgggtgggcctgagcagacagaagagcaacgaggtgtggaagtgggaggacggcagcgtgatcagcgacagcctgttcagccagagcaacttccagaacggcaagggcaacatgaactgcgcctacttccacaacggcaagatgcaccccaccttctgcgagaacaagcactacctgatgtgcgagagaaaggccggcatgaccaaggtggaccagctgccctag

SEQ ID NO: 17683 - DNA, 591 bp, Artificial Sequence; identical to SEQ ID NO: 17681
  Description of Artificial Sequence: Synthetic coding sequence

SEQ ID NO: 17684 - DNA, 831 bp, Artificial Sequence
  Description of Artificial Sequence: Synthetic coding sequence
atgagcgaggaggtgacctacgccaccctgaccttccaggacagcgccggcgccagaaacaacagagacggcaacaacctgagaaagagaggccaccccgcccccagccccatctggagacacgccgccctgggcctggtgaccctgtgcctgatgctgctgatcggcctggtgaccctgggcatgatgttcctgcagatcagcaacgacatcaacagcgacagcgagaagctgagccagctgcagaagaccatccagcagcagcaggacaacctgagccagcagctgggcaacagcaacaacctgagcatggaggaggagttcctgaagagccagatcagcagcgtgctgaagagacaggagcagatggccatcaagctgtgccaggagctgatcatccacaccagcgaccacagatgcaacccctgccccaagatgtggcagtggtaccagaacagctgctactacttcaccaccaacgaggagaagacctgggccaacagcagaaaggactgcatcgacaagaacagcaccctggtgaagatcgacagcctggaggagaaggacttcctgatgagccagcccctgctgatgttcagcttcttctggctgggcctgagctgggacagcagcggcagaagctggttctgggaggacggcagcgtgcccagccccagcctgttcagcaccaaggagctggaccagatcaacggcagcaagggctgcgcctacttccagaagggcaacatctacatcagcagatgcagcgccgagatcttctggatctgcgagaagaccgccgcccccgtgaagaccgaggacctggactag

SEQ ID NO: 17685 - DNA, 699 bp, Artificial Sequence
  Description of Artificial Sequence: Synthetic coding sequence
atgagcgaggaggtgacctacgccaccctgaccttccaggacagcgccggcgccagaaacaacagagacggcaacaacctgagaaagagaggccaccccgcccccagccccatctggagacacgccgccctgggcctggtgaccctgtgcctgatgctgctgatcggcctggtgaccctgggcatgatgttcctgcagatcagcaacgacatcaacagcgacagcgagaagctgagccagctgcagaagaccatccagcagcagcaggacaacctgagccagcagctgggcaacagcaacaacctgagcatggaggaggagttcctgaagagccagatcagcagcgtgctgaagagacaggagcagatggccatcaagctgtgccaggagctgatcatccacaccagcgaccacagatgcaacccctgccccaagatgtggcagtggtaccagaacagctgctactacttcaccaccaacgaggagaagacctgggccaacagcagaaaggactgcatcgacaagaacagcaccctggtgaagatcgacagcctggaggagaaggacttcctgatgagccagcccctgctgatgttcagcttcttctggctgggcctgagctgggacagcagcggcagaagctggttctgggaggacggcagcgtgcccagccccagcctgtacgtgagcaactactag

SEQ ID NO: 17686 - DNA, 1473 bp, Artificial Sequence
  Description of Artificial Sequence: Synthetic coding sequence
atgagacccgccttcgccctgtgcctgctgtggcaggccctgtggcccggccccggcggcggcgagcaccccaccgccgacagagccggctgcagcgccagcggcgcctgctacagcctgcaccacgccaccatgaagagacaggccgccgaggaggcctgcatcctgagaggcggcgccctgagcaccgtgagagccggcgccgagctgagagccgtgctggccctgctgagagccggccccggccccggcggcggcagcaaggacctgctgttctgggtggccctggagagaagaagaagccactgcaccctggagaacgagcccctgagaggcttcagctggctgagcagcgaccccggcggcctggagagcgacaccctgcagtgggtggaggagccccagagaagctgcaccgccagaagatgcgccgtgctgcaggccaccggcggcgtggagcccgccggctggaaggagatgagatgccacctgagagccaacggctacctgtgcaagtaccagttcgaggtgctgtgccccgcccccagacccggcgccgccagcaacctgagctacagagcccccttccagctgcacagcgccgccctggacttcagcccccccggcaccgaggtgagcgccctgtgcagaggccagctgcccatcagcgtgacctgcatcgccgacgagatcggcgccagatgggacaagctgagcggcgacgtgctgtgcccctgccccggcagatacctgagagccggcaagtgcgccgagctgcccaactgcctggacgacctgggcggcttcgcctgcgagtgcgccaccggcttcgagctgggcaaggacggcagaagctgcgtgaccagcggcgagggccagcccaccctgggcggcaccggcgtgcccaccagaagaccccccgccaccgccaccagccccgtgccccagagaacctggcccatcagagtggacgagaagctgggcgagacccccctggtgcccgagcaggacaacagcgtgaccagcatccccgagatccccagatggggcagccagagcaccatgagcaccctgcagatgagcctgcaggccgagagcaaggccaccatcacccccagcggcagcgtgatcagcaagttcaacagcaccaccagcagcgccaccccccaggccttcgacagcagcagcgccgtggtgttcatcttcgtgagcaccgccgtggtggtgctggtgatcctgaccatgaccgtgctgggcctggtgaagctgtgcttccacgagagccccagcagccagcccagaaaggagagcatgggcccccccggcctggagagcgaccccgagcccgccgccctgggcagcagcagcgcccactgcaccaacaacggcgtgaaggtgggcgactgcgacctgagagacagagccgagggcgccctgctggccgagagccccctgggcagcagcgacgcctag

SEQ ID NO: 17687 - DNA, 633 bp, Artificial Sequence
  Description of Artificial Sequence: Synthetic coding sequence
ggcaccaacagcagagccatgtgctgcgtgccccccggcagatacctgagagccggcaagtgcgccgagctgcccaactgcctggacgacctgggcggcttcgcctgcgagtgcgccaccggcttcgagctgggcaaggacggcagaagctgcgtgaccagcggcgagggccagcccaccctgggcggcaccggcgtgcccaccagaagaccccccgccaccgccaccagccccgtgccccagagaacctggcccatcagagtggacgagaagctgggcgagacccccctggtgcccgagcaggacaacagcgtgaccagcatccccgagatccccagatggggcagccagagcaccatgagcaccctgcagatgagcctgcaggccgagagcaaggccaccatcacccccagcggcagcgtgatcagcaagttcaacagcaccaccagcagcgccaccccccaggccttcgacagcagcagcgccgtggtgttcatcttcgtgagcaccgccgtggtggtgctggtgatcctgaccatgaccgtgctgggcctggtgaagctgtgcttccacgagagccccagcagccagcccagaaaggagagcatgggcccccccggcctggagagctag

SEQ ID NO: 17688 - DNA, 870 bp, Artificial Sequence
  Description of Artificial Sequence: Synthetic coding sequence
atgcacaacctgtacagcatcaccggctaccccgacccccccggcaccatggaggaggaggaggaggacgacgactacgagaacagcacccccccctacaaggacctgccccccaagcccggcaccatggaggaggaggaggaggacgacgactacgagaacagcacccccccctacaaggacctgccccccaagcccgccctgaccctgagcttcagcagccccggcagcagcgccccccccagaccccccagagccgccaaggagaccgagaagccccccctgccctgcaagcccagaaacatgaccggcctggacctggccgccgtgacctgcccccccccccagctggccgtgaacctggagcccagccccctgcagcccagcctggccgccacccccgtgccctggctgaaccagagaagcggcggccccggctgctgccagaagagatggatggtgtacctgtgcctgctggtggtgaccagcctgttcctgggctgcctgggcctgaccgtgaccctgatcaagtaccaggagctgatggaggagctgagaatgctgagcttccagcagatgacctggagaaccaacatgaccggcatggccggcctggccggcctgaagcacgacatcgccagagtgagagccgacaccaaccagagcctggtggagctgtggggcctgctggactgcagaagaatcacctgccccgagggctggctgcccttcgagggcaagtgctactacttcagccccagcaccaagagctgggacgaggccagaatgttctgccaggagaactacagccacctggtgatcatcaacagcttcgccgagcacctgctgggcgccagaggcacccagtag

SEQ ID NO: 17689 - DNA, 1137 bp, Artificial Sequence
  Description of Artificial Sequence: Synthetic coding sequence
atgcacaacctgtacagcatcaccggctaccccgacccccccggcaccatggaggaggaggaggaggacgacgactacgagaacagcacccccccctacaaggacctgccccccaagcccggcaccatggaggaggaggaggaggacgacgactacgagaacagcacccccccctacaaggacctgccccccaagcccggcaccatggaggaggaggaggaggacgacgactacgagaacagcacccccccctacaaggacctgccccccaagcccggcagcagcgccccccccagaccccccagagccgccaaggagaccgagaagccccccctgccctgcaagcccagaaacatgaccggcctggacctggccgccgtgacctgcccccccccccagctggccgtgaacctggagcccagccccctgcagcccagcctggccgccacccccgtgccctggctgaaccagagaagcggcggccccggctgctgccagaagagatggatggtgtacctgtgcctgctggtggtgaccagcctgttcctgggctgcctgggcctgaccgtgaccctgatcaagtaccaggagctgatggaggagctgagaatgctgagcttccagcagatgacctggagaaccaacatgaccggcatggccggcctggccggcctgaagcacgacatcgccagagtgagagccgacaccaaccagagcctggtggagctgtggggcctgctggactgcagaagaatcacctgccccgagggctggctgcccttcgagggcaagtgctactacttcagccccagcaccaagagctgggacgaggccagaatgttctgccaggagaactacagccacctggtgatcatcaacagcttcgccgagcacaacttcgtggccaaggcccacggcagccccagagtgtactggctgggcctgaacgacagagcccaggagggcgactggagatggctggacggcagccccgtgaccctgagcttctgggagcccgaggagcccaacaacatccacgacgaggactgcgccaccatgaacaagggcggcacctggaacgacctgagctgctacaagaccacctactggatctgcgagagaaagtgcagctgctag

SEQ ID NO: 17690 - DNA, 921 bp, Artificial Sequence
  Description of Artificial Sequence: Synthetic coding sequence
atgcacaacctgtacagcatcaccggctaccccgacccccccggcaccatggaggaggaggaggaggacgacgactacgagaacagcacccccccctacaaggacctgccccccaagcccggcaccatggaggaggaggaggaggacgacgactacgagaacagcacccccccctacaaggacctgccccccaagcccggcaccatggaggaggaggaggaggacgacgactacgagaacagcacccccccctacaaggacctgccccccaagcccggcagcagcgccccccccagaccccccagagccgccaaggagaccgagaagccccccctgccctgcaagcccagaaacatgaccggcctggacctggccgccgtgacctgcccccccccccagctggccgtgaacctggagcccagccccctgcagcccagcctggccgccacccccgtgccctggctgaaccagagaagcggcggccccggctgctgccagaagagatggatggtgtacctgtgcctgctggtggtgaccagcctgttcctgggctgcctgggcctgaccgtgaccctgatcaagtaccaggagctgatggaggagctgagaatgctgagcttccagcagatgacctggagaaccaacatgaccggcatggccggcctggccggcctgaagcacgacatcgccagagtgagagccgacaccaaccagagcctggtggagctgtggggcctgctggactgcagaagaatcacctgccccgagggctggctgcccttcgagggcaagtgctactacttcagccccagcaccaagagctgggacgaggccagaatgttctgccaggagaactacagccacctggtgatcatcaacagcttcgccgagcacctgctgggcgccagaggcacccagtag

SEQ ID NO: 17691 - DNA, 1770 bp, Artificial Sequence
  Description of Artificial Sequence: Synthetic coding sequence
atggacggcgaggccgtgagattctgcaccgacaaccagtgcgtgagcctgcacccccaggaggtggacagcgtggccatggcccccgccgcccccaagatccccagactggtgcaggccacccccgccttcatggccgtgaccctggtgttcagcctggtgaccctgttcgtggtggtgcagcagcagaccagacccgtgcccaagcccgtgcaggccgtgatcctgggcgacaacatcaccggccacctgcccttcgagcccaacaaccaccaccacttcggcagagaggccgagatgagagagctgatccagaccttcaagggccacatggagaacagcagcgcctgggtggtggagatccagatgctgaagtgcagagtggacaacgtgaacagccagctgcaggtgctgggcgaccacctgggcaacaccaacgccgacatccagatggtgaagggcgtgctgaaggacgccaccaccctgagcctgcagacccagatgctgagaagcagcctggagggcaccaacgccgagatccagagactgaaggaggacctggagaaggccgacgccctgaccttccagaccctgaacttcctgaagagcagcctggagaacaccagcatcgagctgcacgtgctgagcagaggcctggagaacgccaacagcgagatccagatgctgaacgccagcctggagaccgccaacacccaggcccagctggccaacagcagcctgaagaacgccaacgccgagatctacgtgctgagaggccacctggacagcgtgaacgacctgagaacccagaaccaggtgctgagaaacagcctggagggcgccaacgccgagatccagggcctgaaggagaacctgcagaacaccaacgccctgaacagccagacccaggccttcatcaagagcagcttcgacaacaccagcgccgagatccagttcctgagaggccacctggagagagccggcgacgagatccacgtgctgaagagagacctgaagatggtgaccgcccagacccagaaggccaacggcagactggaccagaccgacacccagatccaggtgttcaagagcgagatggagaacgtgaacaccctgaacgcccagatccaggtgctgaacggccacatgaagaacgccagcagagagatccagaccctgaagcagggcatgaagaacgccagcgccctgaccagccagacccagatgctggacagcaacctgcagaaggccagcgccgagatccagagactgagaggcgacctggagaacaccaaggccctgaccatggagatccagcaggagcagagcagactgaagaccctgcacgtggtgatcaccagccaggagcagctgcagagaacccagagccagctgctgcagatggtgctgcagggctggaagttcaacggcggcagcctgtactacttcagcagcgtgaagaagagctggcacgaggccgagcagttctgcgtgagccagggcgcccacctggccagcgtggccagcaaggaggagcaggccttcctggtggagttcaccagcaaggtgtactactggatcggcctgaccgacagaggcaccgagggcagctggagatggaccgacggcacccccttcaacgccgcccagaacaaggcccccggcagcaagggcagctgccccctgagaaagtacatcatcgtgaacagcggcatgggcgcctgcagcttcatcgacacccccccctgcccctggatcctgagcaactag

SEQ ID NO: 17692 - DNA, 882 bp, Artificial Sequence
  Description of Artificial Sequence: Synthetic coding sequence
atggacaccaccagatacagcaagtggggcggcagcagcgaggaggtgcccggcggcccctggggcagatgggtgcactggagcagaagacccctgttcctggccctggccgtgctggtgaccaccgtgctgtgggccgtgatcctgagcatcctgctgagcaaggccagcaccgagagagccgccctgctggacggccacgacctgctgagaaccaacgccagcaagcagaccgccgccctgggcgccctgaaggaggaggtgggcgactgccacagctgctgcagcggcacccaggcccagctgcagaccaccagagccgagctgggcgaggcccaggccaagctgatggagcaggagagcgccctgagagagctgagagagagagtgacccagggcctggccgaggccggcagaggcagagaggacgtgagaaccgagctgttcagagccctggaggccgtgagactgcagaacaacagctgcgagccctgccccaccagctggctgagcttcgagggcagctgctacttcttcagcgtgcccaagaccacctgggccgccgcccaggaccactgcgccgacgccagcgcccacctggtgatcgtgggcggcctggacgagcagggcttcctgaccagaaacaccagaggcagaggctactggctgggcctgagagccgtgagacacctgggcaaggtgcagggctaccagtgggtggacggcgtgagcctgagcttcagccactggaaccagggcgagcccaacgacgcctggggcagagagaactgcgtgatgatgctgcacaccggcctgtggaacgacgccccctgcgacagcgagaaggacggctggatctgcgagaagagacacaactgctag

SEQ ID NO: 17693 - DNA, 759 bp, Artificial Sequence
  Description of Artificial Sequence: Synthetic coding sequence
atggagcaggagagcgccctgagagagctgagagagagagtgacccagggcctggccgaggccggcagaggcagagaggacgtgagaaccgagctgttcagagccctggaggccgtgagactgcagaacaacagctgcgagccctgccccaccagctggctgagcttcgagggcagctgctacttcttcagcgtgcccaagaccacctgggccgccgcccaggaccactgcgccgacgccagcgcccacctggtgatcgtgggcggcctggacgagcagggcttcctgaccagaaacaccagaggcagaggctactggctgggcctgagagccgtgagacacctgggcaaggtgcagggctaccagtgggtggacggcgtgagcctgagcttcagccactggaaccagggcgagcccaacgacgcctggggcagagagaactgcgtgatgatgctgcacaccggcctgtggaacgacgccccctgcgacagcgagaaggacggctggatctgcgagaaggcccagctgctgaccccccccagcgccctggagcccagacccctgcagcacgtggtgagctggggcctgctgaccagcctggcccccggcgccgactgccagagagtgttcagcagcagcagcaccgccgccgagagccagaagcacctggcccagcacagccccgtgcagcccagcgcctgggccctgggccccccctgcagaccccaccccaacagcacccacgccgaccccacctag

SEQ ID NO: 17694 - DNA, 726 bp, Artificial Sequence
  Description of Artificial Sequence: Synthetic coding sequence
atgcacgaggaggagatctacaccagcctgcagtgggacagccccgcccccgacacctaccagaagtgcctgagcagcaacaagtgcagcggcgcctgctgcctggtgatggtgatcagctgcgtgttctgcatgggcctgctgaccgccagcatcttcctgggcgtgaagctgctgcaggtgagcaccatcgccatgcagcagcaggagaagctgatccagcaggagagagccctgctgaacttcaccgagtggaagagaagctgcgccctgcagatgaagtactgccaggccttcatgcagaacagcctgagcagcgcccacaacagcagcccctgccccaacaactggatccagaacagagagagctgctactacgtgagcgagatctggagcatctggcacaccagccaggagaactgcctgaaggagggcagcaccctgctgcagatcgagagcaaggaggagatggacttcatcaccggcagcctgagaaagatcaagggcagctacgactactgggtgggcctgagccaggacggccacagcggcagatggctgtggcaggacggcagcagccccagccccggcctgctgcccgccgagagaagccagagcgccaaccaggtgtgcggctacgtgaagagcaacagcctgctgagcagcaactgcagcacctggaagtacttcatctgcgagaagtacgccctgagaagcagcgtgtag

SEQ ID NO: 17695 - DNA, 504 bp, Artificial Sequence
  Description of Artificial Sequence: Synthetic coding sequence
atggtgagcaacttcttccacgtgatccaggtgttcgagaagagcgccaccctgatcagcaagaccgagcacatcggcttcgtgatctacagctggagaaagagcaccacccacctgggcagcagaagaaagttcgccatcagcatctacctgagcgaggtgagcctgcagaagtacgactgccccttcagcggcaccagcttcgtggtgttcagcctgttcctgatctgcgccatggccggcgacgtggtgtacgccgacatcaagaccgtgagaaccagccccctggagctggccttccccctgcagagaagcgtgagcttcaacttcagcaccgtgcacaagagctgccccgccaaggactggaaggtgcacaagggcaagtgctactggatcgccgagaccaagaagagctggaacaagagccagaacgactgcgccatcaacaacagctacctgatggtgatccaggacatcaccgccatggtgagattcaacatctag

SEQ ID NO: 17696 - DNA, 108 bp, Artificial Sequence
  Description of Artificial Sequence: Synthetic coding sequence
caggacatcaccgccatgctgatcaccttcctgctgtacctgcagatggccttcctgcagtgcgtgtacatcagcgacgtgagcgtgtaccccaacttcttcctgtag

SEQ ID NO: 17697 - DNA, 726 bp, Artificial Sequence
  Description of Artificial Sequence: Synthetic coding sequence
atgggccacaacagcaccgtggagatcatctacatcaccgaggacgacgtgatccagagccagaacgccctgggcaagtacaacaccagcatggccctgttcgagagcaacagcttcgagaagaccatcctggagagcccctactacgtggacctgaaccagaccctgttcgtgcaggtgagcctgcacaccagcgaccccaacctggtggtgttcctggacacctgcagagccagccccaccagcgacttcgccagccccacctacgacctgatcaagagcggctgcagcagagacgagacctgcaaggtgtaccccctgttcggccactacggcagattccagttcaacgccttcaagttcctgagaagcatgagcagcgtgtacctgcagtgcaaggtgctgatctgcgacagcagcgaccaccagagcagatgcaaccagggctgcgtgagcagaagcaagagagacatcagcagctacaagtggaagaccgacagcatcatcggccccatcagactgaagagagacagaagcgccagcggcaacagcggcttccagcacgagacccacgccgaggagacccccaaccagcccttcaacagcgtgcacctgttcagcttcatggtgctggccctgaacgtggtgaccgtggccaccatcaccgtgagacacttcgtgaaccagagagccgactacaagtaccagaagctgcagaactactag

SEQ ID NO: 17698 - DNA, 981 bp, Artificial Sequence
  Description of Artificial Sequence: Synthetic coding sequence
atgagagtgatcatcagcaagagctacctggaggccttcaacagcaacggcaacaacctgcagctgaaggaccccacctgcagacccaagctgagcaacgtggtggagttcagcgtgcccctgaacggctgcggcaccatcagaaaggtggaggaccagagcatcacctacaccaacatcatcaccttcagcgccagcagcaccagcgaggtgatcaccagacagaagcagctgcagatcatcgtgaagtgcgagatgggccacaacagcaccgtggagatcatctacatcaccgaggacgacgtgatccagagccagaacgccctgggcaagtacaacaccagcatggccctgttcgagagcaacagcttcgagaagaccatcctggagagcccctactacgtggacctgaaccagaccctgttcgtgcaggtgagcctgcacaccagcgaccccaacctggtggtgttcctggacacctgcagagccagccccaccagcgacttcgccagccccacctacgacctgatcaagagcggctgcagcagagacgagacctgcaaggtgtaccccctgttcggccactacggcagattccagttcaacgccttcaagttcctgagaagcatgagcagcgtgtacctgcagtgcaaggtgctgatctgcgacagcagcgaccaccagagcagatgcaaccagggctgcgtgagcagaagcaagagagacatcagcagctacaagtggaagaccgacagcatcatcggccccatcagactgaagagagacagaagcgccagcggcaacagcggcttccagcacgagacccacgccgaggagacccccaaccagcccttcaacagcgtgcacctgttcagcttcatggtgctggccctgaacgtggtgaccgtggccaccatcaccgtgagacacttcgtgaaccagagagccgactacaagtaccagaagctgcagaactactag

SEQ ID NO: 17699 - DNA, 981 bp, Artificial Sequence; identical to SEQ ID NO: 17698
  Description of Artificial Sequence: Synthetic coding sequence

SEQ ID NO: 17700 - DNA, 981 bp, Artificial Sequence; identical to SEQ ID NO: 17698
  Description of Artificial Sequence: Synthetic coding sequence

SEQ ID NO: 17701 - DNA, 1824 bp, Artificial Sequence
  Description of Artificial Sequence: Synthetic coding sequence
atggagctggtgagaagactgatgcccctgaccctgctgatcctgagctgcctggccgagctgaccatggccgaggccgagggcaacgccagctgcaccgtgagcctgggcggcgccaacatggccgagacccacaaggccatgatcctgcagctgaaccccagcgagaactgcacctggaccatcgagagacccgagaacaagagcatcagaatcatcttcagctacgtgcagctggaccccgacggcagctgcgagagcgagaacatcaaggtgttcgacggcaccagcagcaacggccccctgctgggccaggtgtgcagcaagaacgactacgtgcccgtgttcgagagcagcagcagcaccctgaccttccagatcgtgaccgacagcgccagaatccagagaaccgtgttcgtgttctactacttcttcagccccaacatcagcatccccaactgcggcggctacctggacaccctggagggcagcttcaccagccccaactaccccaagccccaccccgagctggcctactgcgtgtggcacatccaggtggagaaggactacaagatcaagctgaacttcaaggagatcttcctggagatcgacaagcagtgcaagttcgacttcctggccatctacgacggccccagcaccaacagcggcctgatcggccaggtgtgcggcagagtgacccccaccttcgagagcagcagcaacagcctgaccgtggtgctgagcaccgactacgccaacagctacagaggcttcagcgccagctacaccagcatctacgccgagaacatcaacaccaccagcctgacctgcagcagcgacagaatgagagtgatcatcagcaagagctacctggaggccttcaacagcaacggcaacaacctgcagctgaaggaccccacctgcagacccaagctgagcaacgtggtggagttcagcgtgcccctgaacggctgcggcaccatcagaaaggtggaggaccagagcatcacctacaccaacatcatcaccttcagcgccagcagcaccagcgaggtgatcaccagacagaagcagctgcagatcatcgtgaagtgcgagatgggccacaacagcaccgtggagatcatctacatcaccgaggacgacgtgatccagagccagaacgccctgggcaagtacaacaccagcatggccctgttcgagagcaacagcttcgagaagaccatcctggagagcccctactacgtggacctgaaccagaccctgttcgtgcaggtgagcctgcacaccagcgaccccaacctggtggtgttcctggacacctgcagagccagccccaccagcgacttcgccagccccacctacgacctgatcaagagcggctgcagcagagacgagacctgcaaggtgtaccccctgttcggccactacggcagattccagttcaacgccttcaagttcctgagaagcatgagcagcgtgtacctgcagtgcaaggtgctgatctgcgacagcagcgaccaccagagcagatgcaaccagggctgcgtgagcagaagcaagagagacatcagcagctacaagtggaagaccgacagcatcatcggccccatcagactgaagagagacagaagcgccagcggcaacagcggcttccagcacgagacccacgccgaggagacccccaaccagcccttcaacagcgtgcacctgttcagcttcatggtgctggccctgaacgtggtgaccgtggccaccatcaccgtgagacacttcgtgaaccagagagccgactacaagtaccagaagctgcagaactactag

SEQ ID NO: 17702 - DNA, 2238 bp, Artificial Sequence
  Description of Artificial Sequence: Synthetic coding sequence
atgagacccgacagccacccctacggcttcccctgggagctggtgatcagagccgccgtggccggcttcttcgccgtgctgttcctgtggagaagcttcagaagcgtgaccagcagactgtacgtgagaagagagaagaagttcgccgtggccctgagcggcctgatcgaggagaagtgcaagctgctggagaagttcagcctggtgcagaaggagtacgagggctacgaggtggagagcagcctgaagaacgccagcttcgagaaggaggccaccgaggcccagagcctggaggccacctgcgagaagctgaacagattcaacagcgagctggtgcacgagatcctgtgcctggagaaggagctgaaggaggagaagagcaagcacagcgagcagaacgagctgatggccgacatcagcaagagaatccagagcctggaggacgagagcaagagcctgaagagccaggtggccgaggccaagatgaccttcaagagattccaggccaacgaggagagactggagatcgagatccaggacgcctggaaggagaacagcgagctgcaggagagccagaagcagctgctgcaggaggccgaggtgtggaaggagcaggtgagcgagctgatcaagcagaagagaaccttcgaggacagcaaggtgcacgccgagcaggtgctgaacgacaaggagaaccacatcaagaccctgaccgagagactgctgaagatgaaggacggcgtggccatgctggaggaggacgtgaccgacgacgacaacctggagctggagatgaacagcgagagcgaggacggcgcctacctggacaacccccccaagggcgccctgaagaagctgatccacgccgccaagctgaacgccagcctgaagaccctggagggcgagagaaaccagatctacatccagctgagcgaggtggacaagaccaaggaggagctgaccgagcacatcaagaacctgcagaccgagcaggccagcctgcagagcgagaacacccacttcgagagcgagaaccagaagctgcagcagaagctgaaggtgatgaccgagctgtaccaggagaacgagatgaagctgtacagaaagctgatcgtggaggagaagtgcagactggagaaggaggagaagctgagcaaggtggacgagatgatcagccacgccaccgaggagctggagacctacagaaagagagccaaggacctgaaggagttcgagaagaccatccacttctaccagaagaagatcatcctgcacgagaagaaggcccacgacaactggagcgccgcctggaccgccgagagaaacctgaacgacctgagaaaggagaacgcccacaacagacagaagctgaccgagatcgagttcaagatcaagctgctggagaaggacccctacggcctggacgtgcccaacaccgccttcggcagacagcacagcccctacggccccagccccctgggctggcccagcagcgagaccagagccagcctgtacccccccaccctgctggagggccccctgagactgagccccctgctgcccagaggcggcggcagaggcagcagaggccccggcaacccccccgaccaccagatcaccaaggagagaggcgagagcagctgcgacagactgaccgacccccacagagcccccagcgacgccggccccctggcccccccctgggagcaggactacagaatgatgttccccccccccggccagagctaccccgacagcgccctgcccccccagagacaggacagattctacagcaactgcgccagactgagcggccccgccgagctgagaagcttcaacatgcccagcctggacaagatggacggcagcatgcccagcgagatggagagcagcagaaacgacaccaaggacaacctgggcaacctgaaggtgcccgacagcagcctgcccgccgagaacgaggccaccggccccggcttcgtgcccccccccctggcccccatcagaggcctgctgttccccgtggacaccagaggccccttcatcagaagaggcccccccttccccccccccccccccggcaccgtgttcggcgccagccccgactacttcagccccagagacgtgcccggcccccccagagcccccttcgccatgagaaacgtgtacctgcccagaggcttcctgccctacagaccccccagacccgccttcttcccccccgcccccaccttctag

SEQ ID NO: 17703 - DNA, 225 bp, Artificial Sequence
  Description of Artificial Sequence: Synthetic coding sequence
atgttcgtgatcatcagcctgcacaactgcgtggtgatcagcttcgtgctgttcctgttcggcggcaacaacttcatccagaacttctacctgccccagaactacatcgaccagttcctgctgaccagcttccccaccttcaccagcgtgggcgtgctgatcgtgctggtgctgtgcagcgccttcctgctgctgtggcagggcgagggcgtgaacctgagatag

SEQ ID NO: 17704 - DNA, 4518 bp, Artificial Sequence
  Description of Artificial Sequence: Synthetic coding sequence
atgctgtgcgtggccggcgccagactgaagagagagctggacgccaccgccaccgtgctggccaacagacaggacgagagcgagcagagcagaaagagactgatcgagcagagcagagagttcaagaagaacacccccgaggacctgagaaagcaggtggcccccctgctgaagagcttccagggcgagatcgacgccctgagcaagagaagcaaggaggccgaggccgccttcctgaacgtgtacaagagactgatcgacgtgcccgaccccgtgcccgccctggacctgggccagcagctgcagctgaaggtgcagagactgcacgacatcgagaccgagaaccagaagctgagagagaccctggaggagtacaacaaggagttcgccgaggtgaagaaccaggaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggagcaggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcagcgccagaagaaagggcaaggaccagcccgagagcagaagacccggcagcctgcccgcccccccccccagccagctgcccagaaaccccggcgagcaggccagcaacaccaacggcacccaccagttcagccccgccggcctgagccaggacttcttcagcagcagcctggccagccccagcctgcccctggccagcaccggcaagttcgccctgaacagcctgctgcagagacagctgatgcagagcttctacagcaaggccatgcaggaggccggcagcaccagcatgatcttcagcaccggcccctacagcaccaacagcatcagcagccagagccccctgcagcagagccccgacgtgaacggcatggcccccagccccagccagagcgagagcgccggcagcgtgagcgagggcgaggagatggacaccgccgagatcgccagacaggtgaaggagcagctgatcaagcacaacatcggccagagaatcttcggccactacgtgctgggcctgagccagggcagcgtgagcgagatcctggccagacccaagccctggaacaagctgaccgtgagaggcaaggagcccttccacaagatgaagcagttcctgagcgacgagcagaacatcctggccctgagaagcatccagggcagacagagagagaaccccggccagagcctgaacagactgttccaggaggtgcccaagagaagaaacggcagcgagggcaacatcaccaccagaatcagagccagcgagaccggcagcgacgaggccatcaagagcatcctggagcaggccaagagagagctgcaggtgcagaagaccgccgagcccgcccagcccagcagcgccagcggcagcggcaacagcgacgacgccatcagaagcatcctgcagcaggccagaagagagatggaggcccagcaggccgccctggaccccgccctgaagcaggcccccctgagccagagcgacatcaccatcctgacccccaagctgctgagcaccagccccatgcccaccgtgagcagctacccccccctggccatcagcctgaagaagcccagcgccgcccccgaggccggcgccagcgccctgcccaacccccccgccctgaagaaggaggcccaggacgcccccggcctggacccccagggcgccgccgactgcgcccagggcgtgctgagacaggtgaagaacgaggtgggcagaagcggcgcctggaaggaccactggtggagcgccgtgcagcccgagagaagaaacgccgccagcagcgaggaggccaaggccgaggagaccggcggcggcaaggagaagggcagcggcggcagcggcggcggcagccagcccagagccgagagaagccagctgcagggccccagcagcagcgagtactggaaggagtggcccagcgccgagagcccctacagccagagcagcgagctgagcctgaccggcgccagcagaagcgagaccccccagaacagccccctgcccagcagccccatcgtgcccatgagcaagcccaccaagcccagcgtgccccccctgacccccgagcagtacgaggtgtacatgtaccaggaggtggacaccatcgagctgaccagacaggtgaaggagaagctggccaagaacggcatctgccagagaatcttcggcgagaaggtgctgggcctgagccagggcagcgtgagcgacatgctgagcagacccaagccctggagcaagctgacccagaagggcagagagcccttcatcagaatgcagctgtggctgaacggcgagctgggccagggcgtgctgcccgtgcagggccagcagcagggccccgtgctgcacagcgtgaccagcctgcaggaccccctgcagcagggctgcgtgagcagcgagagcacccccaagaccagcgccagctgcagccccgcccccgagagccccatgagcagcagcgagagcgtgaagagcctgaccgagctggtgcagcagccctgcccccccatcgaggccagcaaggacagcaagccccccgagcccagcgacccccccgccagcgacagccagcccaccacccccctgcccctgagcggccacagcgccctgagcatccaggagctggtggccatgagccccgagctggacacctacggcatcaccaagagagtgaaggaggtgctgaccgacaacaacctgggccagagactgttcggcgagaccatcctgggcctgacccagggcagcgtgagcgacctgctggccagacccaagccctggcacaagctgagcctgaagggcagagagcccttcgtgagaatgcagctgtggctgaacgaccccaacaacgtggagaagctgatggacatgaagagaatggagaagaaggcctacatgaagagaagacacagcagcgtgagcgacagccagccctgcgagccccccagcgtgggcaccgagtacagccagggcgccagcccccagccccagcaccagctgaagaagcccagagtggtgctggcccccgaggagaaggaggccctgaagagagcctaccagcagaagccctaccccagccccaagaccatcgaggacctggccacccagctgaacctgaagaccagcaccgtgatcaactggttccacaactacagaagcagaatcagaagagagctgttcatcgaggagatccaggccggcagccagggccaggccggcgccagcgacagccccagcgccagaagcggcagagccgcccccagcagcgagggcgacagctgcgacggcgtggaggccaccgagggccccggcagcgccgacaccgaggagcccaagagccagggcgaggccgagagagaggaggtgcccagacccgccgagcagaccgagcccccccccagcggcacccccggccccgacgacgccagagacgacgaccacgagggcggccccgtggagggccccggccccctgcccagccccgccagcgccaccgccaccgccgcccccgccgcccccgaggacgccgccaccagcgccgccgccgcccccggcgagggccccgccgcccccagcagcgcccccccccccagcaacagcagcagcagcagcgcccccagaagacccagcagcctgcagagcctgttcggcctgcccgaggccgccggcgccagagacagcagagacaaccccctgagaaagaagaaggccgccaacctgaacagcatcatccacagactggagaaggccgccagcagagaggagcccatcgagtgggagttctag

SEQ ID NO: 17705 - DNA, 2037 bp, Artificial Sequence
  Description of Artificial Sequence: Synthetic coding sequence
atggccgccaacgtgggcagcatgttccagtactggaagagattcgacctgcagcagctgcagagagagctggacgccaccgccaccgtgctggccaacagacaggacgagagcgagcagagcagaaagagactgatcgagcagagcagagagttcaagaagaacacccccgaggacctgagaaagcaggtggcccccctgctgaagagcttccagggcgagatcgacgccctgagcaagagaagcaaggaggccgaggccgccttcctgaacgtgtacaagagactgatcgacgtgcccgaccccgtgcccgccctggacctgggccagcagctgcagctgaaggtgcagagactgcacgacatcgagaccgagaaccagaagctgagagagaccctggaggagtacaacaaggagttcgccgaggtgaagaaccaggaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggagcaggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcagatgcgccgagctgcaggtgagaatcaccgaggccgtggccaccgccaccgagcagagagagctgatcgccagactggagcaggacctgagcatcatccagagcatccagagacccgacgccgagggcgccgccgagcacagactggagaagatccccgagcccatcaaggaggccaccgccctgttctacggccccgccgcccccgccagcggcgccctgcccgagggccaggtggacagcctgctgagcatcatcagcagccagagagagagattcagagccagaaaccaggagctggaggccgagaacagactggcccagcacaccctgcaggccctgcagagcgagctggacagcctgagagccgacaacatcaagctgttcgagaagatcaagttcctgcagagctaccccggcagaggcagcggcagcgacgacaccgagctgagatacagcagccagtacgaggagagactggaccccttcagcagcttcagcaagagagagagacagagaaagtacctgagcctgagcccctgggacaaggccaccctgagcatgggcagactggtgctgagcaacaagatggccagaaccatcggcttcttctacaccctgttcctgcactgcctggtgttcctggtgctgtacaagctggcctggagcgagagcatggagagagactgcgccaccttctgcgccaagaagttcgccgaccacctgcacaagttccacgagaacgacaacggcgccgccgccggcgacctgtggcagtag

SEQ ID NO: 17706 - DNA, 4551 bp, Artificial Sequence
  Description of Artificial Sequence: Synthetic coding sequence
atggccgccaacgtgggcagcatgttccagtactggaagagattcgacctgcagcagctgcagagagagctggacgccaccgccaccgtgctggccaacagacaggacgagagcgagcagagcagaaagagactgatcgagcagagcagagagttcaagaagaacacccccgaggacctgagaaagcaggtggcccccctgctgaagagcttccagggcgagatcgacgccctgagcaagagaagcaaggaggccgaggccgccttcctgaacgtgtacaagagactgatcgacgtgcccgaccccgtgcccgccctggacctgggccagcagctgcagctgaaggtgcagagactgcacgacatcgagaccgagaaccagaagctgagagagaccctggaggagtacaacaaggagttcgccgaggtgaagaaccaggaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggagcaggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcagcgccagaagaaagggcaaggaccagcccgagagcagaagacccggcagcctgcccgcccccccccccagccagctgcccagaaaccccggcgagcaggccagcaacaccaacggcacccaccagttcagccccgccggcctgagccaggacttcttcagcagcagcctggccagccccagcctgcccctggccagcaccggcaagttcgccctgaacagcctgctgcagagacagctgatgcagagcttctacagcaaggccatgcaggaggccggcagcaccagcatgatcttcagcaccggcccctacagcaccaacagcatcagcagccagagccccctgcagcagagccccgacgtgaacggcatggcccccagccccagccagagcgagagcgccggcagcgtgagcgagggcgaggagatggacaccgccgagatcgccagacaggtgaaggagcagctgatcaagcacaacatcggccagagaatcttcggccactacgtgctgggcctgagccagggcagcgtgagcgagatcctggccagacccaagccctggaacaagctgaccgtgagaggcaaggagcccttccacaagatgaagcagttcctgagcgacgagcagaacatcctggccctgagaagcatccagggcagacagagagagaaccccggccagagcctgaacagactgttccaggaggtgcccaagagaagaaacggcagcgagggcaacatcaccaccagaatcagagccagcgagaccggcagcgacgaggccatcaagagcatcctggagcaggccaagagagagctgcaggtgcagaagaccgccgagcccgcccagcccagcagcgccagcggcagcggcaacagcgacgacgccatcagaagcatcctgcagcaggccagaagagagatggaggcccagcaggccgccctggaccccgccctgaagcaggcccccctgagccagagcgacatcaccatcctgacccccaagctgctgagcaccagccccatgcccaccgtgagcagctacccccccctggccatcagcctgaagaagcccagcgccgcccccgaggccggcgccagcgccctgcccaacccccccgccctgaagaaggaggcccaggacgcccccggcctggacccccagggcgccgccgactgcgcccagggcgtgctgagacaggtgaagaacgaggtgggcagaagcggcgcctggaaggaccactggtggagcgccgtgcagcccgagagaagaaacgccgccagcagcgaggaggccaaggccgaggagaccggcggcggcaaggagaagggcagcggcggcagcggcggcggcagccagcccagagccgagagaagccagctgcagggccccagcagcagcgagtactggaaggagtggcccagcgccgagagcccctacagccagagcagcgagctgagcctgaccggcgccagcagaagcgagaccccccagaacagccccctgcccagcagccccatcgtgcccatgagcaagcccaccaagcccagcgtgccccccctgacccccgagcagtacgaggtgtacatgtaccaggaggtggacaccatcgagctgaccagacaggtgaaggagaagctggccaagaacggcatctgccagagaatcttcggcgagaaggtgctgggcctgagccagggcagcgtgagcgacatgctgagcagacccaagccctggagcaagctgacccagaagggcagagagcccttcatcagaatgcagctgtggctgaacggcgagctgggccagggcgtgctgcccgtgcagggccagcagcagggccccgtgctgcacagcgtgaccagcctgcaggaccccctgcagcagggctgcgtgagcagcgagagcacccccaagaccagcgccagctgcagccccgcccccgagagccccatgagcagcagcgagagcgtgaagagcctgaccgagctggtgcagcagccctgcccccccatcgaggccagcaaggacagcaagccccccgagcccagcgacccccccgccagcgacagccagcccaccacccccctgcccctgagcggccacagcgccctgagcatccaggagctggtggccatgagccccgagctggacacctacggcatcaccaagagagtgaaggaggtgctgaccgacaacaacctgggccagagactgttcggcgagaccatcctgggcctgacccagggcagcgtgagcgacctgctggccagacccaagccctggcacaagctgagcctgaagggcagagagcccttcgtgagaatgcagctgtggctgaacgaccccaacaacgtggagaagctgatggacatgaagagaatggagaagaaggcctacatgaagagaagacacagcagcgtgagcgacagccagccctgcgagccccccagcgtgggcaccgagtacagccagggcgccagcccccagccccagcaccagctgaagaagcccagagtggtgctggcccccgaggagaaggaggccctgaagagagcctaccagcagaagccctaccccagccccaagaccatcgaggacctggccacccagctgaacctgaagaccagcaccgtgatcaactggttccacaactacagaagcagaatcagaagagagctgttcatcgaggagatccaggccggcagccagggccaggccggcgccagcgacagccccagcgccagaagcggcagagccgcccccagcagcgagggcgacagctgcgacggcgtggaggccaccgagggccccggcagcgccgacaccgaggagcccaagagccagggcgaggccgagagagaggaggtgcccagacccgccgagcagaccgagcccccccccagcggcacccccggccccgacgacgccagagacgacgaccacgagggcggccccgtggagggccccggccccctgcccagccccgccagcgccaccgccaccgccgcccccgccgcccccgaggacgccgccaccagcgccgccgccgcccccggcgagggccccgccgcccccagcagcgcccccccccccagcaacagcagcagcagcagcgcccccagaagacccagcagcctgcagagcctgttcggcctgcccgaggccgccggcgccagagacagcagagacaaccccctgagaaagaagaaggccgccaacctgaacagcatcatccacagactggagaaggccgccagcagagaggagcccatcgagtgggagttctag

SEQ ID NO: 17707 - DNA, 1920 bp, Artificial Sequence
  Description of Artificial Sequence: Synthetic coding sequence
atggccgccaacgtgggcagcatgttccagtactggaagagattcgacctgcagcagctgcaggacctgagaaagcaggtggcccccctgctgaagagcttccagggcgagatcgacgccctgagcaagagaagcaaggaggccgaggccgccttcctgaacgtgtacaagagactgatcgacgtgcccgaccccgtgcccgccctggacctgggccagcagctgcagctgaaggtgcagagactgcacgacatcgagaccgagaaccagaagctgagagagaccctggaggagtacaacaaggagttcgccgaggtgaagaaccaggaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcagatgcgccgagctgcaggtgagaatcaccgaggccgtggccaccgccaccgagcagagagagctgatcgccagactggagcaggacctgagcatcatccagagcatccagagacccgacgccgagggcgccgccgagcacagactggagaagatccccgagcccatcaaggaggccaccgccctgttctacggccccgccgcccccgccagcggcgccctgcccgagggccaggtggacagcctgctgagcatcatcagcagccagagagagagattcagagccagaaaccaggagctggaggccgagaacagactggcccagcacaccctgcaggccctgcagagcgagctggacagcctgagagccgacaacatcaagctgttcgagaagatcaagttcctgcagagctaccccggcagaggcagcggcagcgacgacaccgagctgagatacagcagccagtacgaggagagactggaccccttcagcagcttcagcaagagagagagacagagaaagtacctgagcctgagcccctgggacaaggccaccctgagcatgggcagactggtgctgagcaacaagatggccagaaccatcggcttcttctacaccctgttcctgcactgcctggtgttcctggtgctgtacaagctggcctggagcgagagcatggagagagactgcgccaccttctgcgccaagaagttcgccgaccacctgcacaagttccacgagaacgacaacggcgccgccgccggcgacctgtggcagtag

SEQ ID NO: 17708 - DNA, 1899 bp, Artificial Sequence
  Description of Artificial Sequence: Synthetic coding sequence
atggccgccaacgtgggcagcatgttccagtactggaagagattcgacctgcagcagctgcagagagagctggacgccaccgccaccgtgctggccaacagacaggacgagagcgagcagagcagaaagagactgatcgagcagagcagagagttcaagaagaacacccccgaggacctgagaaagcaggtggcccccctgctgaagagcttccagggcgagatcgacgccctgagcaagagaagcaaggaggccgaggccgccttcctgaacgtgtacaagagactgatcgacgtgcccgaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggagcaggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcagatgcgccgagctgcaggtgagaatcaccgaggccgtggccaccgccaccgagcagagagagctgatcgccagactggagcaggacctgagcatcatccagagcatccagagacccgacgccgagggcgccgccgagcacagactggagaagatccccgagcccatcaaggaggccaccgccctgttctacggccccgccgcccccgccagcggcgccctgcccgagggccaggtggacagcctgctgagcatcatcagcagccagagagagagattcagagccagaaaccaggagctggaggccgagaacagactggcccagcacaccctgcaggccctgcagagcgagctggacagcctgagagccgacaacatcaagctgttcgagaagatcaagttcctgcagagctaccccggcagaggcagcggcagcgacgacaccgagctgagatacagcagccagtacgaggagagactggaccccttcagcagcttcagcaagagagagagacagagaaagtacctgagcctgagcccctgggacaaggccaccctgagcatgggcagactggtgctgagcaacaagatggccagaaccatcggcttcttctacaccctgttcctgcactgcctggtgttcctggtgctgtacaagctggcctggagcgagagcatggagagagactgcgccaccttctgcgccaagaagttcgccgaccacctgcacaagttccacgagaacgacaacggcgccgccgccggcgacctgtggcagtag

SEQ ID NO: 17709 - DNA, 2031 bp, Artificial Sequence
  Description of Artificial Sequence: Synthetic coding sequence
atggccgccaacgtgggcagcatgttccagtactggaagagattcgacctgcagcagctgcagagagagctggacgccaccgccaccgtgctggccaacagacaggacgagagcgagcagagcagaaagagactgatcgagcagagcagagagttcaagaagaacacccccgaggacctgagaaagcaggtggcccccctgctgaagagcttccagggcgagatcgacgccctgagcaagagaagcaaggaggccgaggccgccttcctgaacgtgtacaagagactgatcgacgtgcccgaccccgtgcccgccctggacctgggccagcagctgcagctgaaggtgcagagactgcacgacatcgagaccgagaaccagaagctgagagagaccctggaggagtacaacaaggagttcgccgaggtgaagaaccaggaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcagatgcgccgagctgcaggtgagaatcaccgaggccgtggccaccgccaccgagcagagagagctgatcgccagactggagcaggacctgagcatcatccagagcatccagagacccgacgccgagggcgccgccgagcacagactggagaagatccccgagcccatcaaggaggccaccgccctgttctacggccccgccgcccccgccagcggcgccctgcccgagggccaggtggacagcctgctgagcatcatcagcagccagagagagagattcagagccagaaaccaggagctggaggccgagaacagactggcccagcacaccctgcaggccctgcagagcgagctggacagcctgagagccgacaacatcaagctgttcgagaagatcaagttcctgcagagctaccccggcagaggcagcggcagcgacgacaccgagctgagatacagcagccagtacgaggagagactggaccccttcagcagcttcagcaagagagagagacagagaaagtacctgagcctgagcccctgggacaaggccaccctgagcatgggcagactggtgctgagcaacaagatggccagaaccatcggcttcttctacaccctgttcctgcactgcctggtgttcctggtgctgtacaagctggcctggagcgagagcatggagagagactgcgccaccttctgcgccaagaagttcgccgaccacctgcacaagttccacgagaacgacaacggcgccgccgccggcgacctgtggcagtag

SEQ ID NO: 17710 - DNA, 4212 bp, Artificial Sequence
  Description of Artificial Sequence: Synthetic coding sequence
atgctgtgcgtggccggcgccagactgaagagagagctggacgccaccgccaccgtgctggccaacagacaggacgagagcgagcagagcagaaagagactgatcgagcagagcagagagttcaagaagaacacccccgaggacctgagaaagcaggtggcccccctgctgaagagcttccagggcgagatcgacgccctgagcaagagaagcaaggaggccgaggccgccttcctgaacgtgtacaagagactgatcgacgtgcccgaccccgtgcccgccctggacctgggccagcagctgcagctgaaggtgcagagactgcacgacatcgagaccgagaaccagaagctgagagagaccctggaggagtacaacaaggagttcgccgaggtgaagaaccaggaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggagcaggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcccctacagcaccaacagcatcagcagccagagccccctgcagcagagccccgacgtgaacggcatggcccccagccccagccagagcgagagcgccggcagcgtgagcgagggcgaggagatggacaccgccgagatcgccagacaggtgaaggagcagctgatcaagcacaacatcggccagagaatcttcggccactacgtgctgggcctgagccagggcagcgtgagcgagatcctggccagacccaagccctggaacaagctgaccgtgagaggcaaggagcccttccacaagatgaagcagttcctgagcgacgagcagaacatcctggccctgagaagcatccagggcagacagagagagaaccccggccagagcctgaacagactgttccaggaggtgcccaagagaagaaacggcagcgagggcaacatcaccaccagaatcagagccagcgagaccggcagcgacgaggccatcaagagcatcctggagcaggccaagagagagctgcaggtgcagaagaccgccgagcccgcccagcccagcagcgccagcggcagcggcaacagcgacgacgccatcagaagcatcctgcagcaggccagaagagagatggaggcccagcaggccgccctggaccccgccctgaagcaggcccccctgagccagagcgacatcaccatcctgacccccaagctgctgagcaccagccccatgcccaccgtgagcagctacccccccctggccatcagcctgaagaagcccagcgccgcccccgaggccggcgccagcgccctgcccaacccccccgccctgaagaaggaggcccaggacgcccccggcctggacccccagggcgccgccgactgcgcccagggcgtgctgagacaggtgaagaacgaggtgggcagaagcggcgcctggaaggaccactggtggagcgccgtgcagcccgagagaagaaacgccgccagcagcgaggaggccaaggccgaggagaccggcggcggcaaggagaagggcagcggcggcagcggcggcggcagccagcccagagccgagagaagccagctgcagggccccagcagcagcgagtactggaaggagtggcccagcgccgagagcccctacagccagagcagcgagctgagcctgaccggcgccagcagaagcgagaccccccagaacagccccctgcccagcagccccatcgtgcccatgagcaagcccaccaagcccagcgtgccccccctgacccccgagcagtacgaggtgtacatgtaccaggaggtggacaccatcgagctgaccagacaggtgaaggagaagctggccaagaacggcatctgccagagaatcttcggcgagaaggtgctgggcctgagccagggcagcgtgagcgacatgctgagcagacccaagccctggagcaagctgacccagaagggcagagagcccttcatcagaatgcagctgtggctgaacggcgagctgggccagggcgtgctgcccgtgcagggccagcagcagggccccgtgctgcacagcgtgaccagcctgcaggaccccctgcagcagggctgcgtgagcagcgagagcacccccaagaccagcgccagctgcagccccgcccccgagagccccatgagcagcagcgagagcgtgaagagcctgaccgagctggtgcagcagccctgcccccccatcgaggccagcaaggacagcaagccccccgagcccagcgacccccccgccagcgacagccagcccaccacccccctgcccctgagcggccacagcgccctgagcatccaggagctggtggccatgagccccgagctggacacctacggcatcaccaagagagtgaaggaggtgctgaccgacaacaacctgggccagagactgttcggcgagaccatcctgggcctgacccagggcagcgtgagcgacctgctggccagacccaagccctggcacaagctgagcctgaagggcagagagcccttcgtgagaatgcagctgtggctgaacgaccccaacaacgtggagaagctgatggacatgaagagaatggagaagaaggcctacatgaagagaagacacagcagcgtgagcgacagccagccctgcgagccccccagcgtgggcaccgagtacagccagggcgccagcccccagccccagcaccagctgaagaagcccagagtggtgctggcccccgaggagaaggaggccctgaagagagcctaccagcagaagccctaccccagccccaagaccatcgaggacctggccacccagctgaacctgaagaccagcaccgtgatcaactggttccacaactacagaagcagaatcagaagagagctgttcatcgaggagatccaggccggcagccagggccaggccggcgccagcgacagccccagcgccagaagcggcagagccgcccccagcagcgagggcgacagctgcgacggcgtggaggccaccgagggccccggcagcgccgacaccgaggagcccaagagccagggcgaggccgagagagaggaggtgcccagacccgccgagcagaccgagcccccccccagcggcacccccggccccgacgacgccagagacgacgaccacgagggcggccccgtggagggccccggccccctgcccagccccgccagcgccaccgccaccgccgcccccgccgcccccgaggacgccgccaccagcgccgccgccgcccccggcgagggccccgccgcccccagcagcgcccccccccccagcaacagcagcagcagcagcgcccccagaagacccagcagcctgcagagcctgttcggcctgcccgaggccgccggcgccagagacagcagagacaaccccctgagaaagaagaaggccgccaacctgaacagcatcatccacagactggagaaggccgccagcagagaggagcccatcgagtgggagttctag

SEQ ID NO: 17711 - DNA, 1989 bp, Artificial Sequence
  Description of Artificial Sequence: Synthetic coding sequence
atggccgccaacgtgggcagcatgttccagtactggaagagattcgacctgcagcagctgcagagagagctggacgccaccgccaccgtgctggccaacagacaggacgagagcgagcagagcagaaagagactgatcgagcagagcagagagttcaagaagaacacccccgagatcgacgccctgagcaagagaagcaaggaggccgaggccgccttcctgaacgtgtacaagagactgatcgacgtgcccgaccccgtgcccgccctggacctgggccagcagctgcagctgaaggtgcagagactgcacgacatcgagaccgagaaccagaagctgagagagaccctggaggagtacaacaaggagttcgccgaggtgaagaaccaggaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggagcaggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcagatgcgccgagctgcaggtgagaatcaccgaggccgtggccaccgccaccgagcagagagagctgatcgccagactggagcaggacctgagcatcatccagagcatccagagacccgacgccgagggcgccgccgagcacagactggagaagatccccgagcccatcaaggaggccaccgccctgttctacggccccgccgcccccgccagcggcgccctgcccgagggccaggtggacagcctgctgagcatcatcagcagccagagagagagattcagagccagaaaccaggagctggaggccgagaacagactggcccagcacaccctgcaggccctgcagagcgagctggacagcctgagagccgacaacatcaagctgttcgagaagatcaagttcctgcagagctaccccggcagaggcagcggcagcgacgacaccgagctgagatacagcagccagtacgaggagagactggaccccttcagcagcttcagcaagagagagagacagagaaagtacctgagcctgagcccctgggacaaggccaccctgagcatgggcagactggtgctgagcaacaagatggccagaaccatcggcttcttctacaccctgttcctgcactgcctggtgttcctggtgctgtacaagctggcctggagcgagagcatggagagagactgcgccaccttctgcgccaagaagttcgccgaccacctgcacaagttccacgagaacgacaacggcgccgccgccggcgacctgtggcagtag

SEQ ID NO: 17712 - DNA, 4452 bp, Artificial Sequence
  Description of Artificial Sequence: Synthetic coding sequence
atgctgtgcgtggccggcgccagactgaagagagagctggacgccaccgccaccgtgctggccaacagacaggacgagagcgagcagagcagaaagagactgatcgagcagagcagagagttcaagaagaacacccccgaggacctgagaaagcaggtggcccccctgctgaagagcttccagggcgagatcgacgccctgagcaagagaagcaaggaggccgaggccgccttcctgaacgtgtacaagagactgatcgacgtgcccgaccccgtgcccgccctggacctgggccagcagctgcagctgaaggtgcagagactgcacgacatcgagaccgagaaccagaagctgagagagaccctggaggagtacaacaaggagttcgccgaggtgaagaaccaggaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggagcaggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcagcgccagaagaaagggcaaggaccagcccgagagcagaagacccggcagcctgcccgcccccccccccagccagctgcccagaaaccccggcgagcaggccagcaacaccaacggcacccaccagttcagccccgccggcctgagccaggacttcttcagcagcagcctggccagccccagcctgcccctggccagcaccggcaagttcgccctgaacagcctgctgcagagacagctgatgcagagcttctacagcaaggccatgcaggaggccggcagcaccagcatgatcttcagcaccggcccctacagcaccaacagcatcagcagccagagccccctgcagcagagccccgacgtgaacggcatggcccccagccccagccagagcgagagcgccggcagcgtgagcgagggcgaggagatggacaccgccgagatcgccagacaggtgaaggagcagctgatcaagcacaacatcggccagagaatcttcggccactacgtgctgggcctgagccagggcagcgtgagcgagatcctggccagacccaagccctggaacaagctgaccgtgagaggcaaggagcccttccacaagatgaagcagttcctgagcgacgagcagaacatcctggccctgagaagcatccagggcagacagagaggcaacatcaccaccagaatcagagccagcgagaccggcagcgacgaggccatcaagagcatcctggagcaggccaagagagagctgcaggtgcagaagaccgccgagcccgcccagcccagcagcgccagcggcagcggcaacagcgacgacgccatcagaagcatcctgcagcaggccagaagagagatggaggcccagcaggccgccctggaccccgccctgaagcaggcccccctgagccagagcgacatcaccatcctgacccccaagctgctgagcaccagccccatgcccaccgtgagcagctacccccccctggccatcagcctgaagaagcccagcgccgcccccgaggccggcgccagcgccctgcccaacccccccgccctgaagaaggaggcccaggacgcccccggcctggacccccagggcgccgccgactgcgcccagggcgtgctgagacaggtgaagaacgaggtgggcagaagcggcgcctggaaggaccactggtggagcgccgtgcagcccgagagaagaaacgccgccagcagcgaggaggccaaggccgaggagaccggcggcggcaaggagaagggcagcggcggcagcggcggcggcagccagcccagagccgagagaagccagctgcagggccccagcagcagcgagtactggaaggagtggcccagcgccgagagcccctacagccagagcagcgagctgagcctgaccggcgccagcagaagcgagaccccccagaacagccccctgcccagcagccccatcgtgcccatgagcaagcccaccaagcccagcgtgccccccctgacccccgagcagtacgaggtgtacatgtaccaggaggtggacaccatcgagctgaccagacaggtgaaggagaagctggccaagaacggcatctgccagagaatcttcggcgagaaggtgctgggcctgagccagggcagcgtgagcgacatgctgagcagacccaagccctggagcaagctgacccagaagggcagagagcccttcatcagaatgcagctgtggctgaacggcgagctgggccagggcgtgctgcccgtgcagggccagcagcagggccccgtgctgcacagcgtgaccagcctgcaggaccccctgcagcagggctgcgtgagcagcgagagcacccccaagaccagcgccagctgcagccccgcccccgagagccccatgagcagcagcgagagcgtgaagagcctgaccgagctggtgcagcagccctgcccccccatcgaggccagcaaggacagcaagccccccgagcccagcgacccccccgccagcgacagccagcccaccacccccctgcccctgagcggccacagcgccctgagcatccaggagctggtggccatgagccccgagctggacacctacggcatcaccaagagagtgaaggaggtgctgaccgacaacaacctgggccagagactgttcggcgagaccatcctgggcctgacccagggcagcgtgagcgacctgctggccagacccaagccctggcacaagctgagcctgaagggcagagagcccttcgtgagaatgcagctgtggctgaacgaccccaacaacgtggagaagctgatggacatgaagagaatggagaagaaggcctacatgaagagaagacacagcagcgtgagcgacagccagccctgcgagccccccagcgtgggcaccgagtacagccagggcgccagcccccagccccagcaccagctgaagaagcccagagtggtgctggcccccgaggagaaggaggccctgaagagagcctaccagcagaagccctaccccagccccaagaccatcgaggacctggccacccagctgaacctgaagaccagcaccgtgatcaactggttccacaactacagaagcagaatcagaagagagctgttcatcgaggagatccaggccggcagccagggccaggccggcgccagcgacagccccagcgccagaagcggcagagccgcccccagcagcgagggcgacagctgcgacggcgtggaggccaccgagggccccggcagcgccgacaccgaggagcccaagagccagggcgaggccgagagagaggaggtgcccagacccgccgagcagaccgagcccccccccagcggcacccccggccccgacgacgccagagacgacgaccacgagggcggccccgtggagggccccggccccctgcccagccccgccagcgccaccgccaccgccgcccccgccgcccccgaggacgccgccaccagcgccgccgccgcccccggcgagggccccgccgcccccagcagcgcccccccccccagcaacagcagcagcagcagcgcccccagaagacccagcagcctgcagagcctgttcggcctgcccgaggccgccggcgccagagacagcagagacaaccccctgagaaagaagaaggccgccaacctgaacagcatcatccacagactggagaaggccgccagcagagaggagcccatcgagtgggagttctag

SEQ ID NO: 17713 - DNA, 4350 bp, Artificial Sequence
  Description of Artificial Sequence: Synthetic coding sequence
atgctgtgcgtggccggcgccagactgaagagagagctggacgccaccgccaccgtgctggccaacagacaggacgagagcgagcagagcagaaagagactgatcgagcagagcagagagttcaagaagaacacccccgaggacctgagaaagcaggtggcccccctgctgaagagcttccagggcgagatcgacgccctgagcaagagaagcaaggaggccgaggccgccttcctgaacgtgtacaagagactgatcgacgtgcccgaccccgtgcccgccctggacctgggccagcagctgcagctgaaggtgcagagactgcacgacatcgagaccgagaaccagaagctgagagagaccctggaggagtacaacaaggagttcgccgaggtgaagaaccaggaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggagcaggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcagcgccagaagaaagggcaaggaccagcccgagagcagaagacccggcagcctgcccgcccccccccccagccagctgcccagaaaccccggcgagcaggccagcaacaccaacggcacccaccagttcagccccgccggcctgagccaggacttcttcagcagcagcctggccagccccagcctgcccctggccagcaccggcaagttcgccctgaacagcctgctgcagagacagctgatgcagagcttctacagcaaggccatgcaggaggccggcagcaccagcatgatcttcagcaccggcccctacagcaccaacagcatcagcagccagagccccctgcagcagagccccgacgtgaacggcatggcccccagccccagccagagcgagagcgccggcagcgtgagcgagggcgaggagatggacaccgccgagatcgccagacaggtgaaggagcagctgatcaagcacaacatcggccagagaatcttcggccactacgtgctgggcctgagccagggcagcgtgagcgagatcctggccagacccaagccctggaacaagctgaccgtgagaggcaaggagcccttccacaagatgaagcagttcctgagcgacgagcagaacatcctggccctgagaagcatccagggcagacagagagccgagcccgcccagcccagcagcgccagcggcagcggcaacagcgacgacgccatcagaagcatcctgcagcaggccagaagagagatggaggcccagcaggccgccctggaccccgccctgaagcaggcccccctgagccagagcgacatcaccatcctgacccccaagctgctgagcaccagccccatgcccaccgtgagcagctacccccccctggccatcagcctgaagaagcccagcgccgcccccgaggccggcgccagcgccctgcccaacccccccgccctgaagaaggaggcccaggacgcccccggcctggacccccagggcgccgccgactgcgcccagggcgtgctgagacaggtgaagaacgaggtgggcagaagcggcgcctggaaggaccactggtggagcgccgtgcagcccgagagaagaaacgccgccagcagcgaggaggccaaggccgaggagaccggcggcggcaaggagaagggcagcggcggcagcggcggcggcagccagcccagagccgagagaagccagctgcagggccccagcagcagcgagtactggaaggagtggcccagcgccgagagcccctacagccagagcagcgagctgagcctgaccggcgccagcagaagcgagaccccccagaacagccccctgcccagcagccccatcgtgcccatgagcaagcccaccaagcccagcgtgccccccctgacccccgagcagtacgaggtgtacatgtaccaggaggtggacaccatcgagctgaccagacaggtgaaggagaagctggccaagaacggcatctgccagagaatcttcggcgagaaggtgctgggcctgagccagggcagcgtgagcgacatgctgagcagacccaagccctggagcaagctgacccagaagggcagagagcccttcatcagaatgcagctgtggctgaacggcgagctgggccagggcgtgctgcccgtgcagggccagcagcagggccccgtgctgcacagcgtgaccagcctgcaggaccccctgcagcagggctgcgtgagcagcgagagcacccccaagaccagcgccagctgcagccccgcccccgagagccccatgagcagcagcgagagcgtgaagagcctgaccgagctggtgcagcagccctgcccccccatcgaggccagcaaggacagcaagccccccgagcccagcgacccccccgccagcgacagccagcccaccacccccctgcccctgagcggccacagcgccctgagcatccaggagctggtggccatgagccccgagctggacacctacggcatcaccaagagagtgaaggaggtgctgaccgacaacaacctgggccagagactgttcggcgagaccatcctgggcctgacccagggcagcgtgagcgacctgctggccagacccaagccctggcacaagctgagcctgaagggcagagagcccttcgtgagaatgcagctgtggctgaacgaccccaacaacgtggagaagctgatggacatgaagagaatggagaagaaggcctacatgaagagaagacacagcagcgtgagcgacagccagccctgcgagccccccagcgtgggcaccgagtacagccagggcgccagcccccagccccagcaccagctgaagaagcccagagtggtgctggcccccgaggagaaggaggccctgaagagagcctaccagcagaagccctaccccagccccaagaccatcgaggacctggccacccagctgaacctgaagaccagcaccgtgatcaactggttccacaactacagaagcagaatcagaagagagctgttcatcgaggagatccaggccggcagccagggccaggccggcgccagcgacagccccagcgccagaagcggcagagccgcccccagcagcgagggcgacagctgcgacggcgtggaggccaccgagggccccggcagcgccgacaccgaggagcccaagagccagggcgaggccgagagagaggaggtgcccagacccgccgagcagaccgagcccccccccagcggcacccccggccccgacgacgccagagacgacgaccacgagggcggccccgtggagggccccggccccctgcccagccccgccagcgccaccgccaccgccgcccccgccgcccccgaggacgccgccaccagcgccgccgccgcccccggcgagggccccgccgcccccagcagcgcccccccccccagcaacagcagcagcagcagcgcccccagaagacccagcagcctgcagagcctgttcggcctgcccgaggccgccggcgccagagacagcagagacaaccccctgagaaagaagaaggccgccaacctgaacagcatcatccacagactggagaaggccgccagcagagaggagcccatcgagtgggagttctag

SEQ ID NO: 17714 - DNA, 4044 bp, Artificial Sequence
  Description of Artificial Sequence: Synthetic coding sequence
atgctgtgcgtggccggcgccagactgaagagagagctggacgccaccgccaccgtgctggccaacagacaggacgagagcgagcagagcagaaagagactgatcgagcagagcagagagttcaagaagaacacccccgaggacctgagaaagcaggtggcccccctgctgaagagcttccagggcgagatcgacgccctgagcaagagaagcaaggaggccgaggccgccttcctgaacgtgtacaagagactgatcgacgtgcccgaccccgtgcccgccctggacctgggccagcagctgcagctgaaggtgcagagactgcacgacatcgagaccgagaaccagaagctgagagagaccctggaggagtacaacaaggagttcgccgaggtgaagaaccaggaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggagcaggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcccctacagcaccaacagcatcagcagccagagccccctgcagcagagccccgacgtgaacggcatggcccccagccccagccagagcgagagcgccggcagcgtgagcgagggcgaggagatggacaccgccgagatcgccagacaggtgaaggagcagctgatcaagcacaacatcggccagagaatcttcggccactacgtgctgggcctgagccagggcagcgtgagcgagatcctggccagacccaagccctggaacaagctgaccgtgagaggcaaggagcccttccacaagatgaagcagttcctgagcgacgagcagaacatcctggccctgagaagcatccagggcagacagagagccgagcccgcccagcccagcagcgccagcggcagcggcaacagcgacgacgccatcagaagcatcctgcagcaggccagaagagagatggaggcccagcaggccgccctggaccccgccctgaagcaggcccccctgagccagagcgacatcaccatcctgacccccaagctgctgagcaccagccccatgcccaccgtgagcagctacccccccctggccatcagcctgaagaagcccagcgccgcccccgaggccggcgccagcgccctgcccaacccccccgccctgaagaaggaggcccaggacgcccccggcctggacccccagggcgccgccgactgcgcccagggcgtgctgagacaggtgaagaacgaggtgggcagaagcggcgcctggaaggaccactggtggagcgccgtgcagcccgagagaagaaacgccgccagcagcgaggaggccaaggccgaggagaccggcggcggcaaggagaagggcagcggcggcagcggcggcggcagccagcccagagccgagagaagccagctgcagggccccagcagcagcgagtactggaaggagtggcccagcgccgagagcccctacagccagagcagcgagctgagcctgaccggcgccagcagaagcgagaccccccagaacagccccctgcccagcagccccatcgtgcccatgagcaagcccaccaagcccagcgtgccccccctgacccccgagcagtacgaggtgtacatgtaccaggaggtggacaccatcgagctgaccagacaggtgaaggagaagctggccaagaacggcatctgccagagaatcttcggcgagaaggtgctgggcctgagccagggcagcgtgagcgacatgctgagcagacccaagccctggagcaagctgacccagaagggcagagagcccttcatcagaatgcagctgtggctgaacggcgagctgggccagggcgtgctgcccgtgcagggccagcagcagggccccgtgctgcacagcgtgaccagcctgcaggaccccctgcagcagggctgcgtgagcagcgagagcacccccaagaccagcgccagctgcagccccgcccccgagagccccatgagcagcagcgagagcgtgaagagcctgaccgagctggtgcagcagccctgcccccccatcgaggccagcaaggacagcaagccccccgagcccagcgacccccccgccagcgacagccagcccaccacccccctgcccctgagcggccacagcgccctgagcatccaggagctggtggccatgagccccgagctggacacctacggcatcaccaagagagtgaaggaggtgctgaccgacaacaacctgggccagagactgttcggcgagaccatcctgggcctgacccagggcagcgtgagcgacctgctggccagacccaagccctggcacaagctgagcctgaagggcagagagcccttcgtgagaatgcagctgtggctgaacgaccccaacaacgtggagaagctgatggacatgaagagaatggagaagaaggcctacatgaagagaagacacagcagcgtgagcgacagccagccctgcgagccccccagcgtgggcaccgagtacagccagggcgccagcccccagccccagcaccagctgaagaagcccagagtggtgctggcccccgaggagaaggaggccctgaagagagcctaccagcagaagccctaccccagccccaagaccatcgaggacctggccacccagctgaacctgaagaccagcaccgtgatcaactggttccacaactacagaagcagaatcagaagagagctgttcatcgaggagatccaggccggcagccagggccaggccggcgccagcgacagccccagcgccagaagcggcagagccgcccccagcagcgagggcgacagctgcgacggcgtggaggccaccgagggccccggcagcgccgacaccgaggagcccaagagccagggcgaggccgagagagaggaggtgcccagacccgccgagcagaccgagcccccccccagcggcacccccggccccgacgacgccagagacgacgaccacgagggcggccccgtggagggccccggccccctgcccagccccgccagcgccaccgccaccgccgcccccgccgcccccgaggacgccgccaccagcgccgccgccgcccccggcgagggccccgccgcccccagcagcgcccccccccccagcaacagcagcagcagcagcgcccccagaagacccagcagcctgcagagcctgttcggcctgcccgaggccgccggcgccagagacagcagagacaaccccctgagaaagaagaaggccgccaacctgaacagcatcatccacagactggagaaggccgccagcagagaggagcccatcgagtgggagttctag

SEQ ID NO: 17715 - DNA, 1902 bp, Artificial Sequence
  Description of Artificial Sequence: Synthetic coding sequence
atgaagatcagcgcctggctgatgtgcgccagaggcaaggacctgagaaagcaggtggcccccctgctgaagagcttccagggcgagatcgacgccctgagcaagagaagcaaggaggccgaggccgccttcctgaacgtgtacaagagactgatcgacgtgcccgaccccgtgcccgccctggacctgggccagcagctgcagctgaaggtgcagagactgcacgacatcgagaccgagaaccagaagctgagagagaccctggaggagtacaacaaggagttcgccgaggtgaagaaccaggaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggagcaggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcagatgcgccgagctgcaggtgagaatcaccgaggccgtggccaccgccaccgagcagagagagctgatcgccagactggagcaggacctgagcatcatccagagcatccagagacccgacgccgagggcgccgccgagcacagactggagaagatccccgagcccatcaaggaggccaccgccctgttctacggccccgccgcccccgccagcggcgccctgcccgagggccaggtggacagcctgctgagcatcatcagcagccagagagagagattcagagccagaaaccaggagctggaggccgagaacagactggcccagcacaccctgcaggccctgcagagcgagctggacagcctgagagccgacaacatcaagctgttcgagaagatcaagttcctgcagagctaccccggcagaggcagcggcagcgacgacaccgagctgagatacagcagccagtacgaggagagactggaccccttcagcagcttcagcaagagagagagacagagaaagtacctgagcctgagcccctgggacaaggccaccctgagcatgggcagactggtgctgagcaacaagatggccagaaccatcggcttcttctacaccctgttcctgcactgcctggtgttcctggtgctgtacaagctggcctggagcgagagcatggagagagactgcgccaccttctgcgccaagaagttcgccgaccacctgcacaagttccacgagaacgacaacggcgccgccgccggcgacctgtggcagtag

SEQ ID NO: 17716 - DNA, 2079 bp, Artificial Sequence
  Description of Artificial Sequence: Synthetic coding sequence
atgagcgccggcaccggcaagggcggcccccagacccccgtggagagccccaccgccagcagcaagctgccccaggcccactggctgtgcagccccggcatcaagagagagctggacgccaccgccaccgtgctggccaacagacaggacgagagcgagcagagcagaaagagactgatcgagcagagcagagagttcaagaagaacacccccgaggacctgagaaagcaggtggcccccctgctgaagagcttccagggcgagatcgacgccctgagcaagagaagcaaggaggccgaggccgccttcctgaacgtgtacaagagactgatcgacgtgcccgaccccgtgcccgccctggacctgggccagcagctgcagctgaaggtgcagagactgcacgacatcgagaccgagaaccagaagctgagagagaccctggaggagtacaacaaggagttcgccgaggtgaagaaccaggaggtgaccatcaaggccctgaaggagaagatcagagagtacgagcagaccctgaagaaccaggccgagaccatcgccctggagaaggagcagaagctgcagaacgacttcgccgagaaggagagaaagctgcaggagacccagatgagcaccaccagcaagctggaggaggccgagcacaaggtgcagagcctgcagaccgccctggagaagaccagaaccgagctgttcgacctgaagaccaagtacgacgaggagaccaccgccaaggccgacgagatcgagatgatcatgaccgacctggagagagccaaccagagagccgaggtggcccagagagaggccgagaccctgagagagcagctgagcagcgccaaccacagcctgcagctggccagccagatccagaaggcccccgacgtggagcaggccatcgaggtgctgaccagaagcagcctggaggtggagctggccgccaaggagagagagatcgcccagctggtggaggacgtgcagagactgcaggccagcctgaccaagctgagagagaacagcgccagccagatcagccagctggagcagcagctgagcgccaagaacagcaccctgaagcagctggaggagaagctgaagggccaggccgactacgaggaggtgaagaaggagctgaacatcctgaagagcatggagttcgcccccagcgagggcgccggcacccaggacgccgccaagcccctggaggtgctgctgctggagaagaacagaagcctgcagagcgagaacgccgccctgagaatcagcaacagcgacctgagcggcagatgcgccgagctgcaggtgagaatcaccgaggccgtggccaccgccaccgagcagagagagctgatcgccagactggagcaggacctgagcatcatccagagcatccagagacccgacgccgagggcgccgccgagcacagactggagaagatccccgagcccatcaaggaggccaccgccctgttctacggccccgccgcccccgccagcggcgccctgcccgagggccaggtggacagcctgctgagcatcatcagcagccagagagagagattcagagccagaaaccaggagctggaggccgagaacagactggcccagcacaccctgcaggccctgcagagcgagctggacagcctgagagccgacaacatcaagctgttcgagaagatcaagttcctgcagagctaccccggcagaggcagcggcagcgacgacaccgagctgagatacagcagccagtacgaggagagactggaccccttcagcagcttcagcaagagagagagacagagaaagtacctgagcctgagcccctgggacaaggccaccctgagcatgggcagactggtgctgagcaacaagatggccagaaccatcggcttcttctacaccctgttcctgcactgcctggtgttcctggtgctgtacaagctggcctggagcgagagcatggagagagactgcgccaccttctgcgccaagaagttcgccgaccacctgcacaagttccacgagaacgacaacggcgccgccgccggcgacctgtggcagtag

SEQ ID NO: 17717 - DNA, 1719 bp, Artificial Sequence
  Description of Artificial Sequence: Synthetic coding sequence
atggacagagccggcgccgacatgtgggccagcaccttcaccctggccatggccgagagaaagccccaggacgtgtgggtgctgctgcccgagcacagcctggtgcccggctgcctggacggcggcggcgtgcagtacctgctggtgggcctgagcagactgcagtgcggccactgccccggcacctgggacagcgcccacgtgcacgtgctgttccacctgtggtgggacagagccagccacagaggcctggtgaagatgagaatctggggccagagatgcagactgtgccccgcccccggcgactgccaggtgagaccccccggcgagcagcccttcctgagcagactggtgctgcacatcctgcaggactgctacggcgacggccccggccccgccagacaccccagagaggcctacgagggctgctgcgaggcctgcgagctgggcgtgtgcttcctgcagaaggcccccgaccccgcctggagcgccaacgccaccaagggcaacttccccgccaccgcctggggcggcaccggcaccgtgagcagaggcaagcccctgagcacccccggcgacgacctgggcaagggcggcgtggtgatcgccatccccttcagcctggtgggcaccagcaacgaccaggtgcccatcgccgagggccccgccccccccgccggcgccagcctgcccgtgaccggcagctgcgaggccctggtgatcggccagggcagcatcttcctgagcggcgacagcgtggccatgcccggcggcaagggcttccccgtggccatcggcgaccccctgttccacggccccggcctgctgggcagcagcatccagaccttcgagctgaagggcttcctgttcaagggcagaggcagcctgtgcagccccgtgggcgtggcccagggctggggccccatcagcctgaacaacggcctggtgcccgtgggcaagcacacccccaccgtgttctactgcgtgggcctgagcgccagcggcgagggcagcctgaccttccccagcagcctgaccagcatcttcaccaacaccctgagcgagcccaccgacggccccgtggccaccaaggaggccagcatcaccttccccttcatcttcaccgacgtgaaggacgccgtggccgaggtggccgagggcaacggcaaggagggcggcggccagggcctggtgcccgtgggccacgacgccctgcccgagaccaacgccggcggcctgcccagccaggtgaagggcagcctggccctgcccttccccgccgacgtgcagggcaaggacgccttcaccgacatcaccgagggcaaggagaaggagggcggcctggtgaccgccggccacgacgcccccctggaggccaacgccgagggccccatcaccgtgagcgagggctgcatcaccatccccttcgccgtgttcgacgtgatcaagagaaagggcggcggccacgtggcctacggcccccagggcaacggctgcttcagccagggctactaccagaagagacagctgagaagcagattccacaaggccagatgcggctgcagaagagaggaggacgagagacccggcagagcctgcagaagaccccacgccgagccctacgaggacttctggatctgggtgagcatgaccgtgtgcgtgttctggctgatgtgcatgtgcagactgaaccccggcatctacccccagcaggtgtag

SEQ ID NO: 17718 - DNA, 1728 bp, Artificial Sequence
  Description of Artificial Sequence: Synthetic coding sequence
atgagccaggacaccaaggtgaagaccaccgagagcagcccccccgcccccagcaaggccagaaagctgctgcccgtgctggaccccagcggcgactactactactggtggctgaacaccatggtgttccccgtgatgtacaacctgatcatcctggtgtgcagagcctgcttccccgacctgcagcacggctacctggtggcctggctggtgctggactacaccagcgacctgctgtacctgctggacatggtggtgagattccacaccggcttcctggagcagggcatcctggtggtggacaagggcagaatcagcagcagatacgtgagaacctggagcttcttcctggacctggccagcctgatgcccaccgacgtggtgtacgtgagactgggcccccacacccccaccctgagactgaacagattcctgagagcccccagactgttcgaggccttcgacagaaccgagaccagaaccgcctaccccaacgccttcagaatcgccaagctgatgctgtacatcttcgtggtgatccactggaacagctgcctgtacttcgccctgagcagatacctgggcttcggcagagacgcctgggtgtaccccgaccccgcccagcccggcttcgagagactgagaagacagtacctgtacagcttctacttcagcaccctgatcctgaccaccgtgggcgacacccccccccccgccagagaggaggagtacctgttcatggtgggcgacttcctgctggccgtgatgggcttcgccaccatcatgggcagcatgagcagcgtgatctacaacatgaacaccgccgacgccgccttctaccccgaccacgccctggtgaagaagtacatgaagctgcagcacgtgaacagaaagctggagagaagagtgatcgactggtaccagcacctgcagatcaacaagaagatgaccaacgaggtggccatcctgcagcacctgcccgagagactgagagccgaggtggccgtgagcgtgcacctgagcaccctgagcagagtgcagatcttccagaactgcgaggccagcctgctggaggagctggtgctgaagctgcagccccagacctacagccccggcgagtacgtgtgcagaaagggcgacatcggccaggagatgtacatcatcagagagggccagctggccgtggtggccgacgacggcatcacccagtacgccgtgctgggcgccggcctgtacttcggcgagatcagcatcatcaacatcaagggcaacatgagcggcaacagaagaaccgccaacatcaagagcctgggctacagcgacctgttctgcctgagcaaggaggacctgagagaggtgctgagcgagtacccccaggcccagaccatcatggaggagaagggcagagagatcctgctgaagatgaacaagctggacgtgaacgccgaggccgccgagatcgccctgcaggaggccaccgagagcagactgagaggcctggaccagcagctggacgacctgcagaccaagttcgccagactgctggccgagctggagagcagcgccctgaagatcgcctacagaatcgagagactggagtggcagaccagagagtggcccatgcccgaggacctggccgaggccgacgacgagggcgagcccgaggagggcaccagcaaggacgaggagggcagagccagccaggagggcccccccggccccgagtag

SEQ ID NO: 17719 - DNA, 1164 bp, Artificial Sequence
  Description of Artificial Sequence: Synthetic coding sequence
atgatggacgagccctggtgggagggcagagtggccagcgacgtgcactgcaccctgagagagaaggagctgaagctgcccaccttcagagcccacagccccctgctgaagagcagaagattcttcgtggacatcctgaccctgctgagcagccactgccagctgtgccccgccgccagacacctggccgtgtacctgctggaccacttcatggacagatacaacgtgaccaccagcaagcagctgtacaccgtggccgtgagctgcctgctgctggccagcaagttcgaggacagagaggaccacgtgcccaagctggagcagatcaacagcaccagaatcctgagcagccagaacttcaccctgaccaagaaggagctgctgagcaccgagctgctgctgctggaggccttcagctggaacctgtgcctgcccacccccgcccacttcctggactactacctgctggccagcgtgagccagaaggaccaccactgccacacctggcccaccacctgccccagaaagaccaaggagtgcctgaaggagtacgcccactacttcctggaggtgaccctgcaggaccacatcttctacaagttccagcccagcgtggtggccgccgcctgcgtgggcgccagcagaatctgcctgcagctgagcccctactggaccagagacctgcagagaatcagcagctacagcctggagcacctgagcacctgcatcgagatcctgctggtggtgtacgacaacgtgctgaaggacgccgtggccgtgaagagccaggccctggccatggtgcccggcaccccccccacccccacccaggtgctgttccagccccccgcctaccccgccctgggccagcccgccaccaccctggcccagttccagacccccgtgcaggacctgtgcctggcctacagagacagcctgcaggcccacagaagcggcagcctgctgagcggcagcaccggcagcagcctgcacaccccctaccagcccctgcagcccctggacatgtgccccgtgcccgtgcccgccagcctgagcatgcacatggccatcgccgccgagcccagacactgcctggccaccacctacggcagcagctacttcagcggcagccacatgttccccaccggctgcttcgacagatag

SEQ ID NO: 17720 - DNA, 1308 bp, Artificial Sequence
  Description of Artificial Sequence: Synthetic coding sequence
atgatggacgagccctggtgggagggcagagtggccagcgacgtgcactgcaccctgagagagaaggagctgaagctgcccaccttcagagcccacagccccctgctgaagagcagaagattcttcgtggacatcctgaccctgctgagcagccactgccagctgtgccccgccgccagacacctggccgtgtacctgctggaccacttcatggacagatacaacgtgaccaccagcaagcagctgtacaccgtggccgtgagctgcctgctgctggccaacggcgtgagcctgctgagccccagactgaagtgcagcggcatgatcagcgcccactgcaacctgcacctgcccggcagcagcaacagccccgccagcgccccccaccccccccccacccccccccaggtggccgagaccaccggcaagttcgaggacagagaggaccacgtgcccaagctggagcagatcaacagcaccagaatcctgagcagccagaacttcaccctgaccaagaaggagctgctgagcaccgagctgctgctgctggaggccttcagctggaacctgtgcctgcccacccccgcccacttcctggactactacctgctggccagcgtgagccagaaggaccaccactgccacacctggcccaccacctgccccagaaagaccaaggagtgcctgaaggagtacgcccactacttcctggaggtgaccctgcaggaccacatcttctacaagttccagcccagcgtggtggccgccgcctgcgtgggcgccagcagaatctgcctgcagctgagcccctactggaccagagacctgcagagaatcagcagctacagcctggagcacctgagcacctgcatcgagatcctgctggtggtgtacgacaacgtgctgaaggacgccgtggccgtgaagagccaggccctggccatggtgcccggcaccccccccacccccacccaggtgctgttccagccccccgcctaccccgccctgggccagcccgccaccaccctggcccagttccagacccccgtgcaggacctgtgcctggcctacagagacagcctgcaggcccacagaagcggcagcctgctgagcggcagcaccggcagcagcctgcacaccccctaccagcccctgcagcccctggacatgtgccccgtgcccgtgcccgccagcctgagcatgcacatggccatcgccgccgagcccagacactgcctggccaccacctacggcagcagctacttcagcggcagccacatgttccccaccggctgcttcgacagatag

SEQ ID NO: 17721 - DNA, 501 bp, Artificial Sequence
  Description of Artificial Sequence: Synthetic coding sequence
atgagacacaccagcaagagaaagccccagtactacgaggccgagatggtgctgaagtactacaagcacctggaggagggcagcgtgagcctgtgctgccccggctggagcgccgtggcccagagcagactgaccgccgccagcaccttcggcgcccaggtgatcctgctgttccagctgagcgagcagctgagactgcaggagctgaagctgcccaccttcagagcccacagccccctgctgaagagcagaagattcttcgtggacatcctgaccctgctgagcagccactgccagctgtgccccgccgccagacacctggccgtgtacctgctggaccacttcatggacagatacaacgtgaccaccagcaagcagctgtacaccgtggccgtgagctgcctgctgctggccagcagaaacaagggcagcggcagccccgtgcccaccagaagcgcccagcagtgcagacagacctgggccagaggcagcccctggtag

SEQ ID NO: 17722 - DNA, 759 bp, Artificial Sequence
  Description of Artificial Sequence: Synthetic coding sequence
atgatggacgagccctggtgggagggcagagtggccagcgacgtgcactgcaccctgagagagaaggagctgaagctgcccaccttcagagcccacagccccctgctgaagagcagaagattcttcgtggacatcctgaccctgctgagcagccactgccagctgtgccccgccgccagacacctggccgtgtacctgctggaccacttcatggacagatacaacgtgaccaccagcaagcagctgtacaccgtggccgtgagctgcctgctgctggccagcaagttcgaggacagagaggaccacgtgcccaagctggagcagatcaacagcaccagaatcctgagcagccagaacttcaccctgaccaagaaggagctgctgagcaccgagctgctgctgctggaggccttcagctggaacctgtgcctgcccacccccgcccacttcctggactactacctgctggccagcgtgagccagaaggaccaccactgccacacctggcccaccacctgccccagaaagaccaaggagtgcctgaaggagtacgcccactacttcctggaggtgaccctgcaggaccacatcttctacaagttccagcccagcgtggtggccgccgcctgcgtgggcgccagcagaatctgcctgcagctgagcccctactggaccagagacctgcagagaatcagcagctacagcctggagcacctgagcacctgcatcgagatcctgctggtgcccctgttcagatag

SEQ ID NO: 17723 - DNA, 756 bp, Artificial Sequence
  Description of Artificial Sequence: Synthetic coding sequence
atggacgagccctggtgggagggcagagtggccagcgacgtgcactgcaccctgagagagaaggagctgaagctgcccaccttcagagcccacagccccctgctgaagagcagaagattcttcgtggacatcctgaccctgctgagcagccactgccagctgtgccccgccgccagacacctggccgtgtacctgctggaccacttcatggacagatacaacgtgaccaccagcaagcagctgtacaccgtggccgtgagctgcctgctgctggccagcaagttcgaggacagagaggaccacgtgcccaagctggagcagatcaacagcaccagaatcctgagcagccagaacttcaccctgaccaagaaggagctgctgagcaccgagctgctgctgctggaggccttcagctggaacctgtgcctgcccacccccgcccacttcctggactactacctgctggccagcgtgagccagaaggaccaccactgccacacctggcccaccacctgccccagaaagaccaaggagtgcctgaaggagtacgcccactacttcctggaggtgaccctgcaggaccacatcttctacaagttccagcccagcgtggtggccgccgcctgcgtgggcgccagcagaatctgcctgcagctgagcccctactggaccagagacctgcagagaatcagcagctacagcctggagcacctgagcacctgcatcgagatcctgctggtgcccctgttcagatag

SEQ ID NO: 17724 - DNA, 1233 bp, Artificial Sequence
  Description of Artificial Sequence: Synthetic coding sequence
atggacctgaccggcctgctgctggacgaggagggcaccttcagcctggccggcttccaggacttcaccttcctgcccggccaccagaagctgagcgccagaatcagaagaagactgtactacggctgggactgggaggccgactgcagcctggaggagctgagcagccccgtggccgacatcgccgtggagctgctgcagaaggccgcccccagccccatcagaagactgcagaagaagtacgtggcccacgtgagcagagaggcctgcatcagcccctgcgccatgatgctggccctggtgtacatcgagagactgagacacagaaaccccgactacctgcagcacgtgagcagcagcgacctgttcctgatcagcatgatggtggccagcaagtacctgtacgacgagggcgaggaggaggaggtgttcaacgacgagtggggcgccgccggcggcgtggccgtgcccaccctgaacgccctggagagaggcttcctgagcgccatggactggcacctgtacaccgaccccagagagatcttcgaggtgctgagctggctggagagctgcgtggccgagcagcagggcagatggagaggctggtacacctacaccgacctgtgcgtgctgctggagcagcccacctggcagctggccctgggcagcctgtgccagagactggtgaagctgagctgcctgctggccgtggcctacgtgagcagcgtggccctggccgtggccagcgtggccgtgatccaccagagcctgggcctgagctgcatccccacccccggcccccccgacctgggcctgaccagcagatgcctgctggagccctgcatccccagcgtgccccagtgcctgcccagcctggccaacgtgagcagctgcctggagggcagcatgggcctgagaagcctgtggggcagcctgctggccagcctgacccccccccccctgcccccccccgacccccccgccccccccaccctgctgcacaactgccacctgtgccagaagctgcagagagacagccccacctgccacgcctgcctgcaccccaacagaaccgtgcccaccgccctgagcagcccctggtaccacacctacggcctggcccccccctggccctggagccccgtgctgctgagcctgccccagccccagcagtgcagcctgttcagcgtgatggagctggccagactgaagagcttcgtgttccccggctag

SEQ ID NO: 17725 - DNA, 1233 bp, Artificial Sequence; identical to SEQ ID NO: 17724
  Description of Artificial Sequence: Synthetic coding sequence

SEQ ID NO: 17726 - DNA, 927 bp, Artificial Sequence
  Description of Artificial Sequence: Synthetic coding sequence
atggacctgaccggcctgctgctggacgaggagggcaccttcagcctggccggcttccaggacttcaccttcctgcccggccaccagaagctgagcgccagaatcagaagaagactgtactacggctgggactgggaggccgactgcagcctggaggagctgagcagccccgtggccgacatcgccgtggagctgctgcagaaggccgcccccagccccatcagaagactgcagaagaagtacgtggcccacgtgagcagagaggcctgcatcagcccctgcgccatgatgctggccctggtgtacatcgagagactgagacacagaaaccccgactacctgcagcacgtgagcagcagcgacctgttcctgatcagcatgatggtggccagcaagtacctgtacgacgagggcgaggaggaggaggtgttcaacgacgagtggggcgccgccggcggcgtggccgtgcccaccctgaacgccctggagagaggcttcctgagcgccatggactggcacctgtacaccgaccccagagagatcttcgaggtgctgagctggctggagagctgcgtggccgagcagcagggcagatggagaggctggtacacctacaccgacctgtgcgtgctgctggagcagcccacctggcagctggccctgggcagcctgtgccagagactggtgaagctgagctgcctgctggccgtggcctacgtgagcagcgtggccctggccgtggccagcgtggccgtgatccaccagagcctgggcctgagctgcatccccacccccggcccccccgacctgggcctgaccagcagatgcctgctggagccctgcatccccagcgtgccccagtgcctgcccagcctggccaacgtgagcagctgcctggagggcagcatgggcctgagaagcctgtag

SEQ ID NO: 17727 - DNA, 1356 bp, Artificial Sequence
  Description of Artificial Sequence: Synthetic coding sequence
atgcacggctacttcggctgcaacgccgccgccgagcccggctacagcgccttcgtgggcaccccccagatctgcgtgaccaagatgagcaccagaaactgccagggcatggacagcgtgatcaagcccctggacaccatccccgaggacaagaaggtgagagtgcagagaacccagagcaccttcgaccccttcgagaagcccgccaaccaggtgaagagagtgcacagcgagaacaacgcctgcatcaacttcaagaccagcagcaccggcaaggagagccccaaggtgagaagacacagcagccccagcagccccaccagccccaagttcggcaaggccgacagctacgagaagctggagaagctgggcgagggcagctacgccaccgtgtacaagggcaagagcaaggtgaacggcaagctggtggccctgaaggtgatcagactgcaggaggaggagggcacccccttcaccgccatcagagaggccagcctgctgaagggcctgaagcacgccaacatcgtgctgctgcacgacatcatccacaccaaggagaccctgaccctggtgttcgagtacgtgcacaccgacctgtgccagtacatggacaagcaccccggcggcctgcaccccgacaacgtgaagctgttcctgttccagctgctgagaggcctgagctacatccaccagagatacatcctgcacagagacctgaagccccagaacctgctgatcagcgacaccggcgagctgaagctggccgacttcggcctggccagagccaagagcgtgcccagccacacctacagcaacgaggtggtgaccctgtggtacagaccccccgacgtgctgctgggcagcaccgagtacagcacctgcctggacatgtggggcgtgggctgcatcttcgtggagatgatccagggcgtggccgccttccccggcatgaaggacatccaggaccagctggagagaatcttcctggtgctgggcacccccaacgaggacacctggcccggcgtgcacagcctgccccacttcaagcccgagagattcaccctgtacagcagcaagaacctgagacaggcctggaacaagctgagctacgtgaaccacgccgaggacctggccagcaagctgctgcagtgcagccccaagaacagactgagcgcccaggccgccctgagccacgagtacttcagcgacctgccccccagactgtgggagctgaccgacatgagcagcatcttcaccgtgcccaacgtgagactgcagcccgaggccggcgagagcatgagagccttcggcaagaacaacagctacggcaagagcctgagcaacagcaagcactag

SEQ ID NO: 17728 - DNA, 1410 bp, Artificial Sequence
  Description of Artificial Sequence: Synthetic coding sequence
atgtgcgacctgatcgagccccagcccgccgagaagatcggcaagatgaagaagctgagaagaaccctgagcgagagcttcagcagaatcgccctgaagaaggacgacaccaccttcgacgagatctgcgtgaccaagatgagcaccagaaactgccagggcatggacagcgtgatcaagcccctggacaccatccccgaggacaagaaggtgagagtgcagagaacccagagcaccttcgaccccttcgagaagcccgccaaccaggtgaagagagtgcacagcgagaacaacgcctgcatcaacttcaagaccagcagcaccggcaaggagagccccaaggtgagaagacacagcagccccagcagccccaccagccccaagttcggcaaggccgacagctacgagaagctggagaagctgggcgagggcagctacgccaccgtgtacaagggcaagagcaaggtgaacggcaagctggtggccctgaaggtgatcagactgcaggaggaggagggcacccccttcaccgccatcagagaggccagcctgctgaagggcctgaagcacgccaacatcgtgctgctgcacgacatcatccacaccaaggagaccctgaccctggtgttcgagtacgtgcacaccgacctgtgccagtacatggacaagcaccccggcggcctgcaccccgacaacgtgaagctgttcctgttccagctgctgagaggcctgagctacatccaccagagatacatcctgcacagagacctgaagccccagaacctgctgatcagcgacaccggcgagctgaagctggccgacttcggcctggccagagccaagagcgtgcccagccacacctacagcaacgaggtggtgaccctgtggtacagaccccccgacgtgctgctgggcagcaccgagtacagcacctgcctggacatgtggggcgtgggctgcatcttcgtggagatgatccagggcgtggccgccttccccggcatgaaggacatccaggaccagctggagagaatcttcctggtgctgggcacccccaacgaggacacctggcccggcgtgcacagcctgccccacttcaagcccgagagattcaccctgtacagcagcaagaacctgagacaggcctggaacaagctgagctacgtgaaccacgccgaggacctggccagcaagctgctgcagtgcagccccaagaacagactgagcgcccaggccgccctgagccacgagtacttcagcgacctgccccccagactgtgggagctgaccgacatgagcagcatcttcaccgtgcccaacgtgagactgcagcccgaggccggcgagagcatgagagccttcggcaagaacaacagctacggcaagagcctgagcaacagcaagcactag

SEQ ID NO: 17729 - DNA, 1023 bp, Artificial Sequence
  Description of Artificial Sequence: Synthetic coding sequence
atgctggccctgaccctgagacccccccccctggccaagagccacctgaagctgggcggcacccccgcccccgccagagtgaacggcaagctggtggccctgaaggtgatcagactgcaggaggaggagggcacccccttcaccgccatcagagaggccagcctgctgaagggcctgaagcacgccaacatcgtgctgctgcacgacatcatccacaccaaggagaccctgaccctggtgttcgagtacgtgcacaccgacctgtgccagtacatggacaagcaccccggcggcctgcaccccgacaacgtgaagctgttcctgttccagctgctgagaggcctgagctacatccaccagagatacatcctgcacagagacctgaagccccagaacctgctgatcagcgacaccggcgagctgaagctggccgacttcggcctggccagagccaagagcgtgcccagccacacctacagcaacgaggtggtgaccctgtggtacagaccccccgacgtgctgctgggcagcaccgagtacagcacctgcctggacatgtggggcgtgggctgcatcttcgtggagatgatccagggcgtggccgccttccccggcatgaaggacatccaggaccagctggagagaatcttcctggtgctgggcacccccaacgaggacacctggcccggcgtgcacagcctgccccacttcaagcccgagagattcaccctgtacagcagcaagaacctgagacaggcctggaacaagctgagctacgtgaaccacgccgaggacctggccagcaagctgctgcagtgcagccccaagaacagactgagcgcccaggccgccctgagccacgagtacttcagcgacctgccccccagactgtgggagctgaccgacatgagcagcatcttcaccgtgcccaacgtgagactgcagcccgaggccggcgagagcatgagagccttcggcaagaacaacagctacggcaagagcctgagcaacagcaagcactag

SEQ ID NO: 17730 - DNA, 1353 bp, Artificial Sequence
  Description of Artificial Sequence: Synthetic coding sequence
atggaccagtactgcatcctgggcagaatcggcgagggcgcccacggcatcgtgttcaaggccaagcacgtggagaccggcgagatcgtggccctgaagaaggtggccctgagaagactggaggacggcttccccaaccaggccctgagagagatcaaggccctgcaggagatggaggacaaccagtacgtggtgcagctgaaggccgtgttcccccacggcggcggcttcgtgctggccttcgagttcatgctgagcgacctggccgaggtggtgagacacgcccagagacccctggcccaggcccaggtgaagagctacctgcagatgctgctgaagggcgtggccttctgccacgccaacaacatcgtgcacagagacctgaagcccgccaacctgctgatcagcgccagcggccagctgaagatcgccgacttcggcctggccagagtgttcagccccgacggcagcagactgtacacccaccaggtggccaccagaagcgtgggctgcatcatgggcgagctgctgaacggcagccccctgttccccggcaagaacgacatcgagcagctgtgctacgtgctgagaatcctgggcacccccaacccccaggtgtggcccgagctgaccgagctgcccgactacaacaagatcagcttcaaggagcaggtgcccatgcccctggaggaggtgctgcccgacgtgagcccccaggccctggacctgctgggccagttcctgctgtaccccccccaccagagaatcgccgccagcaaggccctgctgcaccagtacttcttcaccgcccccctgcccgcccaccccagcgagctgcccatcccccagagactgggcggccccgcccccaaggcccaccccggccccccccacatccacgacttccacgtggacagacccctggaggtggccgtggagcccagagccgacagcgccctgcaccccggcggcgtgagaagctggccctggagcagactgcccgccccccaggaccacagcgtgcacctgttcctgtgccacctgcccggcttcaccctgcagggcctgcccatggccaccgtgggcccccaccacaccctgcccctgagcccctgcgagggctggagcagaggcagaggccacgtgcccagccaggagtacgagaacatccagagcagcagaggcgacagctggcccgtgctgggcgagccctacctgctgtgcgccaccgacgtgcccatcagaaccgtgagcagcgccgccagccagggcctgcacatgcagaacgacgacgcctgcctgggcgccgcccccgagtgctgcctgctggtgaaggagaagtgcagagagtag

SEQ ID NO: 17731 - DNA, 1041 bp, Artificial Sequence
  Description of Artificial Sequence: Synthetic coding sequence
atggaccagtactgcatcctgggcagaatcggcgagggcgcccacggcatcgtgttcaaggccaagcacgtggagaccggcgagatcgtggccctgaagaaggtggccctgagaagactggaggacggcttccccaaccaggccctgagagagatcaaggccctgcaggagatggaggacaaccagtacgtggtgcagctgaaggccgtgttcccccacggcggcggcttcgtgctggccttcgagttcatgctgagcgacctggccgaggtggtgagacacgcccagagacccctggcccaggcccaggtgaagagctacctgcagatgctgctgaagggcgtggccttctgccacgccaacaacatcgtgcacagagacctgaagcccgccaacctgctgatcagcgccagcggccagctgaagatcgccgacttcggcctggccagagtgttcagccccgacggcagcagactgtacacccaccaggtggccaccagatggtacagagcccccgagctgctgtacggcgccagacagtacgaccagggcgtggacctgtggagcgtgggctgcatcatgggcgagctgctgaacggcagccccctgttccccggcaagaacgacatcgagcagctgtgctacgtgctgagaatcctgggcacccccaacccccaggtgtggcccgagctgaccgagctgcccgactacaacaagatcagcttcaaggagcaggtgcccatgcccctggaggaggtgctgcccgacgtgagcccccaggccctggacctgctgggccagttcctgctgtaccccccccaccagagaatcgccgccagcaaggccctgctgcaccagtacttcttcaccgcccccctgcccgcccaccccagcgagctgcccatcccccagagactgggcggccccgcccccaaggcccaccccggccccccccacatccacgacttccacgtggacagacccctggaggagagcctgctgaaccccgagctgatcagacccttcatcctggagggctag

SEQ ID NO: 17732 - DNA, 1017 bp, Artificial Sequence
  Description of Artificial Sequence: Synthetic coding sequence
atggaccagtactgcatcctgggcagaatcggcgagggcgcccacggcatcgtgttcaaggccaagcacgtggagcccagagtgggctggcagtgcctgcccagcatcctgcagaccggcgagatcgtggccctgaagaaggtggccctgagaagactggaggacggcttccccaaccaggccctgagagagatcaaggccctgcaggagatggaggacaaccagtacgtggtgcagctgaaggccgtgttcccccacggcggcggcttcgtgctggccttcgagttcatgctgagcgacctggccgaggtggtgagacacgcccagagacccctggcccaggcccaggtgaagagctacctgcagatgctgctgaagggcgtggccttctgccacgccaacaacatcgtgcacagagacctgaagcccgccaacctgctgatcagcgccagcggccagctgaagatcgccgacttcggcctggccagagtgttcagccccgacggcagcagactgtacacccaccaggtggccaccagaagcgtgggctgcatcatgggcgagctgctgaacggcagccccctgttccccggcaagaacgacatcgagcagctgtgctacgtgctgagaatcctgggcacccccaacccccaggtgtggcccgagctgaccgagctgcccgactacaacaagatcagcttcaaggagcaggtgcccatgcccctggaggaggtgctgcccgacgtgagcccccaggccctggacctgctgggccagttcctgctgtaccccccccaccagagaatcgccgccagcaaggccctgctgcaccagtacttcttcaccgcccccctgcccgcccaccccagcgagctgcccatcccccagagactgggcggccccgcccccaaggcccaccccggccccccccacatccacgacttccacgtggacagacccctggaggagagcctgctgaaccccgagctgatcagacccttcatcctggagggctag

SEQ ID NO: 17733 - DNA, 732 bp, Artificial Sequence
  Description of Artificial Sequence: Synthetic coding sequence
atggaccagtactgcatcctgggcagaatcggcgagggcgcccacggcatcgtgttcaaggccaagcacgtggagaccggcgagatcgtggccctgaagaaggtggccctgagaagactggaggacggcttccccaaccaggccctgagagagatcaaggccctgcaggagatggaggacaaccagtacgtggtgcagctgaaggccgtgttcccccacggcggcggcttcgtgctggccttcgagttcatgctgagcgacctggccgaggtggtgagacacgcccagagacccctggcccaggcccaggtgaagagctacctgcagatgctgctgaagggcgtggccttctgccacgccaacaacatcgtgcacagagacctgaagcccgccaacctgctgatcagcgccagcggccagctgaagatcgccgacttcggcctggccagagtgttcagccccgacggcagcagactgtacacccaccaggtggccaccagaagcagcctgagctgcagaaccaccaccagaagccccctgagaagcagatgcccctgcccctggagaagatgctgcctgaccagcctgcccagacactggatctgctgggtgaacagcttcagcaccctgctgaccagcgccagccagctgcccagactgagcagcatcagcaccagcagccagctgccctgcctgcccatccacctgagctgcagattcctgagcgtgtag

SEQ ID NO: 17734 - DNA, 978 bp, Artificial Sequence
  Description of Artificial Sequence: Synthetic coding sequence
atggaccagtactgcatcctgggcagaatcggcgagggcgcccacggcatcgtgttcaaggccaagcacgtggagaccggcgagatcgtggccctgaagaaggtggccctgagaagactggaggacggcttccccaaccaggccctgagagagatcaaggccctgcaggagatggaggacaaccagtacgtggtgcagctgaaggccgtgttcccccacggcggcggcttcgtgctggccttcgagttcatgctgagcgacctggccgaggtggtgagacacgcccagagacccctggcccaggcccaggtgaagagctacctgcagatgctgctgaagggcgtggccttctgccacgccaacaacatcgtgcacagagacctgaagcccgccaacctgctgatcagcgccagcggccagctgaagatcgccgacttcggcctggccagagtgttcagccccgacggcagcagactgtacacccaccaggtggccaccagaagcgtgggctgcatcatgggcgagctgctgaacggcagccccctgttccccggcaagaacgacatcgagcagctgtgctacgtgctgagaatcctgggcacccccaacccccaggtgtggcccgagctgaccgagctgcccgactacaacaagatcagcttcaaggagcaggtgcccatgcccctggaggaggtgctgcccgacgtgagcccccaggccctggacctgctgggccagttcctgctgtaccccccccaccagagaatcgccgccagcaaggccctgctgcaccagtacttcttcaccgcccccctgcccgcccaccccagcgagctgcccatcccccagagactgggcggccccgcccccaaggcccaccccggccccccccacatccacgacttccacgtggacagacccctggaggagagcctgctgaaccccgagctgatcagacccttcatcctggagggctag

SEQ ID NO: 17735 - DNA, 465 bp, Artificial Sequence
  Description of Artificial Sequence: Synthetic coding sequence
atggacgcccccagactgcccgtgagacccggcgtgctgctgcccaagctggtgctgctgttcgtgtacgccgacgactgcctggcccagtgcggcaaggactgcaagagctactgctgcgacggcaccaccccctactgctgcagctactacgcctacatcggcaacatcctgagcggcaccgccatcgccggcatcgtgttcggcatcgtgttcatcatgggcgtgatcgccggcatcgccatctgcatctgcatgtgcatgaagaaccacagagccaccagagtgggcatcctgagaaccacccacatcaacaccgtgagcagctaccccggcccccccccctacggccacgaccacgagatggagtactgcgccgacctgccccccccctacagccccaccccccagggccccgcccagagaagccccccccccccctaccccggcaacgccagaaagtag

SEQ ID NO: 17736 - DNA, 519 bp, Artificial Sequence
  Description of Artificial Sequence: Synthetic coding sequence
atgaagtgcgagcccggctggcccagaacccccgagtggccccccagccccagactgagcgccgtgggcagagacaaggagacctgggcccccagcgccgccagactgggccccagagccccccagctgagaggcgtgccccagagcctggccagagacgcccccggccccggcagcctgggcagactgcccagacagtggcccggcctgtgcagcaccagactgagcggcgccctgctgagccccagcgacagaccccccagcagccccttcccccccgtgcccggcagccccttcgcccccagcctgagaccccccgcctggatggacgcccccagactgcccgtgagacccggcgtgctgctgcccaagctggtgctgctgttcgtgtacgccgacgactgcctggcccagtgcggcaaggactgcaagagctactgctgcgacggcaccaccccctactgctgcagctactacgcctacatcggcaacatcctgagctgctgctgccccagatag

SEQ ID NO: 17737 - DNA, 675 bp, Artificial Sequence
  Description of Artificial Sequence: Synthetic coding sequence
atgagcatcctgctgcccaacatggccgagttcgacaccatcagcgagctggaggaggaggaggaggaggaggccgccaccagcagcagcagccccagcagcagcagcagcgtgagcggccccgacgacgacgaggaggacgaggaggaggaggaggaggaggaggaggaggaggaggaggaggaggaggaggaggaggaggaggccccccccccccccagagtggtgagcgaggagcacctgagaagatacgcccccgaccccgtgctggtgagaggcgccggccacatcaccgtgttcggcctgagcaacaagttcgacaccgagttccccagcgtgctgaccggcaaggtggcccccgaggagttcaagaccagcatcggcagagtgaacgcctgcctgaagaaggccctgcccgtgaacgtgaagtggctgctgtgcggctgcctgtgctgctgctgcaccctgggctgcagcctgtggcccgtgatctgcctgaacaagagaaccagaagaagcatccagaagctgatcgagtgggagaacaacagactgtaccacaagctggccctgcactggaagctgaccaagagaaagtgcgagaccagcaacatgatggagtacgtgatcctgatcgagttcctgcccaagtaccccatcttcagacccgactag

SEQ ID NO: 17738 - DNA, 615 bp, Artificial Sequence
  Description of Artificial Sequence: Synthetic coding sequence
atgagcatcctgctgcccaacatggccgagttcgacaccatcagcgagctggaggaggaggaggaggaggaggccgccaccagcagcagcagccccagcagcagcagcagcgtgagcggccccgacgacgacgaggaggacgaggaggaggaggaggaggaggaggaggaggaggaggaggaggaggaggaggaggaggaggaggccccccccccccccagagtggtgagcgaggagcacctgagaagatacgcccccgaccccgtgctggtgagaggcgccggccacatcaccgtgttcggcctgagcaacaagttcgacaccgagttccccagcgtgctgaccggcaaggtggcccccgaggagttcaagaccagcatcggcagagtgaacgcctgcctgaagaaggccctgcccgtgaacgtgaagtggctgctgtgcggctgcctgtgctgctgctgcaccctgggctgcagcctgtggcccgtgatctgcctgaacaagagaaccagaagaagcatccagaagctgatcgagtgggagaacaacagactgtaccacaaggtgatcctgatcgagttcctgcccaagtaccccatcttcagacccgactag

SEQ ID NO: 17739 - DNA, 1341 bp, Artificial Sequence
  Description of Artificial Sequence: Synthetic coding sequence
atgcacgagcccagcctgtgcgccaacgtggagtgcccccccgcccacacctgcccctgcggcgtgcccgcctgcagctgcgcccacgtggagtgcccccccgcccacacctgcagatgcggcgtgcccgcctgcagccacatgcccatgtggagcgccagactgctgaccagagcccacgtggagtgcccccccgcccacaccagagtgcacgtggagtgcccccccgcccacgtgcccatgtggagcgcccacctgctgacctgcgccgacgtggagtgccacctgctgacccacgtgcccatgtggagcgccagactgctgacctgcccctgcggcgtgcccgcctgcagccacgtgcccatgagaagcgccagactgctgaccagagcccacgccgagtgcccccccgcccacacctgcccctgcggcgtgcccgcctgcagccacgtgcccatgagaagcgccagactgctgaccagagccgacgtggagtgcccccccgcccacacctgcccctgcggcgtgcccgcctgcagccacgtgcccacctggagcgccagactgatcaccagagcccacgtggagtgcagccccgcccacacctgcagatgcggcgtgcccgcctgcagccacgtgcccatgtggagcgtgagactgctgaccagagccgacgccgagtgcccccccgcccacacctgcagatgcggcgtgcccgcctgcagccacgtgcccatgtggagcgccagactgctgacctgcagatgcggcgtgcccgcctgcagccacgtgcccatgtggagcgccagactgctgacctgcagatgcggcgtgcccgcctgcagccacgtgcccatgtggagcgccagactgctgaccagagcccacgtggagtgcccccccgcccacacctgcagaagaggcgtgcccgcctgcagcagagcccacatggagtgcccccccgcccacacctgccactgcggcgtgcccgcctgcagccacacctgcagatgcggcgtgcccgcctgcagccacgtgcccatgtggagcgccagactgctgaccagagcccacgtggagtgcccccccgcccacaccagagcccacgtggagtgcccccccgcccacacctgcccctgcggcgtgcccgcctgcagccacacctgcccctgcggcgtgcccgcctgcagccacaaggccctggcctggtggttctgcagattccccgtgctgcccgccgagagcgacgccgtgaccgtgcacagcacccacggcggcttcctgatcagattctacgtgaaggaccccttctacatcagcctgcacctggagatcacctag

SEQ ID NO: 17740 - DNA, 1167 bp, Artificial Sequence
  Description of Artificial Sequence: Synthetic coding sequence
gccaacgtggagtgcccccccgcccacacctgcccctgcggcgtgcccgcctgcagctgcgcccacgtggagtgcccccccgcccacacctgcagatgcggcgtgcccgcctgcagccacatgcccatgtggagcgccagactgctgaccagagcccacgtggagtgcccccccgcccacaccagagtgcacgtggagtgcccccccgcccacgtgcccatgtggagcgcccacctgctgacctgcgccgacgtggagtgccacctgctgacccacgtgcccatgtggagcgccagactgctgaccagagccgacgccgagtgcccccccgcccacacctgcccctgcggcgtgcccgcctgcagccacgtgcccatgagaagcgccagactgctgaccagagcccacgccgagtgcccccccgcccacacctgcagaagaggcgtgcccgcctgcagccacgtgcccatgtggagcgccagactgctgaccagagccgacgccgagtgcccccccgcccacacctgcagatgcggcgtgcccgcctgcagccacgtgcccatgtggagcgccagactgctgacctgcagatgcggcgtgcccgcctgcagccacgtgcccatgtggagcgccagactgctgacctgcagatgcggcgtgcccgcctgcagccacgtgcccatgtggagcgccagactgctgaccagagcccacgtggagtgcccccccgcccacacctgcagaagaggcgtgcccgcctgcagcagagcccacatggagtgcccccccgcccacacctgccactgcggcgtgcccgcctgcagccacacctgcagatgcggcgtgcccgcctgcagccacgtgcccatgtggagcgccagactgctgaccagagcccacgtggagtgcccccccgcccacaccagagcccacgtggagtgcccccccgcccacacctgcccctgcggcgtgcccgcctgcagccacacctgcccctgcggcgtgcccgcctgcagccacaaggccctggcctggtggttctgcagattccccgtgctgcccgccgagagcgacgccgtgaccgtgcacagcacccacggcggcttcctgatcagattctacgtgaaggaccccttctacatcagcctgcacctggagatcacctag

SEQ ID NO: 17741 - DNA, 861 bp, Artificial Sequence
  Description of Artificial Sequence: Synthetic coding sequence
atggccatggagggctactggagattcctggccctgctgggcagcgccctgctggtgggcttcctgagcgtgatcttcgccctggtgtgggtgctgcactacagagagggcctgggctgggacggcagcgccctggagttcaactggcaccccgtgctgatggtgaccggcttcgtgttcatccagggcatcgccatcatcgtgtacagactgccctggacctggaagtgcagcaagctgctgatgaagagcatccacgccggcctgaacgccgtggccgccatcctggccatcatcagcgtggtggccgtgttcgagaaccacaacgtgaacaacatcgccaacatgtacagcctgcacagctgggtgggcctgatcgccgtgatctgctacctgctgcagctgctgagcggcttcagcgtgttcctgctgccctgggcccccctgagcctgagagccttcctgatgcccatccacgtgtacagcggcatcgtgatcttcggcaccgtgatcgccaccgccctgatgggcctgaccgagaagctgatcttcagcctgagagaccccgcctacagcaccttcccccccgagggcgtgttcgtgaacaccctgggcctgctgatcctggtgttcggcgccctgatcttctggatcgtgaccagaccccagtggaagagacccaaggagcccaacagcaccatcctgcaccccaacggcggcaccgagcagggcgccagaggcagcatgcccgcctacagcggcaacaacatggacaagagcgacagcgagctgaacagcgaggtggccgccagaaagagaaacctggccctggacgaggccggccagagaagcaccatgtag

SEQ ID NO: 17742 - DNA, 474 bp, Artificial Sequence
  Description of Artificial Sequence: Synthetic coding sequence
atggccatggagggctactggagattcctggccctgctgggcagcgccctgctggtgggcttcctgagcgtgatcttcgccctggtgtgggtgctgcactacagagagggcctgggctgggacggcagcgccctggagttcaactggcaccccgtgctgatggtgaccggcttcgtgttcatccagggcatcgccagcttcagattcttcagcctgagcgccagcatgggcagcgccttcagccccagcatcagccacgcccacacctgcctgttctggaactgccacctgtggaacagcgactgcaacagcacctacggcatcgacagagagaccgacttcttccccgagagaagctgcatccagtacatccccgccagaagatgcttcagaaagtacgcctggcccagcgaccccggcgtgagaggcccccacttcctggacagccaccagaccgccatggagaccagctag

SEQ ID NO: 17743 - DNA, 687 bp, Artificial Sequence
  Description of Artificial Sequence: Synthetic coding sequence
atgctggacgagggcgaggccatcatcgtgtacagactgccctggacctggaagtgcagcaagctgctgatgaagagcatccacgccggcctgaacgccgtggccgccatcctggccatcatcagcgtggtggccgtgttcgagaaccacaacgtgaacaacatcgccaacatgtacagcctgcacagctgggtgggcctgatcgccgtgatctgctacctgctgcagctgctgagcggcttcagcgtgttcctgctgccctgggcccccctgagcctgagagccttcctgatgcccatccacgtgtacagcggcatcgtgatcttcggcaccgtgatcgccaccgccctgatgggcctgaccgagaagctgatcttcagcctgagagaccccgcctacagcaccttcccccccgagggcgtgttcgtgaacaccctgggcctgctgatcctggtgttcggcgccctgatcttctggatcgtgaccagaccccagtggaagagacccaaggagcccaacagcaccatcctgcaccccaacggcggcaccgagcagggcgccagaggcagcatgcccgcctacagcggcaacaacatggacaagagcgacagcgagctgaacagcgaggtggccgccagaaagagaaacctggccctggacgaggccggccagagaagcaccatgtag

SEQ ID NO: 17744 - DNA, 729 bp, Artificial Sequence
  Description of Artificial Sequence: Synthetic coding sequence
atggtgagcggcagattctacctgagctgcctgctgctgggcagcctgggcagcatgtgcatcctgttcaccatctactggatgcagtactggagaggcggcttcgcctggaacggcagcatctacatgttcaactggcaccccgtgctgatggtggccggcatggtggtgttctacggcggcgccagcctggtgtacagactgccccagagctgggtgggccccaagctgccctggaagctgctgcacgccgccctgcacctgatggccttcgtgctgaccgtggtgggcctggtggccgtgttcaccttccacaaccacggcagaaccgccaacctgtacagcctgcacagctggctgggcatcaccaccgtgttcctgttcgcctgccagtggttcctgggcttcgccgtgttcctgctgccctgggccagcatgtggctgagaagcctgctgaagcccatccacgtgttcttcggcgccgccatcctgagcctgagcatcgccagcgtgatcagcggcatcaacgagaagctgttcttcagcctgaagaacaccaccagaccctaccacagcctgcccagcgaggccgtgttcgccaacagcaccggcatgctggtggtggccttcggcctgctggtgctgtacatcctgctggccagcagctggaagagacccgagcccggcatcctgaccgacagacagcccctgctgcacgacggcgagtag

SEQ ID NO: 17745 - DNA, 780 bp, Artificial Sequence
  Description of Artificial Sequence: Synthetic coding sequence
atgggcaagaacttcagcgacagcttcctgagcagagagtgcgtgatcagaatggtgagcggcagattctacctgagctgcctgctgctgggcagcctgggcagcatgtgcatcctgttcaccatctactggatgcagtactggagaggcggcttcgcctggaacggcagcatctacatgttcaactggcaccccgtgctgatggtggccggcatggtggtgttctacggcggcgccagcctggtgtacagactgccccagagctgggtgggccccaagctgccctggaagctgctgcacgccgccctgcacctgatggccttcgtgctgaccgtggtgggcctggtggccgtgttcaccttccacaaccacggcagaaccgccaacctgtacagcctgcacagctggctgggcatcaccaccgtgttcctgttcgcctgccagtggttcctgggcttcgccgtgttcctgctgccctgggccagcatgtggctgagaagcctgctgaagcccatccacgtgttcttcggcgccgccatcctgagcctgagcatcgccagcgtgatcagcggcatcaacgagaagctgttcttcagcctgaagaacaccaccagaccctaccacagcctgcccagcgaggccgtgttcgccaacagcaccggcatgctggtggtggccttcggcctgctggtgctgtacatcctgctggccagcagctggaagagacccgagcccggcatcctgaccgacagacagcccctgctgcacgacggcgagtag

SEQ ID NO: 17746 - DNA, 729 bp, Artificial Sequence; identical to SEQ ID NO: 17744
  Description of Artificial Sequence: Synthetic coding sequence

SEQ ID NO: 17747 - DNA, 549 bp, Artificial Sequence
  Description of Artificial Sequence: Synthetic coding sequence
atggtgagcggcagattctacctgagctgcctgctgctgggcagcctgggcagcatgtgcatcctgttcaccatctactggatgcagtactggagaggcggcttcgcctggaacggcagcatctacatgttcaactggcaccccgtgctgatggtggccggcatggtggtgttctacggcggcgccagcctggtgtacagactgccccagagctgggtgggccccaagctgccctggaagctgctgcacgccgccctgcacctgatggccttcgtgctgaccgtggtgggcctggtggccgtgttcaccttccacaaccacggcagaaccgccaacctgtacagcctgcacagctggctgggcatcaccaccgtgttcctgttcgcctgccagtggttcctgggcttcgccgtgttcctgctgccctgggccagcatgtggctgagaagcctgctgaagcccatccacgtgttcttcggcgccgccatcctgagcctgagcatcgccagcgtgatcagcggcatcaacgagaagctgttcttcagctag

SEQ ID NO: 17748 - DNA, 87 bp, Artificial Sequence
  Description of Artificial Sequence: Synthetic coding sequence
atggtgagcggcagattctacctgagctgcctgctgctgggcagcctgggcagcatgtgcatcctgttcaccatctactggatgtag

SEQ ID NO: 17749 - DNA, 348 bp, Artificial Sequence
  Description of Artificial Sequence: Synthetic coding sequence
atggtgagcggcagattctacctgagctgcctgctgctgggcagcctgggcagcatgtgcatcctgttcaccatctactggatgcagtactggagaggcggcttcgcctggaacggcagcatctacatgttcaactggcaccccgtgctgatggtggccggcatggtggtgttctacggcggcgccagcctggtgtacagactgccccagagctgggtgggccccaagctgccctggaagctgctgcacgccgccctgcacctgatggccttcgtgctgaccgtggtgggcctggtggccgtgttcaccttccacaaccacggcagaaccgccaacctgtacagctag

SEQ ID NO: 17750 - DNA, 603 bp, Artificial Sequence
  Description of Artificial Sequence: Synthetic coding sequence
atggtgagcggcagattctacctgagctgcctgctgctgggcagcctgggcagcatgtgcatcctgttcaccatctactggatgcagtactggagaggcggcttcgcctggaacggcagcatctacatgttcaactggcaccccgtgctgatggtggccggcatggtggtgttctacggcggcgccagcctggtgtacagactgccccagagctgggtgggccccaagctgccctggaagctgctgcacgccgccctgcacctgatggccttcgtgctgaccgtggtgggcctggtggccgtgttcaccttccacaaccacggcagaaccgccaacctgtacagcctgcacagctggctgggcatcaccaccgtgttcctgttcgcctgccagtggttcctgggcttcgccgtgttcctgctgccctgggccagcatgtggctgagaagcctgctgaagcccatccacgtgttcttcggcgccgccatcctgagcctgagcatcgccagcgtgatcagcggcatcaacgagaagctgttcttcagcctgaagaacaccaccagaccctaccacagcctgcccagcgaggccgtgttcgcctag

SEQ ID NO: 17751 - DNA, 168 bp, Artificial Sequence
  Description of Artificial Sequence: Synthetic coding sequence
atggtgagcggcagattctacctgagctgcctgctgctgggcagcctgggcagcatgtgcatcctgttcaccatctactggatgcagtactggagaggcggcttcgcctggaacggcagcatctacatgttcaactggcaccccgtgctgatggtggccggcatgtag

SEQ ID NO: 17752 - DNA, 918 bp, Artificial Sequence
  Description of Artificial Sequence: Synthetic coding sequence
atgggcatccagaccagccccgtgctgctggccagcctgggcgtgggcctggtgaccctgctgggcctggccgtgggcagctacctggtgagaagaagcagaagaccccaggtgaccctgctggaccccaacgagaagtacctgctgagactgctggacaagaccaccgtgagccacaacaccaagagattcagattcgccctgcccaccgcccaccacaccctgggcctgcccgtgggcaagcacatctacctgagcaccagaatcgacggcagcctggtgatcagaccctacacccccgtgaccagcgacgaggaccagggctacgtggacctggtgatcaaggtgtacctgaagggcgtgcaccccaagttccccgagggcggcaagatgagccagtacctggacagcctgaaggtgggcgacgtggtggagttcagaggccccagcggcctgctgacctacaccggcaagggccacttcaacatccagcccaacaagaagagcccccccgagcccagagtggccaagaagctgggcatgatcgccggcggcaccggcatcacccccatgctgcagctgatcagagccatcctgaaggtgcccgaggaccccacccagtgcttcctgctgttcgccaaccagaccgagaaggacatcatcctgagagaggacctggaggagctgcaggccagataccccaacagattcaagctgtggttcaccctggaccacccccccaaggactgggcctacagcaagggcttcgtgaccgccgacatgatcagagagcacctgcccgcccccggcgacgacgtgctggtgctgctgtgcggccccccccccatggtgcagctggcctgccaccccaacctggacaagctgggctacagccagaagatgagattcacctactag

SEQ ID NO: 17753 - DNA, 681 bp, Artificial Sequence
  Description of Artificial Sequence: Synthetic coding sequence
tgaaccgcccaccacaccctgggcctgcccgtgggcaagcacatctacctgagcaccagaatcgacggcagcctggtgatcagaccctacacccccgtgaccagcgacgaggaccagggctacgtggacctggtgatcaaggtgtacctgaagggcgtgcaccccaagttccccgagggcggcaagatgagccagtacctggacagcctgaaggtgggcgacgtggtggagttcagaggccccagcggcctgctgacctacaccggcaagggccacttcaacatccagcccaacaagaagagcccccccgagcccagagtggccaagaagctgggcatgatcgccggcggcaccggcatcacccccatgctgcagctgatcagagccatcctgaaggtgcccgaggaccccacccagtgcttcctgctgttcgccaaccagaccgagaaggacatcatcctgagagaggacctggaggagctgcaggccagataccccaacagattcaagctgtggttcaccctggaccacccccccaagggcatcctgcccatcagcggccaccccaccatccccagcagcagcaagagcaagccctgccccttcgtgaacagcggcttcatcgagatcaacctggccagccactgccagctgggcagcctgagcgcccagacccagtag

SEQ ID NO: 17754 - DNA, 402 bp, Artificial Sequence
  Description of Artificial Sequence: Synthetic coding sequence
atgcagcccctggaggtgggcctggtgcccgcccccgccggcgagcccagactgaccagatggctgagaagaggcagcggcatcctggcccacctggtggccctgggcttcaccatcttcctgaccgccctgagcagacccggcaccaagaccggccccctgatggaggacagaagcgagggcggcagagccagatgggtgatgcccgagatccccgccctgtgggaggccgacgccggcggcagcctggaggtgttcagccccggcaccctgtacagctggccctggagaagcgccagcgcctggctgaagcccagctacagcagccacctgaacaccccctgcagcagcagcgcccccgagaagcacggcagcggcagcaccggccagggcagaccctag

SEQ ID NO: 17755 - DNA, 756 bp, Artificial Sequence
  Description of Artificial Sequence: Synthetic coding sequence
atgcagcccctggaggtgggcctggtgcccgcccccgccggcgagcccagactgaccagatggctgagaagaggcagcggcatcctggcccacctggtggccctgggcttcaccatcttcctgaccgccctgagcagacccggcaccaagaccggccccctgatggaggacagaagcgagggcggcagagccagatgggtgatgcccgagatccccgccctgtgggaggccgacgccggcggcagcctggagttctgcctgtgcatggccgaggccatcctgctgttcagccccgagcacagcctgttcttcttctgcagcagaaaggccagaatcagactgcactgggccggccagaccctggccatcctgtgcgccgccctgggcctgggcttcatcatcagcagcagaaccagaagcgagctgccccacctggtgagctggcacagctgggtgggcgccctgaccctgctggccaccgccgtgcaggccctgtgcggcctgtgcctgctgtgccccagagccgccagagtgagcagagtggccagactgaagctgtaccacctgacctgcggcctggtggtgtacctgatggccaccgtgaccgtgctgctgggcatgtacagcgtgtggttccaggcccagatcaagggcgccgcctggtacctgtgcctggccctgcccgtgtaccccgccctggtgatcatgcaccagatcagcagaagctacctgcccagaaagaagatggagatgtag

SEQ ID NO: 17756 - DNA, 519 bp, Artificial Sequence
  Description of Artificial Sequence: Synthetic coding sequence
atgcagcccctggagttctgcctgtgcatggccgaggccatcctgctgttcagccccgagcacagcctgttcttcttctgcagcagaaaggccagaatcagactgcactgggccggccagaccctggccatcctgtgcgccgccctgggcctgggcttcatcatcagcagcagaaccagaagcgagctgccccacctggtgagctggcacagctgggtgggcgccctgaccctgctggccaccgccgtgcaggccctgtgcggcctgtgcctgctgtgccccagagccgccagagtgagcagagtggccagactgaagctgtaccacctgacctgcggcctggtggtgtacctgatggccaccgtgaccgtgctgctgggcatgtacagcgtgtggttccaggcccagatcaagggcgccgcctggtacctgtgcctggccctgcccgtgtaccccgccctggtgatcatgcaccagatcagcagaagctacctgcccagaaagaagatggagatgtag

SEQ ID NO: 17757 - DNA, 690 bp, Artificial Sequence
  Description of Artificial Sequence: Synthetic coding sequence
atgcagcccctggaggtgggcctggtgcccgcccccgccggcgagcccagactgaccagatggctgagaagaggcagcggcatcctggcccacctggtggccctgggcttcaccatcttcctgaccgccctgagcagacccggcaccagcctgttcagctggcaccccgtgttcatggccctggccttctgcctgtgcatggccgaggccatcctgctgttcagccccgagcacagcctgttcttcttctgcagcagaaaggccagaatcagactgcactgggccggccagaccctggccatcctgtgcgccgccctgggcctgggcttcatcatcagcagcagaaccagaagcgagctgccccacctggtgagctggcacagctgggtgggcgccctgaccctgctggccaccgccgtgcaggccctgtgcggcctgtgcctgctgtgccccagagccgccagagtgagcagagtggccagactgaagctgtaccacctgacctgcggcctggtggtgtacctgatggccaccgtgaccgtgctgctgggcatgtacagcgtgtggttccaggcccagatcaagggcgccgcctggtacctgtgcctggccctgcccgtgtaccccgccctggtgatcatgcaccagatcagcagaagctacctgcccagaaagaagatggagatgtag

SEQ ID NO: 17758 - DNA, 387 bp, Artificial Sequence
  Description of Artificial Sequence: Synthetic coding sequence
atgcagcccctggaggtgggcctggtgcccgcccccgccggcgagcccagactgaccagatggctgagaagaggcagcggcatcctggcccacctggtggccctgggcttcaccatcttcctgaccgccctgagcagacccggcaccaagaccggccccctgatggaggacagaagcgagggcggcagagccagatgggtgatgcccgagatccccgccctgtgggaggccgacgccggcggcagcctggaggtgttcagccccggcaccctgtacagctggccctggagaatgtacgagagcaccagcttcttcagcggcctgcaggccagacacgaggcctactggctgagccccatgttcaccgtgctgcccctgcacggctag

SEQ ID NO: 17759 - DNA, 225 bp, Artificial Sequence
  Description of Artificial Sequence: Synthetic coding sequence
atgcccaagtactacgaggacaagccccagggcggcgcctgcgccggcctgaaggaggacctgggcgcctgcctgctgcagagcgactgcgtggtgcaggagggcaagagccccagacagtgcctgaaggagggctactgcaacagcctgaagtacgccttcttcgagtgcaagagaagcgtgctggacaacagagccagattcagaggcagaaagggctactag

SEQ ID NO: 17760 - DNA, 330 bp, Artificial Sequence
  Description of Artificial Sequence: Synthetic coding sequence
atggccgccgtgggcgtgttcagcgtgagcagactgctgggcagaagcagaccccagctgggcagacccatgagcagcggcgcccacggcgaggagggcagcgccagaatgtggaagaccctgaccttcttcgtggccctgcccggcgtggccgtgagcatgctgaacgtgtacctgaagagccaccacggcgagcacgagagacccgagttcatcgcctacccccacctgagaatcagaaccaagcccttcccctggggcgacggcaaccacaccctgttccacaacccccacgtgaaccccctgcccaccggctacgaggacgagtag

SEQ ID NO: 17761 - DNA, 294 bp, Artificial Sequence
  Description of Artificial Sequence: Synthetic coding sequence
atggccctgcccctgagacccctgaccagaggcctggccagcgccgccaagggcggccacggcggcgccggcgccagaacctggagactgctgaccttcgtgctggccctgcccagcgtggccctgtgcaccttcaacagctacctgcacagcggccacagacccagacccgagttcagaccctaccagcacctgagaatcagaaccaagccctacccctggggcgacggcaaccacaccctgttccacaacagccacgtgaaccccctgcccaccggctacgagcacccctag

SEQ ID NO: 17762 - DNA, 267 bp, Artificial Sequence
  Description of Artificial Sequence: Synthetic coding sequence
atgctggacgtggaggcccaggagccccccaagggcaagtggagcaccccccccttcgaccccagattccccagccagaaccagatcagaaactgctaccagaacttcctggactaccacagatgcctgaagaccagaaccagaagaggcaagagcacccagccctgcgagtactacttcagagtgtaccacagcctgtgccccatcagctgggtggagagctggaacgagcagatcaagaacggcatcttcgccggcaagatctag

SEQ ID NO: 17763 - DNA, 243 bp, Artificial Sequence
  Description of Artificial Sequence: Synthetic coding sequence
atgttccccctggtgaagagcgccctgaacagactgcaggtgagaagcatccagcagaccatggccagacagagccaccagaagagaacccccgacttccacgacaagtacggcaacgccgtgctggccagcggcgccaccttctgcatcgtgacctggacctacgtggccacccaggtgggcatcgagtggaacctgagccccgtgggcagagtgacccccaaggagtggagaaaccagtag

SEQ ID NO: 17764 - DNA, 210 bp, Artificial Sequence
  Description of Artificial Sequence: Synthetic coding sequence
atgagcgtgctgacccccctgctgctgagaggcctgaccggcagcgccagaagactgcccgtgcccagagccaagatccacagcctgccccccgagggcaagctgggcatcatggagctggccgtgggcctgaccagctgcttcgtgaccttcctgctgcccgccggctggatcctgagccacctggagacctacagaagacccgagtag

SEQ ID NO: 17765 - DNA, 219 bp, Artificial Sequence
  Description of Artificial Sequence: Synthetic coding sequence
atgcccctgctgagaggcagatgccccgccagaagacactacagaagactggccctgctgggcctgcagcccgcccccagattcgcccacagcggcccccccagacagagacccctgagcgccgccgagatggccgtgggcctggtggtgttcttcaccaccttcctgacccccgccgcctacgtgctgggcaacctgaagcagttcagaagaaactag

SEQ ID NO: 17766 - DNA, 1092 bp, Artificial Sequence
  Description of Artificial Sequence: Synthetic coding sequence
atggcccccgaggccaccaagaacttcctgcccctgctggacgccgtgagcagagacttcgtgagcgtgctgcacagaagaatcaagaaggccggcagcggcaactacagcggcgacatcagcgacgacctgttcagattcgccttcgagagcatcaccaacgtgatcttcggcgagagacagggcatgctggaggaggtggtgaaccccgaggcccagagattcatcgacgccatctaccagatgttccacaccagcgtgcccatgctgaacctgccccccgacctgttcagactgttcagaaccaagacctggaaggaccacgtggccgcctgggacgtgatcttcagcaaggccgacatctacacccagaacttctactgggagctgagacagaagggcagcgtgcaccacgactacagaggcatcctgtacagactgctgggcgacagcaagatgagcttcgaggacatcaaggccaacgtgaccgagatgctggccggcggcgtggacaccaccagcatgaccctgcagtggcacctgtacgagatggccagaaacctgaaggtgcaggacatgctgagagccgaggtgctggccgccagacaccaggcccagggcgacatggccaccatgctgcagctggtgcccctgctgaaggccagcatcaaggagaccctgagactgcaccccatcagcgtgaccctgcagagatacctggtgaacgacctggtgctgagagactacatgatccccgccaagaccctggtgcaggtggccatctacgccctgggcagagagcccaccttcttcttcgaccccgagaacttcgaccccaccagatggctgagcaaggacaagaacatcacctacttcagaaacctgggcttcggctggggcgtgagacagtgcctgggcagaagaatcgccgagctggagatgaccatcttcctgatcaacatgctggagaacttcagagtggagatccagcacctgagcgacgtgggcaccaccttcaacctgatcctgatgcccgagaagcccatcagcttcaccttctggcccttcaaccaggaggccacccagcagtag

SEQ ID NO: 17767 - DNA, 1566 bp, Artificial Sequence
  Description of Artificial Sequence: Synthetic coding sequence
atgctggccaagggcctgccccccagaagcgtgctggtgaagggctgccagaccttcctgagcgcccccagagagggcctgggcagactgagagtgcccaccggcgagggcgccggcatcagcaccagaagccccagacccttcaacgagatccccagccccggcgacaacggctggctgaacctgtaccacttctggagagagaccggcacccacaaggtgcacctgcaccacgtgcagaacttccagaagtacggccccatctacagagagaagctgggcaacgtggagagcgtgtacgtgatcgaccccgaggacgtggccctgctgttcaagagcgagggccccaaccccgagagattcctgatccccccctgggtggcctaccaccagtactaccagagacccatcggcgtgctgctgaagaagagcgccgcctggaagaaggacagagtggccctgaaccaggaggtgatggcccccgaggccaccaagaacttcctgcccctgctggacgccgtgagcagagacttcgtgagcgtgctgcacagaagaatcaagaaggccggcagcggcaactacagcggcgacatcagcgacgacctgttcagattcgccttcgagagcatcaccaacgtgatcttcggcgagagacagggcatgctggaggaggtggtgaaccccgaggcccagagattcatcgacgccatctaccagatgttccacaccagcgtgcccatgctgaacctgccccccgacctgttcagactgttcagaaccaagacctggaaggaccacgtggccgcctgggacgtgatcttcagcaaggccgacatctacacccagaacttctactgggagctgagacagaagggcagcgtgcaccacgactacagaggcatcctgtacagactgctgggcgacagcaagatgagcttcgaggacatcaaggccaacgtgaccgagatgctggccggcggcgtggacaccaccagcatgaccctgcagtggcacctgtacgagatggccagaaacctgaaggtgcaggacatgctgagagccgaggtgctggccgccagacaccaggcccagggcgacatggccaccatgctgcagctggtgcccctgctgaaggccagcatcaaggagaccctgagactgcaccccatcagcgtgaccctgcagagatacctggtgaacgacctggtgctgagagactacatgatccccgccaagaccctggtgcaggtggccatctacgccctgggcagagagcccaccttcttcttcgaccccgagaacttcgaccccaccagatggctgagcaaggacaagaacatcacctacttcagaaacctgggcttcggctggggcgtgagacagtgcctgggcagaagaatcgccgagctggagatgaccatcttcctgatcaacatgctggagaacttcagagtggagatccagcacctgagcgacgtgggcaccaccttcaacctgatcctgatgcccgagaagcccatcagcttcaccttctggcccttcaaccaggaggccacccagcagtag

SEQ ID NO: 17768 - DNA, 1092 bp, Artificial Sequence; identical to SEQ ID NO: 17766
  Description of Artificial Sequence: Synthetic coding sequence

SEQ ID NO: 17769 - DNA, 1245 bp, Artificial Sequence
  Description of Artificial Sequence: Synthetic coding sequence
atgctggccaagggcctgccccccagaagcgtgctggtgaagggctgccagaccttcctgagcgcccccagagagggcctgggcagactgagagtgcccaccggcgagggcgccggcatcagcaccagaagccccagacccttcaacgagatccccagccccggcgacaacggctggctgaacctgtaccacttctggagagagaccggcacccacaaggtgcacctgcaccacgtgcagaacttccagaagtacggccccatctacagagagaagctgggcaacgtggagagcgtgtacgtgatcgaccccgaggacgtggccctgctgttcaagagcgagggccccaaccccgagagattcctgatccccccctgggtggcctaccaccagtactaccagagacccatcggcgtgctgctgaagaagagcgccgcctggaagaaggacagagtggccctgaaccaggaggtgatggcccccgaggccaccaagaacttcctgcccctgctggacgccgtgagcagagacttcgtgagcgtgctgcacagaagaatcaagaaggccggcagcggcaactacagcggcgacatcagcgacgacctgttcagattcgccttcgagagcatcaccaacgtgatcttcggcgagagacagggcatgctggaggaggtggtgaaccccgaggcccagagattcatcgacgccatctaccagatgttccacaccagcgtgcccatgctgaacctgccccccgacctgttcagactgttcagaaccaagacctggaaggaccacgtggccgcctgggacgtgatcttcagcaaggccgacatctacacccagaacttctactgggagctgagacagaagggcagcgtgcaccacgactacagaggcatcctgtacagactgctgggcgacagcaagatgagcttcgaggacatcaaggccaacgtgaccgagatgctggccggcggcgtggacaccaccagcatgaccctgcagtggcacctgtacgagatggccagaaacctgaaggtgcaggacatgctgagagccgaggtgctggccgccagacaccaggcccagggcgacatggccaccatgctgcagctggtgcccctgctgaaggccagcatcaaggagaccctgagacactggtgcaagtggcccagcatgctgtgggccgagagcccccccagcagcagcaccagaaagatcctgacccagcccgacggctag

SEQ ID NO: 17770 - DNA, 861 bp, Artificial Sequence
  Description of Artificial Sequence: Synthetic coding sequence
atgcccagcaccagatgcagcacccccgccagcccctgcagcaccttcccccagacctgcagcgtgtgcagcggccccagacccaaggaccacgtggccgcctgggacgtgatcttcagcaaggccgacatctacacccagaacttctactgggagctgagacagaagggcagcgtgcaccacgactacagaggcatcctgtacagactgctgggcgacagcaagatgagcttcgaggacatcaaggccaacgtgaccgagatgctggccggcggcgtggacaccaccagcatgaccctgcagtggcacctgtacgagatggccagaaacctgaaggtgcaggacatgctgagagccgaggtgctggccgccagacaccaggcccagggcgacatggccaccatgctgcagctggtgcccctgctgaaggccagcatcaaggagaccctgagactgcaccccatcagcgtgaccctgcagagatacctggtgaacgacctggtgctgagagactacatgatccccgccaagaccctggtgcaggtggccatctacgccctgggcagagagcccaccttcttcttcgaccccgagaacttcgaccccaccagatggctgagcaaggacaagaacatcacctacttcagaaacctgggcttcggctggggcgtgagacagtgcctgggcagaagaatcgccgagctggagatgaccatcttcctgatcaacatgctggagaacttcagagtggagatccagcacctgagcgacgtgggcaccaccttcaacctgatcctgatgcccgagaagcccatcagcttcaccttctggcccttcaaccaggaggccacccagcagtag

SEQ ID NO: 17771 - DNA, 435 bp, Artificial Sequence
  Description of Artificial Sequence: Synthetic coding sequence
atgctggccaagggcctgccccccagaagcgtgctggtgaagggctgccagaccttcctgagcgcccccagagagggcctgggcagactgagagtgcccaccggcgagggcgccggcatcagcaccagaagccccagacccttcaacgagatccccagccccggcgacaacggctggctgaacctgtaccacttctggagagagaccggcacccacaaggtgcacctgcaccacgtgcagaacttccagaagtacggccccatctacagagagaagctgggcaacgtggagagcgtgtacgtgatcgaccccgaggacgtggccctgctgttcaagagcgagggccccaaccccgagagattcctgatccccccctgggtggcctaccaccagtactaccagagacccatcggcgtgctgctgaaccaccactag

SEQ ID NO: 17772 - DNA, 1473 bp, Artificial Sequence
  Description of Artificial Sequence: Synthetic coding sequence
atggaccccgccgtggccctggtgctgtgcctgagctgcctgttcctgctgagcctgtggagacagagcagcggcagaggcagactgcccagcggccccacccccctgcccatcatcggcaacatcctgcagctggacgtgaaggacatgagcaagagcctgaccaacttcagcaaggtgtacggccccgtgttcaccgtgtacttcggcctgaagcccatcgtggtgctgcacggctacgaggccgtgaaggaggccctgatcgaccacggcgaggagttcagcggcagaggcagcttccccgtggccgagaaggtgaacaagggcctgggcatcctgttcagcaacggcaagagatggaaggagatcagaagattctgcctgatgaccctgagaaacttcggcatgggcaagagaagcatcgaggacagagtgcaggaggaggccagatgcctggtggaggagctgagaaagaccaacgccagcccctgcgaccccaccttcatcctgggctgcgccccctgcaacgtgatctgcagcgtgatcttccacgacagattcgactacaaggaccagagattcctgaacctgatggagaagttcaacgagaacctgagaatcctgagcagcccctggatccaggtgtgcaacaacttccccgccctgatcgactacctgcccggcagccacaacaagatcgccgagaacttcgcctacatcaagagctacgtgctggagagaatcaaggagcaccaggagagcctggacatgaacagcgccagagacttcatcgactgcttcctgatcaagatggagcaggagaagcacaaccagcagagcgagttcaccgtggagagcctgatcgccaccgtgaccgacatgttcggcgccggcaccgagaccaccagcaccaccctgagatacggcctgctgctgctgctgaagtaccccgaggtgaccgccaaggtgcaggaggagatcgagtgcgtggtgggcagaaacagaagcccctgcatgcaggacagaagccacatgccctacaccgacgccgtggtgcacgagatccagagatacatcgacctgctgcccaccaacctgccccacgccgtgacctgcgacgtgaagttcaagaactacctgatccccaagggcaccaccatcatcaccagcctgaccagcgtgctgcacaacgacaaggagttccccaaccccgagatgttcgaccccggccacttcctggacaagagcggcaacttcaagaagagcgactacttcatgcccttcagcgccggcaagagaatgtgcatgggcgagggcctggccagaatggagctgttcctgttcctgaccaccatcctgcagaacttcaacctgaagagccaggtggaccccaaggacatcgacatcacccccatcgccaacgccttcggcagagtgccccccctgtaccagctgtgcttcatccccgtgtag

SEQ ID NO: 17773 - DNA, 1296 bp, Artificial Sequence
  Description of Artificial Sequence: Synthetic coding sequence
atggaccccgccgtggccctggtgctgtgcctgagctgcctgttcctgctgagcctgtggagacagagcagcggcagaggcagactgcccagcggccccacccccctgcccatcatcggcaacatcctgcagctggacgtgaaggacatgagcaagagcctgaccaacttcagcaaggtgtacggccccgtgttcaccgtgtacttcggcctgaagcccatcgtggtgctgcacggctacgaggccgtgaaggaggccctgatcgaccacggcgaggagttcagcggcagaggcagcttccccgtggccgagaaggtgaacaagggcctgggcatcctgttcagcaacggcaagagatggaaggagatcagaagattctgcctgatgaccctgagaaacttcggcatgggcaagagaagcatcgaggacagagtgcaggaggaggccagatgcctggtggaggagctgagaaagaccaacgccagcccctgcgaccccaccttcatcctgggctgcgccccctgcaacgtgatctgcagcgtgatcttccacgacagattcgactacaaggaccagagattcctgaacctgatggagaagttcaacgagaacctgagaatcctgagcagcccctggatccaggagaagcacaaccagcagagcgagttcaccgtggagagcctgatcgccaccgtgaccgacatgttcggcgccggcaccgagaccaccagcaccaccctgagatacggcctgctgctgctgctgaagtaccccgaggtgaccgccaaggtgcaggaggagatcgagtgcgtggtgggcagaaacagaagcccctgcatgcaggacagaagccacatgccctacaccgacgccgtggtgcacgagatccagagatacatcgacctgctgcccaccaacctgccccacgccgtgacctgcgacgtgaagttcaagaactacctgatccccaagggcaccaccatcatcaccagcctgaccagcgtgctgcacaacgacaaggagttccccaaccccgagatgttcgaccccggccacttcctggacaagagcggcaacttcaagaagagcgactacttcatgcccttcagcgccggcaagagaatgtgcatgggcgagggcctggccagaatggagctgttcctgttcctgaccaccatcctgcagaacttcaacctgaagagccaggtggaccccaaggacatcgacatcacccccatcgccaacgccttcggcagagtgccccccctgtaccagctgtgcttcatccccgtgtag

SEQ ID NO: 17774 - DNA, 1473 bp, Artificial Sequence
  Description of Artificial Sequence: Synthetic coding sequence
atggccctgctgctgctgctgttcctgggcctgctgggcctgtggggcctgctgtgcgcctgcgcccaggaccccagccccgccgccagatggccccccggccccagacccctgcccctggtgggcaacctgcacctgctgagactgagccagcaggacagaagcctgatggagctgagcgagagatacggccccgtgttcaccgtgcacctgggcagacagaagaccgtggtgctgaccggcttcgaggccgtgaaggaggccctggccggccccggccaggagctggccgacagaccccccatcgccatcttccagctgatccagagaggcggcggcatcttcttcagcagcggcgccagatggagagccgccagacagttcaccgtgagagccctgcacagcctgggcgtgggcagagagcccgtggccgacaagatcctgcaggagctgaagtgcctgagcggccagctggacggctacagaggcagacccttccccctggccctgctgggctgggcccccagcaacatcaccttcgccctgctgttcggcagaagattcgactacagagaccccgtgttcgtgagcctgctgggcctgatcgacgaggtgatggtgctgctgggcagccccggcctgcagctgttcaacgtgtacccctggctgggcgccctgctgcagctgcacagacccgtgctgagaaagatcgaggaggtgagagccatcctgagaaccctgctggaggccagaagaccccacgtgtgccccggcgaccccgtgtgcagctacgtggacgccctgatccagcagggccagggcgacgaccccgagggcctgttcgccgaggccaacgccgtggcctgcaccctggacatggtgatggccggcaccgagaccaccagcgccaccctgcagtgggccgccctgctgatgggcagacaccccgacgtgcagggcagagtgcaggaggagctggacagagtgctgggccccggcagaacccccagactggaggaccagcaggccctgccctacaccagcgccgtgctgcacgaggtgcagagattcatcaccctgctgccccacgtgcccagatgcaccgccgccgacacccagctgggcggcttcctgctgcccaagggcacccccgtgatccccctgctgaccagcgtgctgctggacgagacccagtggcagacccccggccagttcaaccccggccacttcctggacgccaacggccacttcgtgaagagagaggccttcctgcccttcagcgccggcagaagagtgtgcgtgggcgagagactggccagaaccgagctgttcctgctgttcgccggcctgctgcagagatacagactgctgcccccccccggcgtgagccccgccagcctggacaccacccccgccagagccttcaccatgagacccagagcccaggccctgtgcgccgtgcccagaccctag

SEQ ID NO: 17775 - DNA, 1389 bp, Artificial Sequence
  Description of Artificial Sequence: Synthetic coding sequence
atgctggacttcgccatcttcgccgtgaccttcctgctggccctggtgggcgccgtgctgtacctgtaccccgccagcagacaggccgccggcatccccggcatcacccccaccgaggagaaggacggcaacctgcccgacatcgtgaacagcggcagcctgcacgagttcctggtgaacctgcacgagagatacggccccgtggtgagcttctggttcggcagaagactggtggtgagcctgggcaccgtggacgtgctgaagcagcacatcaaccccaacaagaccagcgaccccttcgagaccatgctgaagagcctgctgagataccagagcggcggcggcagcgtgagcgagaaccacatgagaaagaagctgtacgagaacggcgtgaccgacagcctgaagagcaacttcgccctgctgctgaagctgagcgaggagctgctggacaagtggctgagctaccccgagacccagcacgtgcccctgagccagcacatgctgggcttcgccatgaagagcgtgacccagatggtgatgggcagcaccttcgaggacgaccaggaggtgatcagattccagaagaaccacggcaccgtgtggagcgagatcggcaagggcttcctggacggcagcctggacaagaacatgaccagaaagaagcagtacgaggacgccctgatgcagctggagagcgtgctgagaaacatcatcaaggagagaaagggcagaaacttcagccagcacatcttcatcgacagcctggtgcagggcaacctgaacgaccagcagatcctggaggacagcatgatcttcagcctggccagctgcatcatcaccgccaagctgtgcacctgggccatctgcttcctgaccaccagcgaggaggtgcagaagaagctgtacgaggagatcaaccaggtgttcggcaacggccccgtgacccccgagaagatcgagcagctgagatactgccagcacgtgctgtgcgagaccgtgagaaccgccaagctgacccccgtgagcgcccagctgcaggacatcgagggcaagatcgacagattcatcatccccagagagaccctggtgctgtacgccctgggcgtggtgctgcaggaccccaacacctggcccagcccccacaagttcgaccccgacagattcgacgacgagctggtgatgaagaccttcagcagcctgggcttcagcggcacccaggagtgccccgagctgagattcgcctacatggtgaccaccgtgctgctgagcgtgctggtgaagagactgcacctgctgagcgtggagggccaggtgatcgagaccaagtacgagctggtgaccagcagcagagaggaggcctggatcaccgtgagcaagagatactag

SEQ ID NO: 17776 - DNA, 1308 bp, Artificial Sequence
  Description of Artificial Sequence: Synthetic coding sequence
atgctggacttcgccatcttcgccgtgaccttcctgctggccctggtgggcgccgtgctgtacctgtaccccgccagcagacaggccgccggcatccccggcatcacccccaccgaggagaaggacggcaacctgcccgacatcgtgaacagcggcagcctgcacgagttcctggtgaacctgcacgagagatacggccccgtggtgagcttctggttcggcagaagactggtggtgagcctgggcaccgtggacgtgctgaagcagcacatcaaccccaacaagaccagcgaccccttcgagaccatgctgaagagcctgctgagataccagagcggcggcggcagcgtgagcgagaaccacatgagaaagaagctgtacgagaacggcgtgaccgacagcctgaagagcaacttcgccctgctgctgaagctgagcgaggagctgctggacaagtggctgagctaccccgagacccagcacgtgcccctgagccagcacatgctgggcttcgccatgaagagcgtgacccagatggtgatgggcagcaccttcgaggacgaccaggaggtgatcagattccagaagaaccacggcacccccagctgcaactggagcctgttcaaggagcaccacaagagaaccaagagaaaggagctgcagagcacctacttcatcgacagcctggtgcagggcaacctgaacgaccagcagatcctggaggacagcatgatcttcagcctggccagctgcatcatcaccgccaagctgtgcacctgggccatctgcttcctgaccaccagcgaggaggtgcagaagaagctgtacgaggagatcaaccaggtgttcggcaacggccccgtgacccccgagaagatcgagcagctgagatactgccagcacgtgctgtgcgagaccgtgagaaccgccaagctgacccccgtgagcgcccagctgcaggacatcgagggcaagatcgacagattcatcatccccagagagaccctggtgctgtacgccctgggcgtggtgctgcaggaccccaacacctggcccagcccccacaagttcgaccccgacagattcgacgacgagctggtgatgaagaccttcagcagcctgggcttcagcggcacccaggagtgccccgagctgagattcgcctacatggtgaccaccgtgctgctgagcgtgctggtgaagagactgcacctgctgagcgtggagggccaggtgatcgagaccaagtacgagctggtgaccagcagcagagaggaggcctggatcaccgtgagcaagagatactag

SEQ ID NO: 17777 - DNA, 1539 bp, Artificial Sequence
  Description of Artificial Sequence: Synthetic coding sequence
atgctgttcgagggcctggacctggtgagcgccctggccaccctggccgcctgcctggtgagcgtgaccctgctgctggccgtgagccagcagctgtggcagctgagatgggccgccaccagagacaagagctgcaagctgcccatccccaagggcagcatgggcttccccctgatcggcgagaccggccactggctgctgcagggcagcggcttccagagcagcagaagagagaagtacggcaacgtgttcaagacccacctgctgggcagacccctgatcagagtgaccggcgccgagaacgtgagaaagatcctgatgggcgagcaccacctggtgagcaccgagtggcccagaagcaccagaatgctgctgggccccaacaccgtgagcaacagcatcggcgacatccacagaaacaagagaaaggtgttcagcaagatcttcagccacgaggccctggagagctacctgcccaagatccagctggtgatccaggacaccctgagagcctggagcagccaccccgaggccatcaacgtgtaccaggaggcccagaagctgaccttcagaatggccatcagagtgctgctgggcttcagcatccccgaggaggacctgggccacctgttcgaggtgtaccagcagttcgtggacaacgtgttcagcctgcccgtggacctgcccttcagcggctacagaagaggcatccaggccagacagatcctgcagaagggcctggagaaggccatcagagagaagctgcagtgcacccagggcaaggactacctggacgccctggacctgctgatcgagagcagcaaggagcacggcaaggagatgaccatgcaggagctgaaggacggcaccctggagctgatcttcgccgcctacgccaccaccgccagcgccagcaccagcctgatcatgcagctgctgaagcaccccaccgtgctggagaagctgagagacgagctgagagcccacggcatcctgcacagcggcggctgcccctgcgagggcaccctgagactggacaccctgagcggcctgagatacctggactgcgtgatcaaggaggtgatgagactgttcacccccatcagcggcggctacagaaccgtgctgcagaccttcgagctggacggcttccagatccccaagggctggagcgtgatgtacagcatcagagacacccacgacaccgcccccgtgttcaaggacgtgaacgtgttcgaccccgacagattcagccaggccagaagcgaggacaaggacggcagattccactacctgcccttcggcggcggcgtgagaacctgcctgggcaagcacctggccaagctgttcctgaaggtgctggccgtggagctggccagcaccagcagattcgagctggccaccagaaccttccccagaatcaccctggtgcccgtgctgcaccccgtggacggcctgagcgtgaagttcttcggcctggacagcaaccagaacgagatcctgcccgagaccgaggccatgctgagcgccaccgtgtag

SEQ ID NO: 17778 - DNA, 1314 bp, Artificial Sequence
  Description of Artificial Sequence: Synthetic coding sequence
atgctgttcgagggcctggacctggtgagcgccctggccaccctggccgcctgcctggtgagcgtgaccctgctgctggccgtgagccagcagctgtggcagctgagatgggccgccaccagagacaagagctgcaagctgcccatccccaagggcagcatgggcttccccctgatcggcgagaccggccactggctgctgcaggtgttcagcaagatcttcagccacgaggccctggagagctacctgcccaagatccagctggtgatccaggacaccctgagagcctggagcagccaccccgaggccatcaacgtgtaccaggaggcccagaagctgaccttcagaatggccatcagagtgctgctgggcttcagcatccccgaggaggacctgggccacctgttcgaggtgtaccagcagttcgtggacaacgtgttcagcctgcccgtggacctgcccttcagcggctacagaagaggcatccaggccagacagatcctgcagaagggcctggagaaggccatcagagagaagctgcagtgcacccagggcaaggactacctggacgccctggacctgctgatcgagagcagcaaggagcacggcaaggagatgaccatgcaggagctgaaggacggcaccctggagctgatcttcgccgcctacgccaccaccgccagcgccagcaccagcctgatcatgcagctgctgaagcaccccaccgtgctggagaagctgagagacgagctgagagcccacggcatcctgcacagcggcggctgcccctgcgagggcaccctgagactggacaccctgagcggcctgagatacctggactgcgtgatcaaggaggtgatgagactgttcacccccatcagcggcggctacagaaccgtgctgcagaccttcgagctggacggcttccagatccccaagggctggagcgtgatgtacagcatcagagacacccacgacaccgcccccgtgttcaaggacgtgaacgtgttcgaccccgacagattcagccaggccagaagcgaggacaaggacggcagattccactacctgcccttcggcggcggcgtgagaacctgcctgggcaagcacctggccaagctgttcctgaaggtgctggccgtggagctggccagcaccagcagattcgagctggccaccagaaccttccccagaatcaccctggtgcccgtgctgcaccccgtggacggcctgagcgtgaagttcttcggcctggacagcaaccagaacgagatcctgcccgagaccgaggccatgctgagcgccaccgtgtag

SEQ ID NO: 17779 - DNA, 1368 bp, Artificial Sequence
  Description of Artificial Sequence: Synthetic coding sequence
atgagcgtgagcgtgctgagccccagcagaagactgggcggcgtgagcggcatcctgcaggtgaccagcctgctgatcctgctgctgctgctgatcaaggccgcccagctgtacctgcacagacagtggctgctgaaggccctgcagcagttcccctgcccccccagccactggctgttcggccacatccaggagttccagcacgaccaggagctgcagagaatccaggagagagtgaagaccttccccagcgcctgcccctactggatctggggcggcaaggtgagagtgcagctgtacgaccccgactacatgaaggtgatcctgggcagaagcgaccccaagagccacggcagctacaagttcctggcccccagaatcggctacggcctgctgctgctgaacggccagacctggttccagcacagaagaatgctgacccccgccttccacaacgacatcctgaagccctacgtgggcctgatggccgacagcgtgagagtgatgctggacaagtgggaggagctgctgggccaggacagccccctggaggtgttccagcacgtgagcctgatgaccctggacaccatcatgaagagcgccttcagccaccagggcagcatccaggtggacagaaacagccagagctacatccaggccatcagcgacctgaacagcctggtgttctgctgcatgagaaacgccttccacgagaacgacaccatctacagcctgaccagcgccggcagatggacccacagagcctgccagctggcccaccagcacaccgaccaggtgatccagctgagaaaggcccagctgcagaaggagggcgagctggagaagatcaagagaaagagacacctggacttcctggacatcctgctgctggccaagatggagaacggcagcatcctgagcgacaaggacctgagagccgaggtggacaccttcatgttcgagggccacgacaccaccgccagcggcatcagctggatcctgtacgccctggccacccaccccaagcaccaggagagatgcagagaggagatccacggcctgctgggcgacggcgccagcatcacctggaaccacctggaccagatgccctacaccaccatgtgcatcaaggaggccctgagactgtacccccccgtgcccggcatcggcagagagctgagcacccccgtgaccttccccgacggcagaagcctgcccaagggcatcatggtgctgctgagcatctacggcctgcaccacaaccccaaggtgtggcccaacctggaggtgttcgaccccagcagattcgcccccggcagcgcccagcacagccacgccttcctgcccttcagcggcggcagcagatag

SEQ ID NO: 17780 - DNA, 1266 bp, Artificial Sequence
  Description of Artificial Sequence: Synthetic coding sequence
atgagcgtgagcgtgctgagccccagcagaagactgggcggcgtgagcggcatcctgcaggtgaccagcctgctgatcctgctgctgctgctgatcaaggccgcccagctgtacctgcacagacagtggctgctgaaggccctgcagcagttcccctgcccccccagccactggctgttcggccacatccaggagttccagcacgaccaggagctgcagagaatccaggagagagtgaagaccttccccagcgcctgcccctactggatctggggcggcaaggtgagagtgcagctgtacgaccccgactacatgaaggtgatcctgggcagaagcgaccccaagagccacggcagctacaagttcctggcccccagaatcggctacggcctgctgctgctgaacggccagacctggttccagcacagaagaatgctgacccccgccttccacaacgacatcctgaagccctacgtgggcctgatggccgacagcgtgagagtgatgctggacaagtgggaggagctgctgggccaggacagccccctggaggtgttccagcacgtgagcctgatgaccctggacaccatcatgaagagcgccttcagccaccagggcagcatccaggtggacagacccagcgaccccaccgaggagggcagcaccaccgagggcggcggcgccggcgaggaccaggaggaggaggccctgggcttcagcggccacccccccctgggccagagagcccccggcctgcccagaccctgctggtgcagcggctggaactgcttcagaaaccacctggaccagatgccctacaccaccatgtgcatcaaggaggccctgagactgtacccccccgtgcccggcatcggcagagagctgagcacccccgtgaccttccccgacggcagaagcctgcccaagggcatcatggtgctgctgagcatctacggcctgcaccacaaccccaaggtgtggcccaacctggaggtgttcgaccccagcagattcgcccccggcagcgcccagcacagccacgccttcctgcccttcagcggcggcagcagaaactgcatcggcaagcagttcgccatgaaccagctgaaggtggccagagccctgaccctgctgagattcgagctgctgcccgaccccaccagaatccccatccccatggccagactggtgctgaagagcaagaacggcatccacctgagactgagaagactgcccaacccctgcgaggacaaggaccagctgtag

SEQ ID NO: 17781 - DNA, 1560 bp, Artificial Sequence
  Description of Artificial Sequence: Synthetic coding sequence
atgagcgtgagcgtgctgagccccagcagaagactgggcggcgtgagcggcatcctgcaggtgaccagcctgctgatcctgctgctgctgctgatcaaggccgcccagctgtacctgcacagacagtggctgctgaaggccctgcagcagttcccctgcccccccagccactggctgttcggccacatccaggagttccagcacgaccaggagctgcagagaatccaggagagagtgaagaccttccccagcgcctgcccctactggatctggggcggcaaggtgagagtgcagctgtacgaccccgactacatgaaggtgatcctgggcagaagcgaccccaagagccacggcagctacaagttcctggcccccagaatcggctacggcctgctgctgctgaacggccagacctggttccagcacagaagaatgctgacccccgccttccacaacgacatcctgaagccctacgtgggcctgatggccgacagcgtgagagtgatgctggacaagtgggaggagctgctgggccaggacagccccctggaggtgttccagcacgtgagcctgatgaccctggacaccatcatgaagagcgccttcagccaccagggcagcatccaggtggacagaaacagccagagctacatccaggccatcagcgacctgaacagcctggtgttctgctgcatgagaaacgccttccacgagaacgacaccatctacagcctgaccagcgccggcagatggacccacagagcctgccagctggcccaccagcacaccgaccaggtgatccagctgagaaaggcccagctgcagaaggagggcgagctggagaagatcaagagaaagagacacctggacttcctggacatcctgctgctggccaagatggagaacggcagcatcctgagcgacaaggacctgagagccgaggtggacaccttcatgttcgagggccacgacaccaccgccagcggcatcagctggatcctgtacgccctggccacccaccccaagcaccaggagagatgcagagaggagatccacggcctgctgggcgacggcgccagcatcacctggaaccacctggaccagatgccctacaccaccatgtgcatcaaggaggccctgagactgtacccccccgtgcccggcatcggcagagagctgagcacccccgtgaccttccccgacggcagaagcctgcccaagggcatcatggtgctgctgagcatctacggcctgcaccacaaccccaaggtgtggcccaacctggaggtgttcgaccccagcagattcgcccccggcagcgcccagcacagccacgccttcctgcccttcagcggcggcagcagaaactgcatcggcaagcagttcgccatgaaccagctgaaggtggccagagccctgaccctgctgagattcgagctgctgcccgaccccaccagaatccccatccccatggccagactggtgctgaagagcaagaacggcatccacctgagactgagaagactgcccaacccctgcgaggacaaggaccagctgtag

SEQ ID NO: 17782 - DNA, 1536 bp, Artificial Sequence
  Description of Artificial Sequence: Synthetic coding sequence
atggtgcccagcttcctgagcctgagcttcagcagcctgggcctgtgggccagcggcctgatcctggtgctgggcttcctgaagctgatccacctgctgctgagaagacagaccctggccaaggccatggacaagttccccggcccccccacccactggctgttcggccacgccctggagatccaggagaccggcagcctggacaaggtggtgagctgggcccaccagttcccctacgcccaccccctgtggttcggccagttcatcggcttcctgaacatctacgagcccgactacgccaaggccgtgtacagcagaggcgaccccaaggcccccgacgtgtacgacttcttcctgcagtggatcggcagaggcctgctggtgctggagggccccaagtggctgcagcacagaaagctgctgacccccggcttccactacgacgtgctgaagccctacgtggccgtgttcaccgagagcaccagaatcatgctggacaagtgggaggagaaggccagagagggcaagagcttcgacatcttctgcgacgtgggccacatggccctgaacaccctgatgaagtgcaccttcggcagaggcgacaccggcctgggccacagagacagcagctactacctggccgtgagcgacctgaccctgctgatgcagcagagactggtgagcttccagtaccacaacgacttcatctactggctgaccccccacggcagaagattcctgagagcctgccaggtggcccacgaccacaccgaccaggtgatcagagagagaaaggccgccctgcaggacgagaaggtgagaaagaagatccagaacagaagacacctggacttcctggacatcctgctgggcgccagagacgaggacgacatcaagctgagcgacgccgacctgagagccgaggtggacaccttcatgttcgagggccacgacaccaccaccagcggcatcagctggttcctgtactgcatggccctgtaccccgagcaccagcacagatgcagagaggaggtgagagagatcctgggcgaccaggacttcttccagtgggacgacctgggcaagatgacctacctgaccatgtgcatcaaggagagcttcagactgtacccccccgtgccccaggtgtacagacagctgagcaagcccgtgaccttcgtggacggcagaagcctgcccgccggcagcctgatcagcatgcacatctacgccctgcacagaaacagcgccgtgtggcccgaccccgaggtgttcgacagcctgagattcagcaccgagaacgccagcaagagacaccccttcgccttcatgcccttcagcgccggccccagaaactgcatcggccagcagttcgccatgagcgagatgaaggtggtgaccgccatgtgcctgctgagattcgagttcagcctggaccccagcagactgcccatcaagatgccccagctggtgctgagaagcaagaacggcttccacctgcacctgaagcccctgggccccggcagcggcaagtag

SEQ ID NO: 17783 - DNA, 1494 bp, Artificial Sequence
  Description of Artificial Sequence: Synthetic coding sequence
atggtgcccagcttcctgagcctgagcttcagcagcctgggcctgtgggccagcggcctgatcctggtgctgggcttcctgaagctgatccacctgctgctgagaagacagaccctggccaaggccatggacaagttccccggcccccccacccactggctgttcggccacgccctggagatccaggagaccggcagcctggacaaggtggtgagctgggcccaccagttcccctacgcccaccccctgtggttcggccagttcatcggcttcctgaacatctacgagcccgactacgccaaggccgtgtacagcagaggcggcagaggcctgctggtgctggagggccccaagtggctgcagcacagaaagctgctgacccccggcttccactacgacgtgctgaagccctacgtggccgtgttcaccgagagcaccagaatcatgctggacaagtgggaggagaaggccagagagggcaagagcttcgacatcttctgcgacgtgggccacatggccctgaacaccctgatgaagtgcaccttcggcagaggcgacaccggcctgggccacagcagagacagcagctactacctggccgtgagcgacctgaccctgctgatgcagcagagactggtgagcttccagtaccacaacgacttcatctactggctgaccccccacggcagaagattcctgagagcctgccaggtggcccacgaccacaccgaccaggtgatcagagagagaaaggccgccctgcaggacgagaaggtgagaaagaagatccagaacagaagacacctggacttcctggacatcctgctgggcgccagagacgaggacgacatcaagctgagcgacgccgacctgagagccgaggtggacaccttcatgttcgagggccacgacaccaccaccagcggcatcagctggttcctgtactgcatggccctgtaccccgagcaccagcacagatgcagagaggaggtgagagagatcctgggcgaccaggacttcttccagtgggacgacctgggcaagatgacctacctgaccatgtgcatcaaggagagcttcagactgtacccccccgtgccccaggtgtacagacagctgagcaagcccgtgaccttcgtggacggcagaagcctgcccgccggcagcctgatcagcatgcacatctacgccctgcacagaaacagcgccgtgtggcccgaccccgaggtgttcgacagcctgagattcagcaccgagaacgccagcaagagacaccccttcgccttcatgcccttcagcgccggccccagaaactgcatcggccagcagttcgccatgagcgagatgaaggtggtgaccgccatgtgcctgctgagattcgagttcagcctggaccccagcagactgcccatcaagatgccccagctggtgctgagaagcaagaacggcttccacctgcacctgaagcccctgggccccggcagcggcaagtag

SEQ ID NO: 17784 - DNA, 1539 bp, Artificial Sequence
  Description of Artificial Sequence: Synthetic coding sequence
atggtgcccagcttcctgagcctgagcttcagcagcctgggcctgtgggccagcggcctgatcctggtgctgggcttcctgaagctgatccacctgctgctgagaagacagaccctggccaaggccatggacaagttccccggcccccccacccactggctgttcggccacgccctggagatccaggagaccggcagcctggacaaggtggtgagctgggcccaccagttcccctacgcccaccccctgtggttcggccagttcatcggcttcctgaacatctacgagcccgactacgccaaggccgtgtacagcagaggcgaccccaaggcccccgacgtgtacgacttcttcctgcagtggatcggcagaggcctgctggtgctggagggccccaagtggctgcagcacagaaagctgctgacccccggcttccactacgacgtgctgaagccctacgtggccgtgttcaccgagagcaccagaatcatgctggacaagtgggaggagaaggccagagagggcaagagcttcgacatcttctgcgacgtgggccacatggccctgaacaccctgatgaagtgcaccttcggcagaggcgacaccggcctgggccacagcagagacagcagctactacctggccgtgagcgacctgaccctgctgatgcagcagagactggtgagcttccagtaccacaacgacttcatctactggctgaccccccacggcagaagattcctgagagcctgccaggtggcccacgaccacaccgaccaggtgatcagagagagaaaggccgccctgcaggacgagaaggtgagaaagaagatccagaacagaagacacctggacttcctggacatcctgctgggcgccagagacgaggacgacatcaagctgagcgacgccgacctgagagccgaggtggacaccttcatgttcgagggccacgacaccaccaccagcggcatcagctggttcctgtactgcatggccctgtaccccgagcaccagcacagatgcagagaggaggtgagagagatcctgggcgaccaggacttcttccagtgggacgacctgggcaagatgacctacctgaccatgtgcatcaaggagagcttcagactgtacccccccgtgccccaggtgtacagacagctgagcaagcccgtgaccttcgtggacggcagaagcctgcccgccggcagcctgatcagcatgcacatctacgccctgcacagaaacagcgccgtgtggcccgaccccgaggtgttcgacagcctgagattcagcaccgagaacgccagcaagagacaccccttcgccttcatgcccttcagcgccggccccagaaactgcatcggccagcagttcgccatgagcgagatgaaggtggtgaccgccatgtgcctgctgagattcgagttcagcctggaccccagcagactgcccatcaagatgccccagctggtgctgagaagcaagaacggcttccacctgcacctgaagcccctgggccccggcagcggcaagtag

SEQ ID NO: 17785 - DNA, 573 bp, Artificial Sequence
  Description of Artificial Sequence: Synthetic coding sequence
atgctgacccccgccttccacttcaacatcctgaagccctacatgaagatcttcaacgagagcgtgaacatcatgcacgccaagtggcagctgctggccagcgagggcagcgcctgcctggacatgttcgagcacatcagcctgatgaccctggacagcctgcagaagtgcgtgttcagcttcgacagccactgccaggagaagcccagcgagtacatcgccgccatcctggagctgagcgccctggtgagcaagagacaccacgagatcctgctgcacatcgacttcctgtactacctgacccccgacggccagagattcagaagagcctgcagactggtgcacgacttcaccgacgccgtgatccaggagagaagaagaaccctgcccagccagggcgtggacgacttcctgcaggccaaggccaagagcaagaccctggacttcatcgacgtgctgctgctgagcaaggccatgacccccagacccgtggtgagccccggcagctgcaccaccctgcagagcacccagaacaccagaagcgccgccggcagaagatgcaagaacttctag

SEQ ID NO: 17786 - DNA, 1974 bp, Artificial Sequence
  Description of Artificial Sequence: Synthetic coding sequence
atggccagcgccagaaaggccagcagacccatgagagacgtgttcggcgacttcagcgacgtgagcctggaggacagcaccatggaggagatcagaaacttccagatcagcagaaacctgaccaagatcgcccccggccacagcagattcctgaagagaaaccagaccctggacgagaagcacctgctgctgaaggagaaccccgtgctgggcagcggccccagactggccagctgcagaccccccaccaccgccagcagaatcagagccaacgccgccctgatgaagctggcccagctggagaccagaatcatgaacagaaagctgcagagaaacctgagcgacaccgagagcgacagcatgaccgccgacgccggcctgcccaagagagccgacagaatcctgagcggcggcgccctggagctggccagccagaacaccgacaagaccagccagaaccaggccagagagctgcccgtgaccgagaacaacgcccagaacgccaaggtgagcagattcctgaagaagaagcaggcccccgtggagaacatcagccccgaggcccccgccggcaaggagagaaccctgcagacccccaagcagaaggagcccgccagaaccttcgacagccccgacagcgacgaggaggagatgaaggtgctgctgggcagcctgatggacagcagcagagagaagaacaccaaccagggcttcagcagcgccaacgtgagcgaggaggaggagagaaagctgttcagcgtgcccagccagctgagagccttcaccgtgcccagcgtggagctgagcagcgccaagcccagccagaccagccacctgcccaccagcctggccgccgacagaaccctgcacagcaccagaagcagagccgactacccccagagccacgtgagcagcgacaccgccagccacacccccagcgtgagcatcaccggcgccttcagcaacagcgtgagcctgaagatgggccacgtgaagctggtgagcagccccggcagaagcgaggccgagaccgtggacgagcccgtgagcgagggcgccgacgacagcctggacgagttcagaatcaacatcctgagcctggacggcctggcccccgccgtgagcgagaacagcgacctggagcaggaggaggagagcgcccagagacagaagaccgccggcaagatcttcagagccgaggccagcaccggccaggacgcccccagacaggcccaggccagaagctgggccagccagggcaaggccgccagcgccgagggcgacgagagcgaggtgagcgagcacctgagcgccagcagcgccagcgccatccagcaggacagcaccagcagcatgcagccccccagcgaggcccccatggtgaacaccgtgagcagcgcctacagcgaggacttcgagaacagccccagcctgaccgccagcgagcccaccgcccacagcaaggagagcctggacagaaccctggacgccctgagcgagagcagcagcagcgtgaagaccgacctgccccagaccgccgagagcagaaagaagagcggcagacacgtgaccagagtgctggtgaaggacaccgccgtgcagacccccgaccccgccttcacctacgagtggaccaaggtggccagcatggccgccatgggccccgccctgggcggcgcctacgtggaccccacccccatcgccaaccacgtgatcagcgccgacgccatcgaggccctgaccgcctacagccccgccgtgctggccctgcacgacgtgctgaagcagcagctgagcctgacccagcagttcatccaggccagcagacacctgcacgccagcctgctgagaagcctggacgccgacagcttccactaccacaccctggaggaggccaaggagtacatcagatgccacagacccgcccccctgaccatggaggacgccctggaggaggtgaacaaggagctgtag

SEQ ID NO: 17787 - DNA, 1116 bp, Artificial Sequence
  Description of Artificial Sequence: Synthetic coding sequence
atgctgacccccgccttccacttcaacatcctgaagccctacatgaagatcttcaacgagagcgtgaacatcatgcacgccaagtggcagctgctggccagcgagggcagcgcctgcctggacatgttcgagcacatcagcctgatgaccctggacagcctgcagaagtgcgtgttcagcttcgacagccactgccaggagaagcccagcgagtacatcgccgccatcctggagctgagcgccctggtgagcaagagacaccacgagatcctgctgcacatcgacttcctgtactacctgacccccgacggccagagattcagaagagcctgcagactggtgcacgacttcaccgacgccgtgatccaggagagaagaagaaccctgcccagccagggcgtggacgacttcctgcaggccaaggccaagagcaagaccctggacttcatcgacgtgctgctgctgagcaaggacgaggacggcaagaagctgagcgacgaggacatcagagccgaggccgacaccttcatgttcgagggccacgacaccaccgccagcggcctgagctgggtgctgtaccacctggccaagcaccccgagtaccaggagagatgcagacaggaggtgcaggagctgctgaaggacagagagcccaaggagatcgagtgggacgacctggcccacctgcccttcctgaccatgtgcatgaaggagagcctgagactgcacccccccgtgcccgtgatcagcagacacgtgacccaggacatcgtgctgcccgacggcagagtgatccccaagggcatcatctgcctgatcagcgtgttcggcacccaccacaaccccgccgtgtggcccgaccccgaggtgtacgaccccttcagattcgaccccgagaacatcaaggagagaagccccctggccttcatccccttcagcgccggccccagaaactgcatcggccagaccttcgccatggccgagatgaaggtggtgctggccctgaccctgctgagattcagagtgctgcccgaccacaccgagcccagaagaaagcccgagctggtgctgagagccgagggcggcctgtggctgagagtggagcccctgagctag

SEQ ID NO: 17788 - DNA, 1530 bp, Artificial Sequence
  Description of Artificial Sequence: Synthetic coding sequence
atggagttcagctggctggagaccagatgggccagacccttctacctggccttcgtgttctgcctggccctgggcctgctgcaggccatcaagctgtacctgagaagacagagactgctgagagacctgagacccttccccgccccccccacccactggttcctgggccaccagaagttcatccaggacgacaacatggagaagctggaggagatcatcgagaagtaccccagagccttccccttctggatcggccccttccaggccttcttctgcatctacgaccccgactacgccaagaccctgctgagcagaaccgaccccaagagccagtacctgcagaagttcagcccccccctgctgggcaagggcctggccgccctggacggccccaagtggttccagcacagaagactgctgacccccggcttccacttcaacatcctgaaggcctacatcgaggtgatggcccacagcgtgaagatgatgctggacaagtgggagaagatctgcagcacccaggacaccagcgtggaggtgtacgagcacatcaacagcatgagcctggacatcatcatgaagtgcgccttcagcaaggagaccaactgccagaccaacagcacccacgacccctacgccaaggccatcttcgagctgagcaagatcatcttccacagactgtacagcctgctgtaccacagcgacatcatcttcaagctgagcccccagggctacagattccagaagctgagcagagtgctgaaccagtacaccgacaccatcatccaggagagaaagaagagcctgcaggccggcgtgaagcaggacaacacccccaagagaaagtaccaggacttcctggacatcgtgctgagcgccaaggacgagagcggcagcagcttcagcgacatcgacgtgcacagcgaggtgagcaccttcctgctggccggccacgacaccctggccgccagcatcagctggatcctgtactgcctggccctgaaccccgagcaccaggagagatgcagagaggaggtgagaggcatcctgggcgacggcagcagcatcacctgggaccagctgggcgagatgagctacaccaccatgtgcatcaaggagacctgcagactgatccccgccgtgcccagcatcagcagagacctgagcaagcccctgaccttccccgacggctgcaccctgcccgccggcatcaccgtggtgctgagcatctggggcctgcaccacaaccccgccgtgtggaagaaccccaaggtgttcgaccccctgagattcagccaggagaacagcgaccagagacacccctacgcctacctgcccttcagcgccggcagcagaaactgcatcggccaggagttcgccatgatcgagctgaaggtgaccatcgccctgatcctgctgcacttcagagtgacccccgaccccaccagacccctgaccttccccaaccacttcatcctgaagcccaagaacggcatgtacctgcacctgaagaagctgagcgagtgctag

SEQ ID NO: 17789 - DNA, 1527 bp, Artificial Sequence
  Description of Artificial Sequence: Synthetic coding sequence
atgatgtggggcggcggcctggacctgtgccccatgcccggccagctgaagttccccccctgcctgagcagatgcctgctgtgggagccccccagcctgtacctgacccagcccaccagcagcctggccgagccccaggccctgatctgcatgaccagcagcagcagcggcctgttcatccaggacgacaacatggagaagctggaggagatcatcgagaagtaccccagagccttccccttctggatcggccccttccaggccttcttctgcatctacgaccccgactacgccaagaccctgctgagcagaaccgaccccaagagccagtacctgcagaagttcagcccccccctgctgggcaagggcctggccgccctggacggccccaagtggttccagcacagaagactgctgacccccggcttccacttcaacatcctgaaggcctacatcgaggtgatggcccacagcgtgaagatgatgctggacaagtgggagaagatctgcagcacccaggacaccagcgtggaggtgtacgagcacatcaacagcatgagcctggacatcatcatgaagtgcgccttcagcaaggagaccaactgccagaccaacagcacccacgacccctacgccaaggccatcttcgagctgagcaagatcatcttccacagactgtacagcctgctgtaccacagcgacatcatcttcaagctgagcccccagggctacagattccagaagctgagcagagtgctgaaccagtacaccgacaccatcatccaggagagaaagaagagcctgcaggccggcgtgaagcaggacaacacccccaagagaaagtaccaggacttcctggacatcgtgctgagcgccaaggacgagagcggcagcagcttcagcgacatcgacgtgcacagcgaggtgagcaccttcctgctggccggccacgacaccctggccgccagcatcagctggatcctgtactgcctggccctgaaccccgagcaccaggagagatgcagagaggaggtgagaggcatcctgggcgacggcagcagcatcacctgggaccagctgggcgagatgagctacaccaccatgtgcatcaaggagacctgcagactgatccccgccgtgcccagcatcagcagagacctgagcaagcccctgaccttccccgacggctgcaccctgcccgccggcatcaccgtggtgctgagcatctggggcctgcaccacaaccccgccgtgtggaagaaccccaaggtgttcgaccccctgagattcagccaggagaacagcgaccagagacacccctacgcctacctgcccttcagcgccggcagcagaaactgcatcggccaggagttcgccatgatcgagctgaaggtgaccatcgccctgatcctgctgcacttcagagtgacccccgaccccaccagacccctgaccttccccaaccacttcatcctgaagcccaagaacggcatgtacctgcacctgaagaagctgagcgagtgctag

SEQ ID NO: 17790 - DNA, 1518 bp, Artificial Sequence
  Description of Artificial Sequence: Synthetic coding sequence
atggagcccagctggctgcaggagctgatggcccaccccttcctgctgctgatcctgctgtgcatgagcctgctgctgttccaggtgatcagactgtaccagagaagaagatggatgatcagagccctgcacctgttccccgccccccccgcccactggttctacggccacaaggagttctaccccgtgaaggagttcgaggtgtaccacaagctgatggagaagtacccctgcgccgtgcccctgtgggtgggccccttcaccatgttcttcagcgtgcacgaccccgactacgccaagatcctgctgaagagacaggaccccaagagcgccgtgagccacaagatcctggagagctgggtgggcagaggcctggtgaccctggacggcagcaagtggaagaagcacagacagatcgtgaagcccggcttcaacatcagcatcctgaagatcttcatcaccatgatgagcgagagcgtgagaatgatgctgaacaagtgggaggagcacatcgcccagaacagcagactggagctgttccagcacgtgagcctgatgaccctggacagcatcatgaagtgcgccttcagccaccagggcagcatccagctggacagcaccctggacagctacctgaaggccgtgttcaacctgagcaagatcagcaaccagagaatgaacaacttcctgcaccacaacgacctggtgttcaagttcagcagccagggccagatcttcagcaagttcaaccaggagctgcaccagttcaccgagaaggtgatccaggacagaaaggagagcctgaaggacaagctgaagcaggacaccacccagaagagaagatgggacttcctggacatcctgctgagcgccaagagcgagaacaccaaggacttcagcgaggccgacctgcaggccgaggtgaagaccttcatgttcgccggccacgacaccaccagcagcgccatcagctggatcctgtactgcctggccaagtaccccgagcaccagcagagatgcagagacgagatcagagagctgctgggcgacggcagcagcatcacctgggagcacctgagccagatgccctacaccaccatgtgcatcaaggagtgcctgagactgtacgcccccgtggtgaacatcagcagactgctggacaagcccatcaccttccccgacggcagaagcctgcccgccggcatcaccgtgttcatcaacatctgggccctgcaccacaacccctacttctgggaggacccccaggtgttcaaccccctgagattcagcagagagaacagcgagaagatccacccctacgccttcatccccttcagcgccggcctgagaaactgcatcggccagcacttcgccatcatcgagtgcaaggtggccgtggccctgaccctgctgagattcaagctggcccccgaccacagcagacccccccagcccgtgagacaggtggtgctgaagagcaagaacggcatccacgtgttcgccaagaaggtgtgctag

SEQ ID NO: 17791 - DNA, 1809 bp, Artificial Sequence
  Description of Artificial Sequence: Synthetic coding sequence
atgcccagcgccaagcagagaggcagcaagggcggccacggcgccgccagccccagcgagaagggcgcccaccccagcggcggcgccgacgacgtggccaagaagcccccccccgccccccagcagcccccccccccccccgccccccacccccagcagcacccccagcagcacccccagaaccaggcccacggcaagggcggccacagaggcggcggcggcggcggcggcaagagcagcagcagcagcagcgccagcgccgccgccgccgccgccgccgccagcagcagcgccagctgcagcagaagactgggcagagccctgaacttcctgttctacctggccctggtggccgccgccgccttcagcggctggtgcgtgcaccacgtgctggaggaggtgcagcaggtgagaagaagccaccaggacttcagcagacagagagaggagctgggccagggcctgcagggcgtggagcagaaggtgcagagcctgcaggccaccttcggcaccttcgagagcatcctgagaagcagccagcacaagcaggacctgaccgagaaggccgtgaagcagggcgagagcgaggtgagcagaatcagcgaggtgctgcagaagctgcagaacgagatcctgaaggacctgagcgacggcatccacgtggtgaaggacgccagagagagagacttcaccagcctggagaacaccgtggaggagagactgaccgagctgaccaagagcatcaacgacaacatcgccatcttcaccgaggtgcagaagagaagccagaaggagatcaacgacatgaaggccaaggtggccagcctggaggagagcgagggcaacaagcaggacctgaaggccctgaaggaggccgtgaaggagatccagaccagcgccaagagcagagagtgggacatggaggccctgagaagcaccctgcagaccatggagagcgacatctacaccgaggtgagagagctggtgagcctgaagcaggagcagcaggccttcaaggaggccgccgacaccgagagactggccctgcaggccctgaccgagaagctgctgagaagcgaggagagcgtgagcagactgcccgaggagatcagaagactggaggaggagctgagacagctgaagagcgacagccacggccccaaggaggacggcggcttcagacacagcgaggccttcgaggccctgcagcagaagagccagggcctggacagcagactgcagcacgtggaggacggcgtgctgagcatgcaggtggccagcgccagacagaccgagagcctggagagcctgctgagcaagagccaggagcacgagcagagactggccgccctgcagggcagactggagggcctgggcagcagcgaggccgaccaggacggcctggccagcaccgtgagaagcctgggcgagacccagctggtgctgtacggcgacgtggaggagctgaagagaagcgtgggcgagctgcccagcaccgtggagagcctgcagaaggtgcaggagcaggtgcacaccctgctgagccaggaccaggcccaggccgccagactgcccccccaggacttcctggacagactgagcagcctggacaacctgaaggccagcgtgagccaggtggaggccgacctgaagatgctgagaaccgccgtggacagcctggtggcctacagcgtgaagatcgagaccaacgagaacaacctggagagcgccaagggcctgctggacgacctgagaaacgacctggacagactgttcgtgaaggtggagaagatccacgagaaggtgtag

SEQ ID NO: 17792 - DNA, 9897 bp, Artificial Sequence
  Description of Artificial Sequence: Synthetic coding sequence
atgcagaaggagctgggcatcgtgcccagctgccccggcatgaagagccccagaccccacctgctgctgcccctgctgctgctgctgctgctgctgctgggcgccggcgtgcccggcgcctggggccaggccggcagcctggacctgcagatcgacgaggagcagcccgccggcaccctgatcggcgacatcagcgccggcctgcccgccggcaccgccgcccccctgatgtacttcatcagcgcccaggagggcagcggcgtgggcaccgacctggccatcgacgagcacagcggcgtggtgagaaccgccagagtgctggacagagagcagagagacagatacagattcaccgccgtgacccccgacggcgccaccgtggaggtgaccgtgagagtggccgacatcaacgaccacgcccccgccttcccccaggccagagccgccctgcaggtgcccgagcacaccgccttcggcaccagataccccctggagcccgccagagacgccgacgccggcagactgggcacccagggctacgccctgagcggcgacggcgccggcgagaccttcagactggagaccagacccggccccgacggcacccccgtgcccgagctggtggtgaccggcgagctggacagagagaacagaagccactacatgctgcagctggaggcctacgacggcggcagcccccccagaagagcccaggccctgctggacgtgaccctgctggacatcaacgaccacgcccccgccttcaaccagagcagataccacgccgtggtgagcgagagcctggcccccggcagccccgtgctgcaggtgttcgccagcgacgccgacgccggcgtgaacggcgccgtgacctacgagatcaacagaagacagagcgagggcgacggccccttcagcatcgacgcccacaccggcctgctgcagctggagagacccctggacttcgagcagagaagagtgcacgagctggtggtgcaggccagagacggcggcgcccaccccgagctgggcagcgccttcgtgaccgtgcacgtgagagacgccaacgacaaccagcccagcatgaccgtgatcttcctgagcgccgacggcagcccccaggtgagcgaggccgccccccccggccagctggtggccagaatcagcgtgagcgaccccgacgacggcgacttcgcccacgtgaacgtgagcctggagggcggcgagggccacttcgccctgagcacccaggacagcgtgatctacctggtgtgcgtggccagaagactggacagagaggagagagacgcctacaacctgagagtgaccgccaccgacagcggcagcccccccctgagagccgaggccgccttcgtgctgcacgtgaccgacgtgaacgacaacgcccccgccttcgacagacagctgtacagacccgagcccctgcccgaggtggccctgcccggcagcttcgtggtgagagtgaccgccagagaccccgaccagggcaccaacggccaggtgacctacagcctggcccccggcgcccacacccactggttcagcatcgaccccaccagcggcatcatcaccaccgccgccagcctggactacgagctggagccccagccccagctgatcgtggtggccaccgacggcggcctgccccccctggccagcagcgccaccgtgagcgtggccctgcaggacgtgaacgacaacgagccccagttccagagaaccttctacaacgccagcctgcccgagggcacccagcccggcacctgcttcctgcaggtgaccgccaccgacgccgacagcggccccttcggcctgctgagctacagcctgggcgccggcctgggcagcagcggcagcccccccttcagaatcgacgcccacagcggcgacgtgtgcaccaccagaaccctggacagagaccagggccccagcagcttcgacttcaccgtgaccgccgtggacggcggcggcctgaagagcatggtgtacgtgaaggtgttcctgagcgacgagaacgacaaccccccccagttctaccccagagagtacgccgccagcatcagcgcccagagcccccccggcaccgccgtgctgagactgagagcccacgaccccgaccagggcagccacggcagactgagctaccacatcctggccggcaacagcccccccctgttcaccctggacgagcagagcggcctgctgaccgtggcctggcccctggccagaagagccaacagcgtggtgcagctggagatcggcgccgaggacggcggcggcctgcaggccgagcccagcgccagagtggacatcagcatcgtgcccggcacccccaccccccccatcttcgagcagctgcagtacgtgttcagcgtgcccgaggacgtggcccccggcaccagcgtgggcatcgtgcaggcccacaacccccccggcagactggcccccgtgaccctgagcctgagcggcggcgaccccagaggcctgttcagcctggacgccgtgagcggcctgctgcagaccctgagacccctggacagagagctgctgggccccgtgctggagctggaggtgagagccggcagcggcgtgccccccgccttcgccgtggccagagtgagagtgctgctggacgacgtgaacgacaacagccccgccttccccgcccccgaggacaccgtgctgctgccccccaacaccgcccccggcacccccatctacaccctgagagccctggaccccgacagcggcgtgaacagcagagtgaccttcaccctgctggccggcggcggcggcgccttcaccgtggaccccaccaccggccacgtgagactgatgagacccctgggccccagcggcggccccgcccacgagctggagctggaggccagagacggcggcagcccccccagaaccagccacttcagactgagagtggtggtgcaggacgtgggcaccagaggcctggcccccagattcaacagccccacctacagagtggacctgcccagcggcaccaccgccggcacccaggtgctgcaggtgcaggcccaggcccccgacggcggccccatcacctaccacctggccgccgagggcgccagcagccccttcggcctggagccccagagcggctggctgtgggtgagagccgccctggacagagaggcccaggagctgtacatcctgaaggtgatggccgtgagcggcagcaaggccgagctgggccagcagaccggcaccgccaccgtgagagtgagcatcctgaaccagaacgagcacagccccagactgagcgaggaccccaccttcctggccgtggccgagaaccagccccccggcaccagcgtgggcagagtgttcgccaccgacagagacagcggccccaacggcagactgacctacagcctgcagcagctgagcgaggacagcaaggccttcagaatccacccccagaccggcgaggtgaccaccctgcagaccctggacagagagcagcagagcagctaccagctgctggtgcaggtgcaggacggcggcagcccccccagaagcaccaccggcaccgtgcacgtggccgtgctggacctgaacgacaacagccccaccttcctgcaggccagcggcgccgccggcggcggcctgcccatccaggtgcccgacagagtgccccccggcaccctggtgaccaccctgcaggccaaggaccccgacgagggcgagaacggcaccatcctgtacaccctgaccggccccggcagcgagctgttcagcctgcacccccacagcggcgagctgctgaccgccgcccccctgatcagagccgagagaccccactacgtgctgaccctgagcgcccacgaccagggcagcccccccagaagcgccagcctgcagctgctggtgcaggtgctgcccagcgccagactggccgagcccccccccgacctggccgagagagaccccgccgcccccgtgcccgtggtgctgaccgtgaccgccgccgagggcctgagacccggcagcctgctgggcagcgtggccgcccccgagcccgccggcgtgggcgccctgacctacaccctggtgggcggcgccgaccccgagggcaccttcgccctggacgccgccagcggcagactgtacctggccagacccctggacttcgaggccggccccccctggagagccctgaccgtgagagccgagggccccggcggcgccggcgccagactgctgagagtgcaggtgcaggtgcaggacgagaacgagcacgcccccgccttcgccagagaccccctggccctggccctgcccgagaaccccgagcccggcgccgccctgtacaccttcagagccagcgacgccgacggccccggccccaacagcgacgtgagatacagactgctgagacaggagccccccgtgcccgccctgagactggacgccagaaccggcgccctgagcgcccccagaggcctggacagagagaccacccccgccctgctgctgctggtggaggccaccgacagacccgccaacgccagcagaagaagagccgccagagtgagcgccagagtgttcgtgaccgacgagaacgacaacgcccccgtgttcgccagccccagcagagtgagactgcccgaggaccagccccccggccccgccgccctgcacgtggtggccagagaccccgacctgggcgaggccgccagagtgagctacagactggccagcggcggcgacggccacttcagactgcacagcagcaccggcgccctgagcgtggtgagacccctggacagagagcagagagccgagcacgtgctgaccgtggtggccagcgaccacggcagcccccccagaagcgccacccaggtgctgaccgtgagcgtggccgacgtgaacgacgaggcccccaccttccagcagcaggagtacagcgtgctgctgagagagaacaacccccccggcaccagcctgctgaccctgagagccaccgaccccgacgtgggcgccaacggccaggtgacctacggcggcgtgagcagcgagagcttcagcctggaccccgacaccggcgtgctgaccaccctgagagccctggacagagaggagcaggaggagatcaacctgaccgtgtacgcccaggacagaggcagccccccccagctgacccacgtgaccgtgagagtggccgtggaggacgagaacgaccacgcccccaccttcggcagcgcccacctgagcctggaggtgcccgagggccaggacccccagaccctgaccatgctgagagccagcgaccccgacgtgggcgccaacggccagctgcagtacagaatcctggacggcgaccccagcggcgccttcgtgctggacctggccagcggcgagttcggcaccatgagacccctggacagagaggtggagcccgccttccagctgagaatcgaggccagagacggcggccagcccgccctgagcgccaccctgctgctgaccgtgaccgtgctggacgccaacgaccacgcccccgccttccccgtgcccgcctacagcgtggaggtgcccgaggacgtgcccgccggcaccctgctgctgcagctgcaggcccacgaccccgacgccggcgccaacggccacgtgacctactacctgggcgccggcaccgccggcgccttcctgctggagcccagcagcggcgagctgagaaccgccgccgccctggacagagagcagtgccccagctacaccttcagcgtgagcgccgtggacggcgccgccgccggccccctgagcaccaccgtgagcgtgaccatcaccgtgagagacgtgaacgaccacgcccccaccttccccaccagccccctgagactgagactgcccagacccggccccagcttcagcacccccaccctggccctggccaccctgagagccgaggacagagacgccggcgccaacgccagcatcctgtacagactggccggcacccccccccccggcaccaccgtggacagctacaccggcgagatcagagtggccagaagccccgtggccctgggccccagagacagagtgctgttcatcgtggccaccgacctgggcagacccgccagaagcgccaccggcgtgatcatcgtgggcctgcagggcgaggccgagagaggccccagattccccagagccagcagcgaggccaccatcagagagaacgccccccccggcacccccatcgtgagccccagagccgtgcacgccggcggcaccaacggccccatcacctacagcatcctgagcggcaacgagaagggcaccttcagcatccagcccagcaccggcgccatcaccgtgagaagcgccgagggcctggacttcgaggtgagccccagactgagactggtgctgcaggccgagagcggcggcgccttcgccttcaccgtgctgaccctgaccctgcaggacgccaacgacaacgcccccagattcctgagaccccactacgtggccttcctgcccgagagcagacccctggagggccccctgctgcaggtggaggccgacgacctggaccagggcagcggcggccagatcagctacagcctggccgccagccagcccgccagaggcctgttccacgtggaccccaccaccggcaccatcaccaccaccgccatcctggacagagagatctgggccgagaccagactggtgctgatggccaccgacagaggcagccccgccctggtgggcagcgccaccctgaccgtgatggtgatcgacaccaacgacaacagacccaccatcccccagccctgggagctgagagtgagcgaggacgccctgctgggcagcgagatcgcccaggtgaccggcaacgacgtggacagcggccccgtgctgtggtacgtgctgagccccagcggcccccaggaccccttcagcgtgggcagatacggcggcagagtgagcctgaccggccccctggacttcgagcagtgcgacagataccagctgcagctgctggcccacgacggcccccacgagggcagagccaacctgaccgtgctggtggaggacgtgaacgacaacgcccccgccttcagccagagcctgtaccaggtgatgctgctggagcacaccccccccggcagcgccatcctgagcgtgagcgccaccgacagagacagcggcgccaacggccacatcagctaccacctggccagccccgccgacggcttcagcgtggaccccaacaacggcaccctgttcaccatcgtgggcaccgtggccctgggccacgacggcagcggcgccgtggacgtggtgctggaggccagagaccacggcgcccccggcagagccgccagagccaccgtgcacgtgcagctgcaggaccagaacgaccacgcccccagcttcaccctgagccactacagagtggccgtgaccgaggacctgccccccggcagcaccctgctgaccctggaggccaccgacgccgacggcagcagaagccacgccgccgtggactacagcatcatcagcggcaactggggcagagtgttccagctggagcccagactggccgaggccggcgagagcgccggccccggccccagagccctgggctgcctggtgctgctggagcccctggacttcgagagcctgacccagtacaacctgaccgtggccgccgccgacagaggccagcccccccagagcagcgtggtgcccgtgaccgtgaccgtgctggacgtgaacgacaacccccccgtgttcaccagagccagctacagagtgaccgtgcccgaggacacccccgtgggcgccgagctgctgcacgtggaggccagcgacgccgaccccggcccccacggcctggtgagattcaccgtgagcagcggcgaccccagcggcctgttcgagctggacgagagcagcggcaccctgagactggcccacgccctggactgcgagacccaggccagacaccagctggtggtgcaggccgccgaccccgccggcgcccacttcgccctggcccccgtgaccatcgaggtgcaggacgtgaacgaccacggccccgccttccccctgaacctgctgagcaccagcgtggccgagaaccagccccccggcaccctggtgaccaccctgcacgccatcgacggcgacgccggcgccttcggcagactgagatacagcctgctggaggccggccccggccccgagggcagagaggccttcgccctgaacagcagcaccggcgagctgagagccagagtgcccttcgactacgagcacaccgagagcttcagactgctggtgggcgccgccgacgccggcaacctgagcgccagcgtgaccgtgagcgtgctggtgaccggcgaggacgagtacgaccccgtgttcctggcccccgccttccacttccaggtgcccgagggcgccagaagaggccacagcctgggccacgtgcaggccaccgacgaggacggcggcgccgacggcctggtgctgtacagcctggccaccagcagcccctacttcggcatcaaccagaccaccggcgccctgtacctgagagtggacagcagagcccccggcagcggcaccgccaccagcggcggcggcggcagaaccagaagagaggcccccagagagctgagactggaggtgatcgccagaggccccctgcccggcagcagaagcgccaccgtgcccgtgaccgtggacatcacccacaccgccctgggcctggcccccgacctgaacctgctgctggtgggcgccgtggccgccagcctgggcgtggtggtggtgctggccctggccgccctggtgctgggcctggtgagagccagaagcagaaaggccgaggccgcccccggccccatgagccaggccgcccccctggccagcgacagcctgcagaagctgggcagagagccccccagccccccccccagcgagcacctgtaccaccagaccctgcccagctacggcggccccggcgccggcggcccctaccccagaggcggcagcctggaccccagccacagcagcggcagaggcagcgccgaggccgccgaggacgacgagatcagaatgatcaacgagttccccagagtggccagcgtggccagcagcctggccgccagaggccccgacagcggcatccagcaggacgccgacggcctgagcgacaccagctgcgagccccccgcccccgacacctggtacaagggcagaaaggccggcctgctgctgcccggcgccggcgccaccctgtacagagaggagggcccccccgccaccgccaccgccttcctgggcggctgcggcctgagccccgcccccaccggcgactacggcttccccgccgacggcaagccctgcgtggccggcgccctgaccgccatcgtggccggcgaggaggagctgagaggcagctacaactgggactacctgctgagctggtgcccccagttccagcccctggccagcgtgttcaccgagatcgccagactgaaggacgaggccagaccctgcccccccgcccccagaatcgaccccccccccctgatcaccgccgtggcccaccccggcgccaagagcgtgccccccaagcccgccaacaccgccgccgccagagccatcttcccccccgccagccacagaagccccatcagccacgagggcagcctgagcagcgccgccatgagccccagcttcagccccagcctgagccccctggccgccagaagccccgtggtgagccccttcggcgtggcccagggccccagcgccagcgccctgagcgccgagagcggcctggagccccccgacgacaccgagctgcacatctag

SEQ ID NO: 17793 - DNA, 462 bp, Artificial Sequence
  Description of Artificial Sequence: Synthetic coding sequence
atgaaggccccctgcccccagctgccctgcccccccgccagccaccccctgtgcctgctgtggctgctggcccaccccctgagccaccacctgggctggcccagagtgccccagccccagcacagcgcccagagcctggcctggagccacctgatgaccagaagctgcaccagcagctgcggccccggctgggcccccacctgggacgcccacagcgtgcccaacgccggccccaccctgagcctgccctgggccgccagcgactacgactggctgagaggcggccaccaccaggcccccgccctgcaccccgagctgcccagccccctgagagtgctgggcccccagaagccctgctgcagcctgacctgcgaccaggtgcagtgcggcgagaagtacgagggcggcagcagccccggcttcagcagcgtgagagacccctgccccgcccccgccccctag

SEQ ID NO: 17794 - DNA, 2121 bp, Artificial Sequence
  Description of Artificial Sequence: Synthetic coding sequence
atggacatcaagcaccaccagaacggcaccagaggccagagaagaaagcagccccacaccaccgtgcagagactgctgacctggggcctgcccgtgagctgcagctggttcctgtggagacagcccggcgagttccccgtgaccgccctgctgctgggcgccggcgccggcggcctgctggccatcggcctgttccagctgctggtgaaccccatgaacatctacgaggagcagaagatcatgttcctgtacagcctggtgggcctgggcgccatgggctggggcaccagcccccacatcagatgcgccagcctgctgctggtgcccaagatgctgggcaaggagggcagactgttcgtgctgggctacgccctggccgccatctacgtgggccccgtggccaacctgagacacaacctgaacaacgtgatcgccagcctgggctgcaccgtggagctgcagatcaacaacaccagagccgcctggagaatcagcaccgcccccctgagagccatgttcaaggacctgctgagcagcaaggagctgctgagagccgagaccagaaacatcagcgccaccttcgaggacctggacgcccaggtgaacagcgagaccggctacacccccgaggacaccatggacagcggcgagaccgcccagggcagagaggccagacaggcccccgccagcagactgcacctgagcacccagaagatgtacgagctgaagaccaagctgagatgcagctacgtggtgaaccaggccatcctgagctgcagaagatggttcgacagaaagcacgagcagtgcatgaagcacatctgggtgcccctgctgacccacctgctgtgcctgcccatgaagttcaagttcttctgcggcatcgccaaggtgatggaggtgtggtgcagaaacagaatccccgtggagggcaacttcggccagacctacgacagcctgaaccagagcatcagaggcctggacggcgagttcagcgccaacatcgacttcaaggaggagaagcaggccggcgtgctgggcctgaacaccagctgggagagagtgagcaccgaggtgagagactacgtgtacagacaggaggccagactggagtgggccctgggcctgctgcacgtgctgctgagctgcaccttcctgctggtgctgcacgccagcttcagctacatggacagctacaaccacgacatcagattcgacaacatctacatcagcacctacttctgccagatcgacgacagaagaaagaagctgggcaagagaaccctgctgcccctgagaaaggccgaggagaagaccgtgatcttcccctgcaagcccaccatccaggccagcgagatgagcaacgtggtgagagagctgctggagaccctgcccatcctgctgctgctggtggtgctgtgcggcctggactgggccctgtacagcatcttcgacaccatcagacaccacagcttcctgcagtacagcttcagaagcagccacaagctggaggtgaaggtgggcggcgacagcatgctggccagactgctgagaaagaccatcggcgccctgaacaccagcagcgagaccgtgatggagagcaacaacatgccctgcctgccccagcccgtgggcctggacgccagagcctactggagagccgccgtgcccatcggcctgctggtgtgcctgtgcctgctgcaggccttcggctacagactgagaagagtgatcgccgccttctacttccccaagagagagaagaagagaatcctgttcctgtacaacgacctgctgaagaagagagccgccttcaccaagctgagaagagccgccatcctgagaagagagagacagcagaaggcccccagacaccccctggccgacatcctgcacagaggctgccccctgctgagaagatggctgtgcagaagatgcgtggtgtgccaggcccccgagacccccgagagctacgtgtgcagaaccctggactgcgaggccgtgtactgctggagctgctgggacgacatgagacagagatgccccgtgtgcacccccagagaggagctgagcagcagcgccttcagcgacagcaacgacgacaccgcctacgccggctag

SEQ ID NO: 17795 - DNA, 1995 bp, Artificial Sequence
  Description of Artificial Sequence: Synthetic coding sequence
atggacatcaagcaccaccagaacggcaccagaggccagagaagaaagcagccccacaccaccgtgcagagactgctgacctggggcctgcccgtgagctgcagctggttcctgtggagacagcccggcgagttccccgtgaccgccctgctgctgggcgccggcgccggcggcctgctggccatcggcctgttccagctgctggtgaaccccatgaacatctacgaggagcagaagatcatgttcctgtacagcctggtgggcctgggcgccatgggctggggcaccagcccccacatcagatgcgccagcctgctgctggtgcccaagatgctgggcaaggagggcagactgttcgtgctgggctacgccctggccgccatctacgtgggccccgtggccaacctgagacacaacctgaacaacgtgatcgccagcctgggctgcaccgtggagctgcagatcaacaacaccagagccgcctggagaatcagcaccgcccccctgagagccatgttcaaggacctgctgagcagcaaggagctgctgagagccgagaccagaaacatcagcgccaccttcgaggacctggacgcccaggtgaacagcgagaccggctacacccccgaggacaccatggacagcggcgagaccgcccagggcagagaggccagacaggcccccgccagcagactgcacctgagcacccagaagatgtacgagctgaagaccaagctgagatgcagctacgtggtgaaccaggccatcctgagctgcagaagatggttcgacagaaagcacgagcagtgcatgaagcacatctgggtgcccctgctgacccacctgctgtgcctgcccatgaagttcaagttcttctgcggcatcgccaaggtgatggaggtgtggtgcagaaacagaatccccgtggagggcaacttcggccagacctacgacagcctgaaccagagcatcagaggcctggacggcgagttcagcgccaacatcgacttcaaggaggagaagcaggccggcgtgctgggcctgaacaccagctgggagagagtgagcaccgaggtgagagactacgtgtacagacaggaggccagactggagtgggccctgggcctgctgcacgtgctgctgagctgcaccttcctgctggtgctgcacgccagcttcagctacatggacagctacaaccacgacatcagattcgacaacatctacatcagcacctacttctgccagatcgacgacagaagaaagaagctgggcaagagaaccctgctgcccctgagaaaggccgaggagaagaccgtgatcttcccctgcaagcccaccatccaggccagcgagatgagcaacgtggtgagagagctgctggagaccctgcccatcctgctgctgctggtggtgctgtgcggcctggactgggccctgtacagcatcttcgacaccatcagacaccacagcttcctgcagtacagcttcagaagcagccacaagctggaggtgaaggtgggcggcgacagcatgctggccagactgctgagaaagaccatcggcgccctgaacaccagcagcgagaccgtgatggagagcaacaacatgccctgcctgccccagcccgtgggcctggacgccagagcctactggagagccgccgtgcccatcggcctgctggtgtgcctgtgcctgctgcaggccttcggctacagactgagaagagtgatcgccgccttctacttccccaagagagagaagaagagaatcctgttcctgtacaacgacctgctgaagaagagagccgccttcaccaagctgagaagagccgccatcctgagaagagagagacagcagaaggcccccgtgttcaccgagccccagttcctgcccctgaagaacggcaagaccggcgagatctgcaaggcctgcagcctggagatcagcctggagtggtggagcggcgtgggcctgagatgccagagagcctag

SEQ ID NO: 17796 - DNA, 1995 bp, Artificial Sequence; identical to SEQ ID NO: 17795
  Description of Artificial Sequence: Synthetic coding sequence

SEQ ID NO: 17797 - DNA, 2046 bp, Artificial Sequence
  Description of Artificial Sequence: Synthetic coding sequence
atggacatcaagcaccaccagaacggcaccagaggccagagaagaaagcagccccacaccaccgtgcagagactgctgacctggggcctgcccgtgagctgcagctggttcctgtggagacagcccggcgagttccccgtgaccgccctgctgctgggcgccggcgccggcggcctgctggccatcggcctgggcgccatgggctggggcaccagcccccacatcagatgcgccagcctgctgctggtgcccaagatgctgggcaaggagggcagactgttcgtgctgggctacgccctggccgccatctacgtgggccccgtggccaacctgagacacaacctgaacaacgtgatcgccagcctgggctgcaccgtggagctgcagatcaacaacaccagagccgcctggagaatcagcaccgcccccctgagagccatgttcaaggacctgctgagcagcaaggagctgctgagagccgagaccagaaacatcagcgccaccttcgaggacctggacgcccaggtgaacagcgagaccggctacacccccgaggacaccatggacagcggcgagaccgcccagggcagagaggccagacaggcccccgccagcagactgcacctgagcacccagaagatgtacgagctgaagaccaagctgagatgcagctacgtggtgaaccaggccatcctgagctgcagaagatggttcgacagaaagcacgagcagtgcatgaagcacatctgggtgcccctgctgacccacctgctgtgcctgcccatgaagttcaagttcttctgcggcatcgccaaggtgatggaggtgtggtgcagaaacagaatccccgtggagggcaacttcggccagacctacgacagcctgaaccagagcatcagaggcctggacggcgagttcagcgccaacatcgacttcaaggaggagaagcaggccggcgtgctgggcctgaacaccagctgggagagagtgagcaccgaggtgagagactacgtgtacagacaggaggccagactggagtgggccctgggcctgctgcacgtgctgctgagctgcaccttcctgctggtgctgcacgccagcttcagctacatggacagctacaaccacgacatcagattcgacaacatctacatcagcacctacttctgccagatcgacgacagaagaaagaagctgggcaagagaaccctgctgcccctgagaaaggccgaggagaagaccgtgatcttcccctgcaagcccaccatccaggccagcgagatgagcaacgtggtgagagagctgctggagaccctgcccatcctgctgctgctggtggtgctgtgcggcctggactgggccctgtacagcatcttcgacaccatcagacaccacagcttcctgcagtacagcttcagaagcagccacaagctggaggtgaaggtgggcggcgacagcatgctggccagactgctgagaaagaccatcggcgccctgaacaccagcagcgagaccgtgatggagagcaacaacatgccctgcctgccccagcccgtgggcctggacgccagagcctactggagagccgccgtgcccatcggcctgctggtgtgcctgtgcctgctgcaggccttcggctacagactgagaagagtgatcgccgccttctacttccccaagagagagaagaagagaatcctgttcctgtacaacgacctgctgaagaagagagccgccttcaccaagctgagaagagccgccatcctgagaagagagagacagcagaaggcccccagacaccccctggccgacatcctgcacagaggctgccccctgctgagaagatggctgtgcagaagatgcgtggtgtgccaggcccccgagacccccgagagctacgtgtgcagaaccctggactgcgaggccgtgtactgctggagctgctgggacgacatgagacagagatgccccgtgtgcacccccagagaggagctgagcagcagcgccttcagcgacagcaacgacgacaccgcctacgccggctag

SEQ ID NO: 17798 - DNA, 1920 bp, Artificial Sequence
  Description of Artificial Sequence: Synthetic coding sequence
atgcccaaggtgatgaaggacgtggtgcaccccctgggcggcgaggagcccagcatggccagagccgtggtgagaagcgtgggcggcttcaccctgggcctgagcctggccaccgcctacggcctgctggagctgctggtggagggccacagcccctggggctgcctggtgggcaccctgaccctggccgccttcctgagcctgggcatgggcttcagcagacaggtgagagccaccgtgctgctgctgctgccccaggccttcagcagacagggcagaaccctgctgctggtggccgccttcggcctggtgctgcagggcccctgcgccaacaccctgagaaacttcaccagagccagcgaggccgtggcctgcggcgccgagctggccctgaaccagaccgccgaggtgctgcagagagccaagcagcccctggtgagcgccctgaacaagatcaaggccatcgccagaaagaccaaggaggtggccgacagagtgagaaagttcttcagaagcatcatggacggcgtgaagcacatcgccagagccctgagaaacgtgtggcagtggctgctgcacatcggcgacgtgtgcaacagcgagctgggcaacccctacctgaagtgcgccagagtgttcgacgacgccaaggacagctgcatgatggtgatcccccaggcctaccacctgtgctacgtgctgatgcccttcaagctggccctgtgcggcctggccagcctggtgcaggtgttctgcgtgatccccaagtacatccagcccttcctgagacagaccatcggcacccccgtgatccagctgctgaacagagtgagacaggagttcgagttcaacatgaccgccacccaccacttcagcgtggacctgaacgccagcagaagcctgagccaggtggccatggacctgcacgaggccgtgagcatgaagctgcacagagtgagagaggccctggccctgatgggcttcaccacccccctgctgctggtgctgctgtacctgcaggccctgttctacagatactgctacctgaactgggaccactacgacaacatctacatcaccagcagattcctgagaatggaggccgtgagaagcaccgccggcctgcccaccgtgctgcccctgagcgcccacgaggccagaagatacatcccccccggcagcatcttcctgagccagtgggagaagttcttctacatcctggagaccttcaacctgatcagacacctgctgctggtgctgttcctggtgttcctggactacgccgtgttctgggtgctggacctggccagacaccagctgcagggcgagatcgtggccagaagccccgtgctggtgagcctgaccgtggagggcaccggctacgccggcaacatctacagagacctggtgagcgccttcgacgtgctgcagcagggcaacatcagcatcctgagcagaagatgcctgctgagacccagcgagcccgacagcaccggctacatcgtgatcggcgtgatgtacggcctgtgcttcttcatcaccctgttcggcagctacgtgagcagactgagaagagtgatctgcgccagctactaccccagcagagagcaggagagaatcagctacctgtacaacgtgctgctgagcagaagaaccaacctgctggccgccctgcacagaagcgtgagaagaagagccgccgaccagggccacagaagcgccttcctggtgctggccagcagatgcccctgcctgggccccttcgtgagccacttctggctgcaccaggcctactgcctgggctgcggccagccccaggacgagggcgacatggagaacaccgtgagctgcagcacccccggctgccagggcttcatctgcaagtggcactgcagcagcagcctggtgtgcaccccctag

SEQ ID NO: 17799 - DNA, 2322 bp, Artificial Sequence
  Description of Artificial Sequence: Synthetic coding sequence
atgcccaaggtgatgaaggacgtggtgcaccccctgggcggcgaggagcccagcatggccagagccgtggtgagaagcgtgggcggcttcaccctgggcctgagcctggccaccgcctacggcctgctggagctgctggtggagggccacagcccctggggctgcctggtgggcaccctgaccctggccgccttcctgagcctgggcatgggcttcagcagacaggtgagagccaccgtgctgctgctgctgccccaggccttcagcagacagggcagaaccctgctgctggtggccgccttcggcctggtgctgcagggcccctgcgccaacaccctgagaaacttcaccagagccagcgaggccgtggcctgcggcgccgagctggccctgaaccagaccgccgaggtgctgcagagagccaagcagcccctggtgagcgccctgaacaagatcaaggccatcgccagaaagaccaaggaggtggccgacagagtgagaaagttcttcagaagcatcatggacggcgtgaagcacatcgccagagccctgagaaacgtgtggcagtggctgctgcacatcggcgacgtgtgcaacagcgagctgggcaacccctacctgaagtgcgccagagtgttcgacgacgccaaggacagctgcatgatggtgatcccccaggcctaccacctgtgctacgtgctgatgcccttcaagctggccctgtgcggcctggccagcctggtgcaggtgttctgcgtgatccccaagtacatccagcccttcctgagacagaccatcggcacccccgtgatccagctgctgaacagagtgagacaggagttcgagttcaacatgaccgccacccaccacttcagcgtggacctgaacgccagcagaagcctgagccaggtggccatggacctgcacgaggccgtgagcatgaagctgcacagagtgagagaggccctggccctgatgggcttcaccacccccctgctgctggtgctgctgtacctgcaggccctgttctacagatactgctacctgaactgggaccactacgacaacatctacatcaccagcagattcctgagaatggaggccgtgagaagcaccgccggcctgcccaccgtgctgcccctgagcgcccacgaggccagaagatacatcccccccggcagcatcttcctgagccagtgggagaagttcttctacatcctggagaccttcaacctgatcagacacctgctgctggtgctgttcctggtgttcctggactacgccgtgttctgggtgctggacctggccagacaccagctgcagggcgagatcgtggccagaagccccgtgctggtgagcctgaccgtggagggcaccggctacgccggcaacatctacagagacctggtgagcgccttcgacgtgctgcagcagggcaacatcagcatcctgagcagaagatgcctgctgagacccagcgagcccgacagcaccggctacatcgtgatcggcgtgatgtacggcctgtgcttcttcatcaccctgttcggcagctacgtgagcagactgagaagagtgatctgcgccagctactaccccagcagagagcaggagagaatcagctacctgtacaacgtgctgctgagcagaagaaccaacctgctggccgccctgcacagaagcgtgagaagaagagccgccgaccagggccacagaagcgccttcctggtgctggccagcagatgcccctgcctgggccccttcgtgagccacttctggctgcaccaggcctactgcctgggctgcggccagccccaggacgagggcgacatggagaacaccgtgagctgcagcacccccggctgccagggcctgtactgcctgacctgcttcagactgctggacaacacctgcagcgtgtgcgccagccccctgagctaccagggcgacctggacctggagctggacagcagcgacgaggagggcccccagctgtggctggccgccgcccagagaaaggaccccgagcaggcctggctgctgcagcagcagctgcaggaggtgctgggcagaagcctgagcatggagagcaccagcgagagcagcgacctggacgaggagaagggcccccagcagagaaagcacggccagcagcccctgcccgaggcccaccagcccgtgagcatcctgaccagccccgagccccacagaccccccgagaccagcagcgccaccaagggcgcccccacccccgccagcgagcccagcgtgcccctgagcccccccagcctgcccgaccccagccaccccccccccaagtag

SEQ ID NO: 17800 - DNA, 1563 bp, Artificial Sequence
  Description of Artificial Sequence: Synthetic coding sequence
atgggccccaccagaaagcccaacgtgtgcagcagactgagcagaagagccctgggctgcttcagcagagacgccggcgtggtgcagagaaccaacctgggcatcctgagagccctggtgtgccaggagagcaccaagttcaagaacgtgtggaccacccacagcagaagccccatcgcctacgagagaggcagaatctacttcgacaactacagaagatgcgtgagcagcgtggccagcgagcccagaaagctgtacgagatgcccaagtgcagcaagagcgagaagatcgaggacgccctgctgtgggagtgccccgtgggcgacatcctgcccaacagcagcgactacaagagcagcctgatcgccctgaccgcccacaactggctgctgagaatcagcgccaccaccggcaagatcctggagaagatctacctggccccctactgcaagttcagatacctgagctgggacaccccccaggaggtgatcgccgtgaagagcgcccagaacagaggcagcgccgtggccagacaggccggcatccagcagcacgtgctgctgtacctggccgtgttcagagtgctgcccttcagcctggtgggcatcctggagatcaacaagaagatcttcggcaacgtgaccgacgccaccctgagccacggcatcctgatcgtgatgtacagcagcggcctggtgagactgtacagcttccagaccatcgccgagcagttcatgcagcagaagctggacctgggctgcgcctgcagatggggcggcaccaccggcaccgtgggcgaggcccccttcggcatcccctgcaacatcaagatcaccgacatgccccccctgctgttcgaggtgagcagcctggagaacgccttccagatcggcggccacccctggcactacatcgtgacccccaacaagaagaagcagaagggcgtgttccacatctgcgccctgaaggacaacagcctggccaagaacggcatccaggagatggactgctgcagcctggagagcgactggatctacttccaccccgacgccagcggcagaatcatccacgtgggccccaaccaggtgaaggtgctgaagctgaccgagatcgagaacaacagcagccagcaccagatcagcgaggacttcgtgatcctggccaacagagagaaccacaagaacgagaacgtgctgaccgtgaccgccagcggcagagtggtgaagaagagcttcaacctgctggacgacgaccccgagcaggagaccttcaagatcgtggactacgaggacgagctggacctgctgagcgtggtggccgtgacccagatcgacgccgagggcaaggcccacctggacttccactgcaacgagtacggcaccctgctgaagagcatccccctggtggagagctgggacgtgacctacagccacgaggtgtacttcgacagagacctggtgctgcacatcgagcagaagcccaacagagtgttcagctgctacgtgtaccagatgatctgcgacaccggcgaggaggaggagaccatcaacagaagctgctag

SEQ ID NO: 17801 - DNA, 813 bp, Artificial Sequence
  Description of Artificial Sequence: Synthetic coding sequence
agacacagcaccacctgcttcgccgtgccctgcagcgtgcccagcagcaccttcttcacctgcagagacagcagagaccagcagaaggacatgccccccctgctgttcgaggtgagcagcctggagaacgccttccagatcggcggccacccctggcactacatcgtgacccccaacaagaagaagcagaagggcgtgttccacatctgcgccctgaaggacaacagcctggccaagaacggcatccaggagatggactgctgcagcctggagagcgactggatctacttccaccccgacgccagcggcagaatcatccacgtgggccccaaccaggtgaaggtgctgaagctgaccgagatcgagaacaacagcagccagcaccagatcagcgaggacttcgtgatcctggccaacagagagaaccacaagaacgagaacgtgctgaccgtgaccgccagcggcagagtggtgaagaagagcttcaacctgctggacgacgaccccgagcaggagaccttcaagatcgtggactacgaggacgagctggacctgctgagcgtggtggccgtgacccagatcgacgccgagggcaaggcccacctggacttccactgcaacgagtacggcaccctgctgaagagcatccccctggtggagagctgggacgtgacctacagccacgaggtgtacttcgacagagacctggtgctgcacatcgagcagaagcccaacagagtgttcagctgctacgtgtaccagatgatctgcgacaccggcgaggaggaggagaccatcaacagaagctgctag

SEQ ID NO: 17802 - DNA, 1362 bp, Artificial Sequence
  Description of Artificial Sequence: Synthetic coding sequence
atgggccccaccagaaagcccaacgtgtgcagcagactgagcagaagagccctgggctgcttcagcagagacgccggcgtggtgcagagaaccaacctgggcatcctgagagccctggtgtgccaggagagcaccaagttcaagaacgtgtggaccacccacagcagaagccccatcgcctacgagagaggcagaatctacttcgacaactacagaagatgcgtgagcagcgtggccagcgagcccagaaagctgtacgagatgcccaagtgcagcaagagcgagaagatcgaggacgccctgctgtgggagtgccccgtgggcgacatcctgcccaacagcagcgactacaagagcagcctgatcgccctgaccgcccacaactggctgctgagaatcagcgccaccaccggcaagatcctggagaagatctacctggccccctactgcaagttcagatacctgagctgggacaccccccaggaggtgatcgccgtgaagagcgcccagaacagaggcagcgccgtggccagacaggccggcatccagcagcacgtgctgctgtacctggccgtgttcagagtgctgcccttcagcctggtgggcatcctggagatcaacaagaagatcttcggcaacgtgaccgacgccaccctgagccacggcatcctgatcgtgatgtacagcagcggcctggtgagactgtacagcttccagaccatcgccgagcagttcatgcagcagaagctggacctgggctgcgcctgcagatggggcggcaccaccggcaccgtgggcgaggcccccttcggcatcccctgcaacatcaagatcaccgacatgccccccctgctgttcgaggtgagcagcctggagaacgccttccagatcggcggccacccctggcactacatcgtgacccccaacaagaagaagcagaagggcgtgttccacatctgcgccctgaaggacaacagcctgaacgagaacgtgctgaccgtgaccgccagcggcagagtggtgaagaagagcttcaacctgctggacgacgaccccgagcaggagaccttcaagatcgtggactacgaggacgagctggacctgctgagcgtggtggccgtgacccagatcgacgccgagggcaaggcccacctggacttccactgcaacgagtacggcaccctgctgaagagcatccccctggtggagagctgggacgtgacctacagccacgaggtgtacttcgacagagacctggtgctgcacatcgagcagaagcccaacagagtgttcagctgctacgtgtaccagatgatctgcgacaccggcgaggaggaggagaccatcaacagaagctgctag

SEQ ID NO: 17803 - DNA, 945 bp, Artificial Sequence
  Description of Artificial Sequence: Synthetic coding sequence
atggtggcccccgtgtggtacctggtggccgccgccctgctggtgggcttcatcctgttcctgaccagaagcagaggcagagccgccagcgccggccaggagcccctgcacaacgaggagctggccggcgccggcagagtggcccagcccggccccctggagcccgaggagcccagagccggcggcagacccagaagaagaagagacctgggcagcagactgcaggcccagagaagagcccagagagtggcctgggccgaggccgacgagaacgaggaggaggccgtgatcctggcccaggaggaggagggcgtggagaagcccgccgagacccacctgagcggcaagatcggcgccaagaagctgagaaagctggaggagaagcaggccagaaaggcccagagagaggccgaggaggccgagagagaggagagaaagagactggagagccagagagaggccgagtggaagaaggaggaggagagactgagactggaggaggagcagaaggaggaggaggagagaaaggccagagaggagcaggcccagagagagcacgaggagtacctgaagctgaaggaggccttcgtggtggaggaggagggcgtgggcgagaccatgaccgaggagcagagccagagcttcctgaccgagttcatcaactacatcaagcagagcaaggtggtgctgctggaggacctggccagccaggtgggcctgagaacccaggacaccatcaacagaatccaggacctgctggccgagggcaccatcaccggcgtgatcgacgacagaggcaagttcatctacatcacccccgaggagctggccgccgtggccaacttcatcagacagagaggcagagtgagcatcgccgagctggcccaggccagcaacagcctgatcgcctggggcagagagagccccgcccaggcccccgcctag

SEQ ID NO: 17804 - DNA, 897 bp, Artificial Sequence
  Description of Artificial Sequence: Synthetic coding sequence
atggtggcccccgtgtggtacctggtggccgccgccctgctggtgggcttcatcctgttcctgaccagaagcagaggcagagccgccagcgccggccaggagcccctgcacaacgaggagctggccggcgccggcagagtggcccagcccggccccctggagcccgaggagcccagagccggcggcagacccagaagaagaagagacctgggcagcagactgcaggcccagagaagagcccagagagtggcctgggccgaggccgacgagaacgaggaggaggccgtgatcctggcccaggaggaggagggcgtggagaagcccgccgagacccacctgagcggcaagatcggcgccaagaagctgagaaagctggaggagaagcaggccagaaaggcccagagagaggccgaggaggccgagagagaggagagaaagagactggagagccagagagaggccgagtggaagaaggaggaggagagactgagactggaggaggagcagaaggaggaggaggagagaaaggccagagaggagcaggcccagagagagcacgaggagtacctgaagctgaaggaggccttcgtggtggaggaggagggcgtgggcgagaccatgaccgaggagcagagccagagcttcctgaccgagttcatcaactacatcaagcagagcaaggtggtgctgctggaggacctggccagccaggtgggcctgagaacccaggtgagccccggcacctggcccgccgtgtgcagcgtggccagaggcctgtggctggccgagagaacctgccccaaggacagagtgctgatgcacagactgccctgcccccagcccagagtgagcagcgcccagaagagccccggcaccctgggcatcctgcacttctag

SEQ ID NO: 17805 - DNA, 942 bp, Artificial Sequence
  Description of Artificial Sequence: Synthetic coding sequence
atggtggcccccgtgtggtacctggtggccgccgccctgctggtgggcttcatcctgttcctgaccagaagcagaggcagagccgccagcgccggccaggagcccctgcacaacgaggagctggccggcgccggcagagtggcccagcccggccccctggagcccgaggagcccagagccggcggcagacccagaagaagaagagacctgggcagcagactgcaggcccagagaagagcccagagagtggcctgggccgaggccgacgagaacgaggaggaggccgtgatcctggcccaggaggaggagggcgtggagaagcccgccgagacccacctgagcggcaagatcggcgccaagaagctgagaaagctggaggagaagcaggccagaaaggcccagagagaggccgaggaggccgagagagaggagagaaagagactggagagccagagagaggccgagtggaagaaggaggaggagagactgagactggaggaggagcagaaggaggaggaggagagaaaggccagagaggagcaggcccagagagagcacgaggagtacctgaagctgaaggaggccttcgtggtggaggaggagggcgtgggcgagaccatgaccgaggagcagagccagagcttcctgaccgagttcatcaactacatcaagcagagcaaggtggtgctgctggaggacctggccagccaggtgggcctgagaacccaggtgagccccggcacctggcccgccgtgtgcagcgtggccagaggcctgtggctggccgagagaacctgccccaaggacagagtgctgatgcacagactgccctgcccccagcccagagtgagcagcgcccagaagagccccggcaccctgggcatcctgcacttcagcctgatcgcctggggcagagagagccccgcccaggcccccgcctag

SEQ ID NO: 17806 - DNA, 324 bp, Artificial Sequence
  Description of Artificial Sequence: Synthetic coding sequence
atggccaacgaggtgcaggacctgctgagccccagaaagggcggccacccccccgccgtgaaggccggcggcatgagaatcagcaagaagcaggagatcggcaccctggagagacacaccaagaagaccggcttcgagaagaccagcgccatcgccaacgtggccaagatccagaccctggacgccctgaacgacgccctggagaagctgaactacaagttccccgccaccgtgcacatggcccaccagaagcccacccccgccctggagaaggtggtgcccctgaagagaatctacatcatccagcagcccagaaagtgctag

SEQ ID NO: 17807 - DNA, 2760 bp, Artificial Sequence
  Description of Artificial Sequence: Synthetic coding sequence
atggccagcgccaccgccgccgccgccagaagaggcctgggcagagccctgcccctgttctggagaggctaccagaccgagagaggcgtgtacggctacagacccagaaagcccgagagcagagagccccagggcgccctggagagaccccccgtggaccacggcctggccagactggtgaccgtgtactgcgagcacggccacaaggccgccaagatcaaccccctgttcaccggccaggccctgctggagaacgtgcccgagatccaggccctggtgcagaccctgcagggccccttccacaccgccggcctgctgaacatgggcaaggaggaggccagcctggaggaggtgctggtgtacctgaaccagatctactgcggccagatcagcatcgagaccagccagctgcagagccaggacgagaaggactggttcgccaagagattcgaggagctgcagaaggagaccttcaccaccgaggagagaaagcacctgagcaagctgatgctggagagccaggagttcgaccacttcctggccaccaagttcagcaccgtgaagagatacggcggcgagggcgccgagagcatgatgggcttcttccacgagctgctgaagatgagcgcctacagcggcatcaccgacgtgatcatcggcatgccccacagaggcagactgaacctgctgaccggcctgctgcagttcccccccgagctgatgttcagaaagatgagaggcctgagcgagttccccgagaacttcagcgccaccggcgacgtgctgagccacctgaccagcagcgtggacctgtacttcggcgcccaccaccccctgcacgtgaccatgctgcccaaccccagccacctggaggccgtgaaccccgtggccgtgggcaagaccagaggcagacagcagagcagacaggacggcgactacagccccgacaacagcgcccagcccggcgacagagtgatctgcctgcaggtgcacggcgacgccagcttctgcggccagggcatcgtgcccgagaccttcaccctgagcaacctgccccacttcagaatcggcggcagcgtgcacctgatcgtgaacaaccagctgggctacaccacccccgccgagagaggcagaagcagcctgtactgcagcgacatcggcaagctggtgggctgcgccatcatccacgtgaacggcgacagccccgaggaggtggtgagagccaccagactggccttcgagtaccagagacagttcagaaaggacgtgatcatcgacctgctgtgctacagacagtggggccacaacgagctggacgagcccttctacaccaaccccatcatgtacaagatcatcagagccagaaagagcatccccgacacctacgccgagcacctgatcgccggcggcctgatgacccaggaggaggtgagcgagatcaagagcagctactacgccaagctgaacgaccacctgaacaacatggcccactacagaccccccgccctgaacctgcaggcccactggcagggcctggcccagcccgaggcccagatcaccacctggagcaccggcgtgcccctggacctgctgagattcgtgggcatgaagagcgtggaggtgcccagagagctgcagatgcacagccacctgctgaagacccacgtgcagagcagaatggagaagatgatggacggcatcaagctggactgggccaccgccgaggccctggccctgggcagcctgctggcccagggcttcaacgtgagactgagcggccaggacgtgggcagaggcaccttcagccagagacacgccatcgtggtgtgccaggagaccgacgacacctacatccccctgaaccacatggaccccaaccagaagggcttcctggaggtgagcaacagccccctgagcgaggaggccgtgctgggcttcgagtacggcatgagcatcgagagccccaagctgctgcccctgtgggaggcccagttcggcgacttcttcaacggcgcccagatcatcttcgacaccttcatcagcggcggcgaggccaagtggctgctgcagagcggcatcgtgatcctgctgccccacggctacgacggcgccggccccgaccacagcagctgcagaatcgagagattcctgcagatgtgcgacagcgccgaggagggcgtggacggcgacaccgtgaacatgttcgtggtgcaccccaccacccccgcccagtacttccacctgctgagaagacagatggtgagaaacttcagaaagcccctgatcgtggccagccccaagatgctgctgagactgcccgccgccgtgagcaccctgcaggagatggcccccggcaccaccttcaaccccgtgatcggcgacagcagcgtggaccccaagaaggtgaagaccctggtgttctgcagcggcaagcacttctacagcctggtgaagcagagagagagcctgggcgccaagaagcacgacttcgccatcatcagagtggaggagctgtgccccttccccctggacagcctgcagcaggagatgagcaagtacaagcacgtgaaggaccacatctggagccaggaggagccccagaacatgggcccctggagcttcgtgagccccagattcgagaagcagctggcctgcaagctgagactggtgggcagaccccccctgcccgtgcccgccgtgggcatcggcaccgtgcacctgcaccagcacgaggacatcctggccaagaccttcgcctag

SEQ ID NO: 17808 - DNA, 486 bp, Artificial Sequence
  Description of Artificial Sequence: Synthetic coding sequence
ggcagacagcagagcagacaggacggcgactacagccccgacaacagcgcccagcccggcgacagagtgatctgcctgcaggtgcacggcgacgccagcttctgcggccagggcatcgtgcccgagaccttcaccctgagcaacctgccccacttcagaatcggcggcagcgtgcacctgatcgtgaacaaccagctgggctacaccacccccgccgagagaggcagaagcagcctgtactgcagcgacatcggcaagctggtgggctgcgccatcatccacgtgaacggcgacagccccgaggaggtggtgagagccaccagactggccttcgagtaccagagacagttcagaaaggacgtgatcatcgacctgctgtgctacagacagtggggccacaacgagctggacgagcccttctacaccaaccccatcatgtacaagatcatcagatacaactacaagcccctgtgcgacatgccctag

SEQ ID NO: 17809 - DNA, 927 bp, Artificial Sequence
  Description of Artificial Sequence: Synthetic coding sequence
atggccagcgccaccgccgccgccgccagaagaggcctgggcagagccctgcccctgttctggagaggctaccagaccgagagaggcgtgtacggctacagacccagaaagcccgagagcagagagccccagggcgccctggagagaccccccgtggaccacggcctggccagactggtgaccgtgtactgcgagcacggccacaaggccgccaagatcaaccccctgttcaccggccaggccctgctggagaacgtgcccgagatccaggccctggtgcagaccctgcagggccccttccacaccgccggcctgctgaacatgggcaaggaggaggccagcctggaggaggtgctggtgtacctgaaccagatctactgcggccagatcagcatcgagaccagccagctgcagagccaggacgagaaggactggttcgccaagagattcgaggagctgcagaaggagaccttcaccaccgaggagagaaagcacctgagcaagctgatgctggagagccagctgatgttcagaaagatgagaggcctgagcgagttccccgagaacttcagcgccaccggcgacgtgctgagccacctgaccagcagcgtggacctgtacttcggcgcccaccaccccctgcacgtgaccatgctgcccaaccccagccacctggaggccgtgaaccccgtggccgtgggcaagaccagaggcagacagcagagcagacaggacggcgactacagccccgacaacagcgcccagcccggcgacagagtgatctgcctgcaggtgcacggcgacgccagcttctgcggccagggcatcgtgcccgagaccttcaccctgagcaacctgccccacttcagaatcggcggcagcgtgcacctgatcgtgaacaaccagctgggctacaccaccccctag

SEQ ID NO: 17810 - DNA, 645 bp, Artificial Sequence
  Description of Artificial Sequence: Synthetic coding sequence
tgaaagatcatcagagccagaaagagcatccccgacacctacgccgagcacctgatcgccggcggcctgatgacccaggaggaggtgagcgagatcaagagcagctactacgccaagctgaacgaccacctgaacaacatggcccactacagaccccccgccctgaacctgcaggcccactggcagggcctggcccagcccgaggcccagatcaccacctggagcaccggcgtgcccctggacctgctgagattcgtgggcatgaagagcgtggaggtgcccagagagctgcagatgcacagccacctgctgaagacccacgtgcagagcagaatggagaagatgatggacggcatcaagctggactgggccaccgccgaggccctggccctgggcagcctgctggcccagggcttcaacgtgagactgagcggccaggacgtgggcagaggcaccttcagccagagacacgccatcgtggtgtgccaggagaccgacgacacctacatccccctgaaccacatggaccccaaccagaagggcttcctggaggagagacccagcggcagctacaaggccgccagcagcagcagcttccacatggccaccatgggcctgggccagaccacccaccccgtggagtag

SEQ ID NO: 17811 - DNA, 942 bp, Artificial Sequence
  Description of Artificial Sequence: Synthetic coding sequence
atggccgcccccatgaacggccaggtgtgcgtggtgaccggcgccagcagaggcatcggcagaggcatcgccctgcagctgtgcaaggccggcgccaccgtgtacatcaccggcagacacctggacaccctgagagtggtggcccaggaggcccagagcctgggcggccagtgcgtgcccgtggtgtgcgacagcagccaggagagcgaggtgagaagcctgttcgagcaggtggacagagagcagcagggcagactggacgtgctggtgaacaacgcctacgccggcgtgcagaccatcctgaacaccagaaacaaggccttctgggagacccccgccagcatgtgggacgacatcaacaacgtgggcctgagaggccactacttctgcagcgtgtacggcgccagactgatggtgcccgccggccagggcctgatcgtggtgatcagcagccccggcagcctgcagtacatgttcaacgtgccctacggcgtgggcaaggccgcctgcgacaagctggccgccgactgcgcccacgagctgagaagacacggcgtgagctgcgtgagcctgtggcccggcatcgtgcagaccgagctgctgaaggagcacatggccaaggaggaggtgctgcaggaccccgtgctgaagcagttcaagagcgccttcagcagcgccgagaccaccgagctgagcggcaagtgcgtggtggccctggccaccgaccccaacatcctgagcctgagcggcaaggtgctgcccagctgcgacctggccagaagatacggcctgagagacgtggacggcagacccgtgcaggactacctgagcctgagcagcgtgctgagccacgtgagcggcctgggctggctggccagctacctgcccagcttcctgagagtgcccaagtggatcatcgccctgtacaccagcaagttctag

SEQ ID NO: 17812 - DNA, 942 bp, Artificial Sequence; identical to SEQ ID NO: 17811
  Description of Artificial Sequence: Synthetic coding sequence

SEQ ID NO: 17813 - DNA, 978 bp, Artificial Sequence
  Description of Artificial Sequence: Synthetic coding sequence
ttcatcagcggcagcagcagaaagagcctgcccaaggtgaaggccatggacttcatcaccagcaccgccatcctgcccctgctgttcggctgcctgggcgtgttcggcctgttcagactgctgcagtgggtgagaggcaaggcctacctgagaaacgccgtggtggtgatcaccggcgccaccagcggcctgggcaaggagtgcgccaaggtgttctacgccgccggcgccaagctggtgctgtgcggcagaaacggcggcgccctggaggagctgatcagagagctgaccgccagccacgccaccaaggtgcagacccacaagccctacctggtgaccttcgacctgaccgacagcggcgccatcgtggccgccgccgccgagatcctgcagtgcttcggctacgtggacatcctggtgaacaacgccggcatcagctacagaggcaccatcatggacaccaccgtggacgtggacaagagagtgatggagaccaactacttcggccccgtggccctgaccaaggccctgctgcccagcatgatcaagagaagacagggccacatcgtggccatcagcagcatccagggcaagatgagcatccccttcagaagcgcctacgccgccagcaagcacgccacccaggccttcttcgactgcctgagagccgagatggagcagtacgagatcgaggtgaccgtgatcagccccggctacatccacaccaacctgagcgtgaacgccatcaccgccgacggcagcagatacggcgtgatggacaccaccaccgcccagggcagaagccccgtggaggtggcccaggacgtgctggccgccgtgggcaagaagaagaaggacgtgatcctggccgacctgctgcccagcctggccgtgtacctgagaaccctggcccccggcctgttcttcagcctgatggccagcagagccagaaaggagagaaagagcaagaacagctag

SEQ ID NO: 17814 - DNA, 978 bp, Artificial Sequence
  Description of Artificial Sequence: Synthetic coding sequence
atggtgagccccgccaccagaaagagcctgcccaaggtgaaggccatggacttcatcaccagcaccgccatcctgcccctgctgttcggctgcctgggcgtgttcggcctgttcagactgctgcagtgggtgagaggcaaggcctacctgagaaacgccgtggtggtgatcaccggcgccaccagcggcctgggcaaggagtgcgccaaggtgttctacgccgccggcgccaagctggtgctgtgcggcagaaacggcggcgccctggaggagctgatcagagagctgaccgccagccacgccaccaaggtgcagacccacaagccctacctggtgaccttcgacctgaccgacagcggcgccatcgtggccgccgccgccgagatcctgcagtgcttcggctacgtggacatcctggtgaacaacgccggcatcagctacagaggcaccatcatggacaccaccgtggacgtggacaagagagtgatggagaccaactacttcggccccgtggccctgaccaaggccctgctgcccagcatgatcaagagaagacagggccacatcgtggccatcagcagcatccagggcaagatgagcatccccttcagaagcgcctacgccgccagcaagcacgccacccaggccttcttcgactgcctgagagccgagatggagcagtacgagatcgaggtgaccgtgatcagccccggctacatccacaccaacctgagcgtgaacgccatcaccgccgacggcagcagatacggcgtgatggacaccaccaccgcccagggcagaagccccgtggaggtggcccaggacgtgctggccgccgtgggcaagaagaagaaggacgtgatcctggccgacctgctgcccagcctggccgtgtacctgagaaccctggcccccggcctgttcttcagcctgatggccagcagagccagaaaggagagaaagagcaagaacagctag

SEQ ID NO: 17815 - DNA, 4587 bp, Artificial Sequence
  Description of Artificial Sequence: Synthetic coding sequence
atgagcgtggccatcagaaagagaagctgggaggagcacgtgacccactggatgggccagcccttcaacagcgacgacagaaacaccgcctgccaccacggcctggtggccgacagcctgcaggccagcatggagaaggacgccaccctgaacgtggacagaaaggagaagtgcgtgagcctgcccgactgctgccacggcagcgagctgagagacttccccggcagacccatgggccacctgagcaaggacgtggacgagaacgacagccacgagggcgaggaccagttcctgagcctggaggccagcaccgagaccctggtgcacgtgagcgacgaggacaacaacgccgacctgtgcctgaccgacgacaagcaggtgctgaacacccagggccagaagaccagcggccagcacatgatccagggcgccggcagcctggagaaggccctgcccatcatccagagcaaccaggtgagcagcaacagctggggcatcgccggcgagaccgagctggccctggtgaaggagagcggcgagagaaaggtgaccgacagcatcagcaagagcctggagctgtgcaacgagatcagcctgagcgagatcaaggacgcccccaaggtgaacgccgtggacaccctgaacgtgaaggacatcgcccccgagaagcagctgctgaacagcgccgtgatcgcccagcagagaagaaagcccgacccccccaaggacgagaacgagagaagcacctgcaacgtggtgcagaacgagttcctggacaccccctgcaccaacagaggcctgcccctgctgaagaccgacttcggcagctgcctgctgcagccccccagctgccccaacggcatgagcgccgagaacggcctggagaagagcggcttcagccagcaccagaacaagagcccccccaaggtgaaggccgaggacggcatgcagtgcctgcagctgaaggagaccctggccacccaggagcccaccgacaaccaggtgagactgagaaagagaaaggagatcagagaggacagagacagagccagactggacagcatggtgctgctgatcatgaagctggaccagctggaccaggacatcgagaacgccctgagcaccagcagcagccccagcggcacccccaccaacctgagaagacacgtgcccgacctggagagcggcagcgagagcggcgccgacaccatcagcgtgaaccagaccagagtgaacctgagcagcgacaccgagagcaccgacctgcccagcagcacccccgtggccaacagcggcaccaagcccaagaccaccgccatccagggcatcagcgagaaggagaaggccgagatcgaggccaaggaggcctgcgactggctgagagccaccggcttcccccagtacgcccagctgtacgaggacttcctgttccccatcgacatcagcctggtgaagagagagcacgacttcctggacagagacgccatcgaggccctgtgcagaagactgaacaccctgaacaagtgcgccgtgatgaagctggagatcagcccccacagaaagagaagcgacgacagcgacgaggacgagccctgcgccatcagcggcaagtggaccttccagagagacagcaagagatggagcagactggaggagttcgacgtgttcagccccaagcaggacctggtgcccggcagccccgacgacagccaccccaaggacggccccagccccggcggcaccctgatggacctgagcgagagacaggaggtgagcagcgtgagaagcctgagcagcaccggcagcctgcccagccacgccccccccagcgaggacgccgccacccccagaaccaacagcgtgatcagcgtgtgcagcagcagcaacctggccggcaacgacgacagcttcggcagcctgcccagccccaaggagctgagcagcttcagcttcagcatgaagggccacgagaagaccgccaagagcaagaccagaagcctgctgaagagaatggagagcctgaagctgaagagcagccaccacagcaagcacaaggcccccagcaagctgggcctgatcatcagcggccccatcctgcaggagggcatggacgaggagaagctgaagcagctgaactgcgtggagatcagcgccctgaacggcaacagaatcaacgtgcccatggtgagaaagagaagcgtgagcaacagcacccagaccagcagcagcagcagccagagcgagaccagcagcgccgtgagcacccccagccccgtgaccagaaccagaagcctgagcgcctgcaacaagagagtgggcatgtacctggagggcttcgaccccttcaaccagagcaccttcaacaacgtggtggagcagaacttcaagaacagagagagctaccccgaggacaccgtgttctacatccccgaggaccacaagcccggcaccttccccaaggccctgaccaacggcagcttcagccccagcggcaacaacggcagcgtgaactggagaaccggcagcttccacggccccggccacatcagcctgagaagagagaacagcagcgacagccccaaggagctgaagagaagaaacagcagcagcagcatgagcagcagactgagcatctacgacaacgtgcccggcagcatcctgtacagcagcagcggcgacctggccgacctggagaacgaggacatcttccccgagctggacgacatcctgtaccacgtgaagggcatgcagagaatcgtgaaccagtggagcgagaagttcagcgacgagggcgacagcgacagcgccctggacagcgtgagcccctgccccagcagccccaagcagatccacctggacgtggacaacgacagaaccacccccagcgacctggacagcaccggcaacagcctgaacgagcccgaggagcccagcgagatccccgagagaagagacagcggcgtgggcgccagcctgaccagaagcaacagacacagactgagatggcacagcttccagagcagccacagacccagcctgaacagcgtgagcctgcagatcaactgccagagcgtggcccagatgaacctgctgcagaagtacagcctgctgaagctgaccgccctgctggagaagtacacccccagcaacaagcacggcttcagctgggccgtgcccaagttcatgaagagaatcaaggtgcccgactacaaggacagaagcgtgttcggcgtgcccctgaccgtgaacgtgcagagaaccggccagcccctgccccagagcatccagcaggccatgagatacctgagaaaccactgcctggaccaggtgggcctgttcagaaagagcggcgtgaagagcagaatccaggccctgagacagatgaacgagggcgccatcgactgcgtgaactacgagggccagagcgcctacgacgtggccgacatgctgaagcagtacttcagagacctgcccgagcccctgatgaccaacaagctgagcgagaccttcctgcagatctaccagtacgtgcccaaggaccagagactgcaggccatcaaggccgccatcatgctgctgcccgacgagaacagagaggtgctgcagaccctgctgtacttcctgagcgacgtgaccgccgccgtgaaggagaaccagatgacccccaccaacctggccgtgtgcctggcccccagcctgttccacctgaacaccctgaagagagagaacagcagccccagagtgatgcagagaaagcagagcctgggcaagcccgaccagaaggacctgaacgagaacctggccgccacccagggcctggcccacatgatcgccgagtgcaagaagctgttccaggtgcccgaggagatgagcagatgcagaaacagctacaccgagcaggagctgaagcccctgaccctggaggccctgggccacctgggcaacgacgacagcgccgactaccagcacttcctgcaggactgcgtggacggcctgttcaaggaggtgaaggagaagttcaagggctgggtgagctacagcaccagcgagcaggccgagctgagctacaagaaggtgagcgagggcccccccctgagactgtggagaagcgtgatcgaggtgcccgccgtgcccgaggagatcctgaagagactgctgaaggagcagcacctgtgggacgtggacctgctggacagcaaggtgatcgagatcctggacagccagaccgagatctaccagtacgtgcagaacagcatggccccccaccccgccagagactacgtggtgctgagaacctggagaaccaacctgcccaagggcgcctgcgccctgctgctgaccagcgtggaccacgacagagcccccgtggtgggcgtgagagtgaacgtgctgctgagcagatacctgatcgagccctgcggccccggcaagagcaagctgacctacatgtgcagagtggacctgagaggccacatgcccgagtggtacaccaagagcttcggccacctgtgcgccgccgaggtggtgaagatcagagacagcttcagcaaccagaacaccgagaccaaggacaccaagagcagatag

SEQ ID NO: 17816 - DNA, 1497 bp, Artificial Sequence
  Description of Artificial Sequence: Synthetic coding sequence
atgagcgtggccatcagaaagagaagctgggaggagcacgtgacccactggatgggccagcccttcaacagcgacgacagaaacaccgcctgccaccacggcctggtggccgacagcctgcaggccagcatggagaaggacgccaccctgaacgtggacagaaaggagaagtgcgtgagcctgcccgactgctgccacggcagcgagctgagagacttccccggcagacccatgggccacctgagcaaggacgtggacgagaacgacagccacgagggcgaggaccagttcctgagcctggaggccagcaccgagaccctggtgcacgtgagcgacgaggacaacaacgccgacctgtgcctgaccgacgacaagcaggtgctgaacacccagggccagaagaccagcggccagcacatgatccagggcgccggcagcctggagaaggccctgcccatcatccagagcaaccaggtgagcagcaacagctggggcatcgccggcgagaccgagctggccctggtgaaggagagcggcgagagaaaggtgaccgacagcatcagcaagagcctggagctgtgcaacgagatcagcctgagcgagatcaaggacgcccccaaggtgaacgccgtggacaccctgaacgtgaaggacatcgcccccgagaagcagctgctgaacagcgccgtgatcgcccagcagagaagaaagcccgacccccccaaggacgagaacgagagaagcacctgcaacgtggtgcagaacgagttcctggacaccccctgcaccaacagaggcctgcccctgctgaagaccgacttcggcagctgcctgctgcagccccccagctgccccaacggcatgagcgccgagaacggcctggagaagagcggcttcagccagcaccagaacaagagcccccccaaggtgaaggccgaggacggcatgcagtgcctgcagctgaaggagaccctggccacccaggagcccaccgacaaccaggtgagactgagaaagagaaaggagatcagagaggacagagacagagccagactggacagcatggtgctgctgatcatgaagctggaccagctggaccaggacatcgagaacgccctgagcaccagcagcagccccagcggcacccccaccaacctgagaagacacgtgcccgacctggagagcggcagcgagagcggcgccgacaccatcagcgtgaaccagaccagagtgaacctgagcagcgacaccgagagcaccgacctgcccagcagcacccccgtggccaacagcggcaccaagcccaagaccaccgccatccagggcatcagcgagaaggagaaggccgccgtgaagagcgtgaagctggaggtggacgaggacaagagcaccaagggcagcaacttcagcaacagcgaggtggccatcggcctgagcccctacaccttcccccagaagagactgttccacgtggccggcgaggagaacatcacctag

SEQ ID NO: 17817 - DNA, 3276 bp, Artificial Sequence
  Description of Artificial Sequence: Synthetic coding sequence
atgtgcagaaagaagcccgacaccatgatcctgacccagatcgaggccaaggaggcctgcgactggctgagagccaccggcttcccccagtacgcccagctgtacgaggacttcctgttccccatcgacatcagcctggtgaagagagagcacgacttcctggacagagacgccatcgaggccctgtgcagaagactgaacaccctgaacaagtgcgccgtgatgaagctggagatcagcccccacagaaagagaagcgacgacagcgacgaggacgagccctgcgccatcagcggcaagtggaccttccagagagacagcaagagatggagcagactggaggagttcgacgtgttcagccccaagcaggacctggtgcccggcagccccgacgacagccaccccaaggacggccccagccccggcggcaccctgatggacctgagcgagagacaggaggtgagcagcgtgagaagcctgagcagcaccggcagcctgcccagccacgccccccccagcgaggacgccgccacccccagaaccaacagcgtgatcagcgtgtgcagcagcagcaacctggccggcaacgacgacagcttcggcagcctgcccagccccaaggagctgagcagcttcagcttcagcatgaagggccacgagaagaccgccaagagcaagaccagaagcctgctgaagagaatggagagcctgaagctgaagagcagccaccacagcaagcacaaggcccccagcaagctgggcctgatcatcagcggccccatcctgcaggagggcatggacgaggagaagctgaagcagctgaactgcgtggagatcagcgccctgaacggcaacagaatcaacgtgcccatggtgagaaagagaagcgtgagcaacagcacccagaccagcagcagcagcagccagagcgagaccagcagcgccgtgagcacccccagccccgtgaccagaaccagaagcctgagcgcctgcaacaagagagtgggcatgtacctggagggcttcgaccccttcaaccagagcaccttcaacaacgtggtggagcagaacttcaagaacagagagagctaccccgaggacaccgtgttctacatccccgaggaccacaagcccggcaccttccccaaggccctgaccaacggcagcttcagccccagcggcaacaacggcagcgtgaactggagaaccggcagcttccacggccccggccacatcagcctgagaagagagaacagcagcgacagccccaaggagctgaagagaagaaacagcagcagcagcatgagcagcagactgagcatctacgacaacgtgcccggcagcatcctgtacagcagcagcggcgacctggccgacctggagaacgaggacatcttccccgagctggacgacatcctgtaccacgtgaagggcatgcagagaatcgtgaaccagtggagcgagaagttcagcgacgagggcgacagcgacagcgccctggacagcgtgagcccctgccccagcagccccaagcagatccacctggacgtggacaacgacagaaccacccccagcgacctggacagcaccggcaacagcctgaacgagcccgaggagcccagcgagatccccgagagaagagacagcggcgtgggcgccagcctgaccagaagcaacagacacagactgagatggcacagcttccagagcagccacagacccagcctgaacagcgtgagcctgcagatcaactgccagagcgtggcccagatgaacctgctgcagaagtacagcctgctgaagctgaccgccctgctggagaagtacacccccagcaacaagcacggcttcagctgggccgtgcccaagttcatgaagagaatcaaggtgcccgactacaaggacagaagcgtgttcggcgtgcccctgaccgtgaacgtgcagagaaccggccagcccctgccccagagcatccagcaggccatgagatacctgagaaaccactgcctggaccaggtgggcctgttcagaaagagcggcgtgaagagcagaatccaggccctgagacagatgaacgagggcgccatcgactgcgtgaactacgagggccagagcgcctacgacgtggccgacatgctgaagcagtacttcagagacctgcccgagcccctgatgaccaacaagctgagcgagaccttcctgcagatctaccagtacgtgcccaaggaccagagactgcaggccatcaaggccgccatcatgctgctgcccgacgagaacagagaggtgctgcagaccctgctgtacttcctgagcgacgtgaccgccgccgtgaaggagaaccagatgacccccaccaacctggccgtgtgcctggcccccagcctgttccacctgaacaccctgaagagagagaacagcagccccagagtgatgcagagaaagcagagcctgggcaagcccgaccagaaggacctgaacgagaacctggccgccacccagggcctggcccacatgatcgccgagtgcaagaagctgttccaggtgcccgaggagatgagcagatgcagaaacagctacaccgagcaggagctgaagcccctgaccctggaggccctgggccacctgggcaacgacgacagcgccgactaccagcacttcctgcaggactgcgtggacggcctgttcaaggaggtgaaggagaagttcaagggctgggtgagctacagcaccagcgagcaggccgagctgagctacaagaaggtgagcgagggcccccccctgagactgtggagaagcgtgatcgaggtgcccgccgtgcccgaggagatcctgaagagactgctgaaggagcagcacctgtgggacgtggacctgctggacagcaaggtgatcgagatcctggacagccagaccgagatctaccagtacgtgcagaacagcatggccccccaccccgccagagactacgtggtgctgagaacctggagaaccaacctgcccaagggcgcctgcgccctgctgctgaccagcgtggaccacgacagagcccccgtggtgggcgtgagagtgaacgtgctgctgagcagatacctgatcgagccctgcggccccggcaagagcaagctgacctacatgtgcagagtggacctgagaggccacatgcccgagtggtacaccaagagcttcggccacctgtgcgccgccgaggtggtgaagatcagagacagcttcagcaaccagaacaccgagaccaaggacaccaagagcagatag

SEQ ID NO: 17818 - DNA, 972 bp, Artificial Sequence
  Description of Artificial Sequence: Synthetic coding sequence
atgggcagcagagtgagcagagaggacttcgagtgggtgtacaccgaccagccccacgccgacagaagaagagagatcctggccaagtaccccgagatcaagagcctgatgaagcccgaccccaacctgatctggatcatcatcatgatggtgctgacccagctgggcgccttctacatcgtgaaggacctggactggaagtgggtgatcttcggcgcctacgccttcggcagctgcatcaaccacagcatgaccctggccatccacgagatcgcccacaacgccgccttcggcaactgcaaggccatgtggaacagatggttcggcatgttcgccaacctgcccatcggcatcccctacagcatcagcttcaagagataccacatggaccaccacagatacctgggcgccgacggcgtggacgtggacatccccaccgacttcgagggctggttcttctgcaccgccttcagaaagttcatctgggtgatcctgcagcccctgttctacgccttcagacccctgttcatcaaccccaagcccatcacctacctggaggtgatcaacaccgtggcccaggtgaccttcgacatcctgatctactacttcctgggcatcaagagcctggtgtacatgctggccgccagcctgctgggcctgggcctgcaccccatcagcggccacttcatcgccgagcactacatgttcctgaagggccacgagacctacagctactacggccccctgaacctgctgaccttcaacgtgggctaccacaacgagcaccacgacttccccaacatccccggcaagagcctgcccctggtgagaaagatcgccgccgagtactacgacaacctgccccactacaacagctggatcaaggtgctgtacgacttcgtgatggacgacaccatcagcccctacagcagaatgaagagacaccagaagggcgagatggtgctggagtag

SEQ ID NO: 17819 - DNA, 972 bp, Artificial Sequence; identical to SEQ ID NO: 17818
  Description of Artificial Sequence: Synthetic coding sequence

SEQ ID NO: 17820 - DNA, 786 bp, Artificial Sequence
  Description of Artificial Sequence: Synthetic coding sequence
atggtgagcccccagctggccaagtaccccgagatcaagagcctgatgaagcccgaccccaacctgatctggatcatcatcatgatggtgctgacccagctgggcgccttctacatcgtgaaggacctggactggaagtgggtgatcttcggcgcctacgccttcggcagctgcatcaaccacagcatgaccctggccatccacgagatcgcccacaacgccgccttcggcaactgcaaggccatgtggaacagatggttcggcatgttcgccaacctgcccatcggcatcccctacagcatcagcttcaagagataccacatggaccaccacagatacctgggcgccgacggcgtggacgtggacatccccaccgacttcgagggctggttcttctgcaccgccttcagaaagttcatctgggtgatcctgcagcccctgttctacgccttcagacccctgttcatcaaccccaagcccatcacctacctggaggtgatcaacaccgtggcccaggtgaccttcgacatcctgatctactacttcctgggcatcaagagcctggtgtacatgctggccgccagcctgctgggcctgggcctgcaccccatcagcggccacttcatcgccgagcactacatgttcctgaagggccacgagacctacagctactacggccccctgaacctgctgaccttcaacgtgggctaccacaacgagcaccacgacttccccaacatccccggcaagagcctgcccctggtgagaaagatcgccgccgagtag

SEQ ID NO: 17821 - DNA, 1152 bp, Artificial Sequence
  Description of Artificial Sequence: Synthetic coding sequence
atgcccagcggctgcagatgcctgcacctggtgtgcctgctgtgcatcctgggcgcccccggccagcccgtgagagccgacgactgcagcagccactgcgacctggcccacggctgctgcgcccccgacggcagctgcagatgcgaccccggctgggagggcctgcactgcgagagatgcgtgagaatgcccggctgccagcacggcacctgccaccagccctggcagtgcatctgccacagcggctgggccggcaagttctgcgacaaggacgagcacatctgcaccacccagagcccctgccagaacggcggccagtgcatgtacgacggcggcggcgagtaccactgcgtgtgcctgcccggcttccacggcagagactgcgagagaaaggccggcccctgcgagcaggccggcagcccctgcagaaacggcggccagtgccaggacgaccagggcttcgccctgaacttcacctgcagatgcctggtgggcttcgtgggcgccagatgcgaggtgaacgtggacgactgcctgatgagaccctgcgccaacggcgccacctgcctggacggcatcaacagattcagctgcctgtgccccgagggcttcgccggcagattctgcaccatcaacctggacgactgcgccagcagaccctgccagagaggcgccagatgcagagacagagtgcacgacttcgactgcctgtgccccagcggctacggcggcaagacctgcgagctggtgctgcccgtgcccgacccccccaccaccgtggacacccccctgggccccaccagcgccgtggtggtgcccgccaccggccccgccccccacagcgccggcgccggcctgctgagaatcagcgtgaaggaggtggtgagaagacaggaggccggcctgggcgagcccagcctggtggccctggtggtgttcggcgccctgaccgccgccctggtgctggccaccgtgctgctgaccctgagagcctggagaagaggcgtgtgcccccccggcccctgctgctaccccgccccccactacgcccccgcctgccaggaccaggagtgccaggtgagcatgctgcccgccggcctgcccctgcccagagacctgccccccgagcccggcaagaccaccgccctgtag

SEQ ID NO: 17822 - DNA, 1134 bp, Artificial Sequence
  Description of Artificial Sequence: Synthetic coding sequence
atgcccagcggctgcagatgcctgcacctggtgtgcctgctgtgcatcctgggcgcccccggccagcccgtgagagccgacgactgcagcagccactgcgacctggcccacggctgctgcgcccccgacggcagctgcagatgcgaccccggctgggagggcctgcactgcgagagatgcgtgagaatgcccggctgccagcacggcacctgccaccagccctggcagtgcatctgccacagcggctgggccgacgagcacatctgcaccacccagagcccctgccagaacggcggccagtgcatgtacgacggcggcggcgagtaccactgcgtgtgcctgcccggcttccacggcagagactgcgagagaaaggccggcccctgcgagcaggccggcagcccctgcagaaacggcggccagtgccaggacgaccagggcttcgccctgaacttcacctgcagatgcctggtgggcttcgtgggcgccagatgcgaggtgaacgtggacgactgcctgatgagaccctgcgccaacggcgccacctgcctggacggcatcaacagattcagctgcctgtgccccgagggcttcgccggcagattctgcaccatcaacctggacgactgcgccagcagaccctgccagagaggcgccagatgcagagacagagtgcacgacttcgactgcctgtgccccagcggctacggcggcaagacctgcgagctggtgctgcccgtgcccgacccccccaccaccgtggacacccccctgggccccaccagcgccgtggtggtgcccgccaccggccccgccccccacagcgccggcgccggcctgctgagaatcagcgtgaaggaggtggtgagaagacaggaggccggcctgggcgagcccagcctggtggccctggtggtgttcggcgccctgaccgccgccctggtgctggccaccgtgctgctgaccctgagagcctggagaagaggcgtgtgcccccccggcccctgctgctaccccgccccccactacgcccccgcctgccaggaccaggagtgccaggtgagcatgctgcccgccggcctgcccctgcccagagacctgccccccgagcccggcaagaccaccgccctgtag

SEQ ID NO: 17823 - DNA, 1152 bp, Artificial Sequence; identical to SEQ ID NO: 17821
  Description of Artificial Sequence: Synthetic coding sequence

SEQ ID NO: 17824 - DNA, 405 bp, Artificial Sequence
  Description of Artificial Sequence: Synthetic coding sequence
atgcccagcggctgcagatgcctgcacctggtgtgcctgctgtgcatcctgggcgcccccggccagcccgtgagagccgacgactgcagcagccactgcgacctggcccacggctgctgcgcccccgacggcagctgcagatgcgaccccggctgggagggcctgcactgcgagagatgcgtgagaatgcccggctgccagcacggcacctgccaccagccctggcagtgcatctgccacagcggctgggccggcaagttctgcgacaaggacgagcacatctgcaccacccagagcccctgccagaacggcggccagtgcatgtacgacggcggcggcgagtaccactgcgtgtgcctgcccggcttccacggcagagactgcgagagaaaggccggcccctag

SEQ ID NO: 17825 - DNA, 1134 bp, Artificial Sequence; identical to SEQ ID NO: 17822
  Description of Artificial Sequence: Synthetic coding sequence

SEQ ID NO: 17826 - DNA, 870 bp, Artificial Sequence
  Description of Artificial Sequence: Synthetic coding sequence
tgaggctgccagcacggcacctgccaccagccctggcagtgcatctgccacagcggctgggccggcaagttctgcgacaagggcttccacggcagagactgcgagagaaaggccggcccctgcgagcaggccggcagcccctgcagaaacggcggccagtgccaggacgaccagggcttcgccctgaacttcacctgcagatgcctggtgggcttcgtgggcgccagatgcgaggtgaacgtggacgactgcctgatgagaccctgcgccaacggcgccacctgcctggacggcatcaacagattcagctgcctgtgccccgagggcttcgccggcagattctgcaccatcaacctggacgactgcgccagcagaccctgccagagaggcgccagatgcagagacagagtgcacgacttcgactgcctgtgccccagcggctacggcggcaagacctgcgagctggtgctgcccgtgcccgacccccccaccaccgtggacacccccctgggccccaccagcgccgtggtggtgcccgccaccggccccgccccccacagcgccggcgccggcctgctgagaatcagcgtgaaggaggtggtgagaagacaggaggccggcctgggcgagcccagcctggtggccctggtggtgttcggcgccctgaccgccgccctggtgctggccaccgtgctgctgaccctgagagcctggagaagaggcgtgtgcccccccggcccctgctgctaccccgccccccactacgcccccgcctgccaggaccaggagtgccaggtgagcatgctgcccgccggcctgcccctgcccagagacctgccccccgagcccggcaagaccaccgccctgtag

SEQ ID NO: 17827 - DNA, 3441 bp, Artificial Sequence
  Description of Artificial Sequence: Synthetic coding sequence
atgagaaagaccgacgtggaccccctggacgaggtgtgctacagagtggtgatgcagctgtgcggcctgtggggccaccccgtgctggccgtgagagtgctgttcgagatgaagaccgccagaatcaagcccaacgccatcacctacggctactacaacaaggtggtgctggagagcccctggcccagcagcaccagaagcggcatcttcctgtggaccaaggtgagaaacgtggtgagaggcctggcccagttcagacagcccctgaagaagaccgtgcagagaagccaggtgagcagcatcagcgccctgcagaacgtgaccggcggcagcgacggcgacaccgtgagccacggcagcgtggacagcagcaacgacgccaacaacggcgagcacaccgtgttcgtgagagacctgatcagactggagagcatcgacaaccacagcagcaccggcggccagagcgaccagggctacggcagcaaggacgagctgatcaaggacgacgccgagatccacgtgcccgaggagcaggccgccagagagctgatcaccaagaccaagatgcagaccgaggaggtgtgcgacgccagcgccatcgtggccaagcacagccagcccagccccgagccccacagccccaccgagccccccgcctggggcagcagcatcgtgaaggtgcccagcggcatcttcgacgtgaacagcagaaagagcagcatcagcaacgtgctgttcagcacccaggaccccgtggaggacgccgtgttcggcgaggccaccaacctgaagaagaacggcgacagaggcgagaagagacagaagcacttccccgagagaagctgcagcttcagcagcgagagcagagccggcatgctgctgaagaagagcagcctggacagcaacagcagcgagatggccatcatgatgggcgccgacgccaagatcctgaccgccgccctgacctgccccaagaccagcctgctgcacatcgccagaacccacagcttcgagaacgtgagctgccacctgcccgacagcagaacctgcatgagcgagagcacctggaaccccgagcacagaagcagccccgtgcccgagatgctggaggagagccaggagctgctggagcccgtggtggacgacgtgcccaagaccaccgccaccgtggacacctacgagagcctgctgagcgacagcaacagcaaccagagcagagacctgaagaccgtgagcaaggacctgagaaacaagagaagcagcctgtacggcatcgccaaggtggtgcagagagaggacgtggagaccggcctggaccccctgagcctgctggccaccgagtgcaccggcggcaagacccccgacagcgaggacaagctgttcagccccgtgatcgccagaaacctggccgacgagatcgagagctacatgaacctgaagagccccctgggcagcaagagcagcagcatggagctgcacagagaggagaacagagagagcggcatgaccaccgccttcatccacgccctggagagaagaagcagcctgcccctggaccacggcagccccgcccaggagaaccccgagagcgagaagagcagccccgccgtgagcagaagcaagaccttcaccggcagattcaagcagcagacccccagcagaacccacaaggagagaagcaccagcctgagcgccctggtgagaagcagcccccacggcagcctgggcagcgtggtgaacagcctgagcggcctgaagctggacaacatcctgagcggccccaagatcgacgtgctgaagagcggcatgaagcaggccgccaccgtggccagcaagatgtgggtggccgtggccagcgcctacagctacagcgacgacgaggaggagaccaacagagactacagcttccccgccggcctggaggaccacatcctgggcgagaacatcagccccaacaccagcatcagcggcctggtgcccagcgagctgacccagagcaacaccagcctgggcagcagcagcagcagcggcgacgtgggcaagctgcactaccccaccggcgaggtgcccttccccagaggcatgaagggccaggacttcgagaagagcgaccacggcagcagccagaacaccagcatgagcagcatctaccagaactgcgccatggaggtgctgatgagcagctgcagccagtgcagagcctgcggcgccctggtgtacgacgaggagatcatggccggctggaccgccgacgacagcaacctgaacaccgcctgccccttctgcaagagcaacttcctgcccctgctgaacatcgagttcaaggacctgagaggcagcgccagcttcttcctgaagcccagcaccagcggcgacagcctgcagagcggcagcatccccctggccaacgagagcctggagcacaagcccgtgagcagcctggccgagcccgacctgatcaacttcatggacttccccaagcacaaccagatcatcaccgaggagaccggcagcgccgtggagcccagcgacgagatcaagagagccagcggcgacgtgcagaccatgaagatcagcagcgtgcccaacagcctgagcaagagaaacgtgagcctgaccagaagccacagcgtgggcggccccctgcagaacatcgacttcacccagagacccttccacggcatcagcaccgtgagcctgcccaacagcctgcaggaggtggtggaccccctgggcaagagacccaaccccccccccgtgagcgtgccctacctgagccccctggtgctgagaaaggagctggagagcctgctggagaacgagggcgaccaggtgatccacaccagcagcttcatcaaccagcaccccatcatcttctggaacctggtgtggtacttcagaagactggacctgcccagcaacctgcccggcctgatcctgaccagcgagcactgcaacgagggcgtgcagctgcccctgagcagcctgagccaggacagcaagctggtgtacatccagctgctgtgggacaacatcaacctgcaccaggagcccagagagcccctgtacgtgagctggagaaacttcaacagcgagaagaagagcagcctgctgagcgaggagcagcaggagaccagcaccctggtggagaccatcagacagagcatccagcacaacaacgtgctgaagcccatcaacctgctgagccagcagatgaagcccggcatgaagagacagagaagcctgtacagagagatcctgttcctgagcctggtgagcctgggcagagagaacatcgacatcgaggccttcgacaacgagtacggcatcgcctacaacagcctgagcagcgagatcctggagagactgcagaagatcgacgccccccccagcgccagcgtggagtggtgcagaaagtgcttcggcgcccccctgatctag

SEQ ID NO: 17828 - DNA, 2013 bp, Artificial Sequence
  Description of Artificial Sequence: Synthetic coding sequence
atgaacctgaagagccccctgggcagcaagagcagcagcatggagctgcacagagaggagaacagagagagcggcatgaccaccgccttcatccacgccctggagagaagaagcagcctgcccctggaccacggcagccccgcccaggagaaccccgagagcgagaagagcagccccgccgtgagcagaagcaagaccttcaccggcagattcaagcagcagacccccagcagaacccacaaggagagaagcaccagcctgagcgccctggtgagaagcagcccccacggcagcctgggcagcgtggtgaacagcctgagcggcctgaagctggacaacatcctgagcggccccaagatcgacgtgctgaagagcggcatgaagcaggccgccaccgtggccagcaagatgtgggtggccgtggccagcgcctacagctacagcgacgacgaggaggagaccaacagagactacagcttccccgccggcctggaggaccacatcctgggcgagaacatcagccccaacaccagcatcagcggcctggtgcccagcgagctgacccagagcaacaccagcctgggcagcagcagcagcagcggcgacgtgggcaagctgcactaccccaccggcgaggtgcccttccccagaggcatgaagggccaggacttcgagaagagcgaccacggcagcagccagaacaccagcatgagcagcatctaccagaactgcgccatggaggtgctgatgagcagctgcagccagtgcagagcctgcggcgccctggtgtacgacgaggagatcatggccggctggaccgccgacgacagcaacctgaacaccgcctgccccttctgcaagagcaacttcctgcccctgctgaacatcgagttcaaggacctgagaggcagcgccagcttcttcctgaagcccagcaccagcggcgacagcctgcagagcggcagcatccccctggccaacgagagcctggagcacaagcccgtgagcagcctggccgagcccgacctgatcaacttcatggacttccccaagcacaaccagatcatcaccgaggagaccggcagcgccgtggagcccagcgacgagatcaagagagccagcggcgacgtgcagaccatgaagatcagcagcgtgcccaacagcctgagcaagagaaacgtgagcctgaccagaagccacagcgtgggcggccccctgcagaacatcgacttcacccagagacccttccacggcatcagcaccgtgagcctgcccaacagcctgcaggaggtggtggaccccctgggcaagagacccaaccccccccccgtgagcgtgccctacctgagccccctggtgctgagaaaggagctggagagcctgctggagaacgagggcgaccaggtgatccacaccagcagcttcatcaaccagcaccccatcatcttctggaacctggtgtggtacttcagaagactggacctgcccagcaacctgcccggcctgatcctgaccagcgagcactgcaacgagggcgtgcagctgcccctgagcagcctgagccaggacagcaagctggtgtacatccagctgctgtgggacaacatcaacctgcaccaggagcccagagagcccctgtacgtgagctggagaaacttcaacagcgagaagaagagcagcctgctgagcgaggagcagcaggagaccagcaccctggtggagaccatcagacagagcatccagcacaacaacgtgctgaagcccatcaacctgctgagccagcagatgaagcccggcatgaagagacagagaagcctgtacagagagatcctgttcctgagcctggtgagcctgggcagagagaacatcgacatcgaggccttcgacaacgagtacggcatcgcctacaacagcctgagcagcgagatcctggagagactgcagaagatcgacgccccccccagcgccagcgtggagtggtgcagaaagtgcttcggcgcccccctgatctag

SEQ ID NO: 17829 - DNA, 777 bp, Artificial Sequence
  Description of Artificial Sequence: Synthetic coding sequence
atgaagcaggccgccaccgtggccagcaagatgtgggtggccgtggccagcgcctacagctacagcgacgacgaggaggagaccaacagagactacagcttccccgccggcctggaggaccacatcctgggcgagaacatcagccccaacaccagcatcagcggcctggtgcccagcgagctgacccagagcaacaccagcctgggcagcagcagcagcagcggcgacgtgggcaagctgcactaccccaccggcgaggtgcccttccccagaggcatgaagggccaggacttcgagaagagcgaccacggcagcagccagaacaccagcatgagcagcatctaccagaactgcgccatggaggtgctgatgagcagctgcagccagtgcagagcctgcggcgccctggtgtacgacgaggagatcatggccggctggaccgccgacgacagcaacctgaacaccgcctgccccttctgcaagagcaacttcctgcccctgctgaacatcgagttcaaggacctgagaggcagcgccagcttcttcctgaagcccagcaccagcggcgacagcctgcagagcggcagcatccccctggccaacgagagcctggagcacaagcccgtgagcagcctggccgagcccgacctgatcaacttcatggacttccccaagcacaaccagatcatcaccgaggagaccggcagcgccgtggagcccagataccagagagtgcagagacccctgtacgtggtgatcaacggcgtgcccctgtag

SEQ ID NO: 17830 - DNA, 2376 bp, Artificial Sequence
  Description of Artificial Sequence: Synthetic coding sequence
atgctgctgaagaagagcagcctggacagcaacagcagcgagatggccatcatgatgggcgccgacgccaagatcctgaccgccgccctgacctgccccaagaccagcctgctgcacatcgccagaacccacagcttcgagaacgtgagctgccacctgcccgacagcagaacctgcatgagcgagagcacctggaaccccgagcacagaagcagccccgtgcccgagatgctggaggagagccaggagctgctggagcccgtggtggacgacgtgcccaagaccaccgccaccgtggacacctacgagagcctgctgagcgacagcaacagcaaccagagcagagacctgaagaccgtgagcaaggacctgagaaacaagagaagcagcctgtacggcatcgccaaggtggtgcagagagaggacgtggagaccggcctggaccccctgagcctgctggccaccgagtgcaccggcggcaagacccccgacagcgaggacaagctgttcagccccgtgatcgccagaaacctggccgacgagatcgagagctacatgaacctgaagagccccctgggcagcaagagcagcagcatggagctgcacagagaggagaacagagagagcggcatgaccaccgccttcatccacgccctggagagaagaagcagcctgcccctggaccacggcagccccgcccaggagaaccccgagagcgagaagagcagccccgccgtgagcagaagcaagaccttcaccggcagattcaagcagcagacccccagcagaacccacaaggagagaagcaccagcctgagcgccctggtgagaagcagcccccacggcagcctgggcagcgtggtgaacagcctgagcggcctgaagctggacaacatcctgagcggccccaagatcgacgtgctgaagagcggcatgaagcaggccgccaccgtggccagcaagatgtgggtggccgtggccagcgcctacagctacagcgacgacgaggaggagaccaacagagactacagcttccccgccggcctggaggaccacatcctgggcgagaacatcagccccaacaccagcatcagcggcctggtgcccagcgagctgacccagagcaacaccagcctgggcagcagcagcagcagcggcgacgtgggcaagctgcactaccccaccggcgaggtgcccttccccagaggcatgaagggccaggacttcgagaagagcgaccacggcagcagccagaacaccagcatgagcagcatctaccagaactgcgccatggaggtgctgatgagcagctgcagccagtgcagagcctgcggcgccctggtgtacgacgaggagatcatggccggctggaccgccgacgacagcaacctgaacaccgcctgccccttctgcaagagcaacttcctgcccctgctgaacatcgagttcaaggacctgagaggcagcgccagcttcttcctgaagcccagcaccagcggcgacagcctgcagagcggcagcatccccctggccaacgagagcctggagcacaagcccgtgagcagcctggccgagcccgacctgatcaacttcatggacttccccaagcacaaccagatcatcaccgaggagaccggcagcgccgtggagcccagcgacgagatcaagagagccagcggcgacgtgcagaccatgaagatcagcagcgtgcccaacagcctgagcaagagaaacgtgagcctgaccagaagccacagcgtgggcggccccctgcagaacatcgacttcacccagagacccttccacggcatcagcaccgtgagcctgcccaacagcctgcaggaggtggtggaccccctgggcaagagacccaaccccccccccgtgagcgtgccctacctgagccccctggtgctgagaaaggagctggagagcctgctggagaacgagggcgaccaggtgatccacaccagcagcttcatcaaccagcaccccatcatcttctggaacctggtgtggtacttcagaagactggacctgcccagcaacctgcccggcctgatcctgaccagcgagcactgcaacgagggcgtgcagctgcccctgagcagcctgagccaggacagcaagctggtgtacatccagctgctgtgggacaacatcaacctgcaccaggagcccagagagcccctgtacgtgagctggagaaacttcaacagcgagaagaagagcagcctgctgagcgaggagcagcaggagaccagcaccctggtggagaccatcagacagagcatccagcacaacaacgtgctgaagcccatcaacctgctgagccagcagatgaagcccggcatgaagagacagagaggcatctag

SEQ ID NO: 17831 - DNA, 3441 bp, Artificial Sequence; identical to SEQ ID NO: 17827
  Description of Artificial Sequence: Synthetic coding sequence

SEQ ID NO: 17832 - DNA, 5022 bp, Artificial Sequence
  Description of Artificial Sequence: Synthetic coding sequence
atgggcgccaccatcgagtgctgggaccccgagaccaagtaccccctgcccgtgttcagcaccttcgtgctgaccggcagcagcgccaagaaggtgtacggcgccgccatccagttctacgagccctacagcagagagctgctgagcgagaagcagctgatgcacctgggcctgctgacccccgtggagagaaagatggtgagcaagagcatcaacaccaacaagtgcatctgcctgctgagccactggcccttcttcgaggccttcagaaagttcctgatgttcatctacaagctgagcgtgagcggcccccaccccctgcccatcgagaagcacatcagccacttcatgcagaacatccccttccccagcccccagagacccagaatcctggtgcagctgagcgtgcacgacgccctgatcctgagccagcccgtgagcacccccctgcccctgagcggcgccaacttcagcaccctgctgatgaacctgggccccgagaactgcgccaccctgctgctgttcgtgctgctggagagcaagatcctgctgcacagcctgagacccgccgtgctgaccggcgtggccgaggccgtggtggccatgatcttccccttccagtggcagtgcccctacatccccctgtgccccctgagcctggccgccgtgctgagcgcccccctgcccttcatcgtgggcgtggacagcagatacttcgacctgcacgaccccccccaggacgtggtgtgcatcgacctggacaccaacatgctgtacgtgagcgacgagaagaagaacatgaactggaagcagctgcccaagaagccctgcaagaacctgctgagcaccctgaagaagctgtacccccagctgagcagcgtgcaccagaagacccaggagggcagcgccatcgacatgacccccatcgaggccgacttcagctggcagaagaagatgacccagctggagatggagatccaggaggccttcctgagattcatggccagcatcctgaagggctacagaacctacctgagacccatcaccgaggcccccagcaacaaggccaccgccgccgacagcctgttcgacagacagggcttcctgaagagcagagacagagcctacgccaagttctacaccctgctgagcaagacccagatcttcatcagattcatcgaggagtgcagcttcgtgagcgacaaggacaccggcctggccttcttcgacgactgcatcgagaagctgttccccgacaagggcaccgagaagaccgacaaggtggacttcgacagcgccgaggacaccagactgatcgagctggacgacagccagaagagcgagcacaccgtgttcatcatgccccccgagcccccccccgacgacggcaaggacctgagccccaagtacagctacaagtacttccccagactggacctgaagctgttcgacagaccccaggagctgaagctgtgcttcagcagacaccccaccggcaacagcatcaccaagagcccccccctgatggccaagagaaccaagcaggagatcaagaccgcccacaagctggccaagagatgctacaccaaccccccccagtgggccaagtgcctgttcagccactgctacagcctgtggttcatctgcctgcccgcctacgtgagagtgagccaccccaaggtgagagccctgcagcaggcctacgacgtgctgatcaagatgagaaagaccgacgtggaccccctggacgaggtgtgctacagagtggtgatgcagctgtgcggcctgtggggccaccccgtgctggccgtgagagtgctgttcgagatgaagaccgccagaatcaagcccaacgccatcacctacggctactacaacaaggtggtgctggagagcccctggcccagcagcaccagaagcggcatcttcctgtggaccaaggtgagaaacgtggtgagaggcctggcccagttcagacagcccctgaagaagaccgtgcagagaagccaggtgagcagcatcagcggcggccagagcgaccagggctacggcagcaaggacgagctgatcaaggacgacgccgagatccacgtgcccgaggagcaggccgccagagagctgatcaccaagaccaagatgcagaccgaggaggtgtgcgacgccagcgccatcgtggccaagcacagccagcccagccccgagccccacagccccaccgagccccccgcctggggcagcagcatcgtgaaggtgcccagcggcatcttcgacgtgaacagcagaaagagcagcaccggcagcatcagcaacgtgctgttcagcacccaggaccccgtggaggacgccgtgttcggcgaggccaccaacctgaagaagaacggcgacagaggcgagaagagacagaagcacttccccgagagaagctgcagcttcagcagcgagagcagagccggcatgctgctgaagaagagcagcctggacagcaacagcagcgagatggccatcatgatgggcgccgacgccaagatcctgaccgccgccctgacctgccccaagaccagcctgctgcacatcgccagaacccacagcttcgagaacgtgagctgccacctgcccgacagcagaacctgcatgagcgagagcacctggaaccccgagcacagaagcagccccgtgcccgagatgctggaggagagccaggagctgctggagcccgtggtggacgacgtgcccaagaccaccgccaccgtggacacctacgagagcctgctgagcgacagcaacagcaaccagagcagagacctgaagaccgtgagcaaggacctgagaaacaagagaagcagcctgtacggcatcgccaaggtggtgcagagagaggacgtggagaccggcctggaccccctgagcctgctggccaccgagtgcaccggcggcaagacccccgacagcgaggacaagctgttcagccccgtgatcgccagaaacctggccgacgagatcgagagctacatgaacctgaagagccccctgggcagcaagagcagcagcatggagctgcacagagaggagaacagagagagcggcatgaccaccgccttcatccacgccctggagagaagaagcagcctgcccctggaccacggcagccccgcccaggagaaccccgagagcgagaagagcagccccgccgtgagcagaagcaagaccttcaccggcagattcaagcagcagacccccagcagaacccacaaggagagaagcaccagcctgagcgccctggtgagaagcagcccccacggcagcctgggcagcgtggtgaacagcctgagcggcctgaagctggacaacatcctgagcggccccaagatcgacgtgctgaagagcggcatgaagcaggccgccaccgtggccagcaagatgtgggtggccgtggccagcgcctacagctacagcgacgacgaggaggagaccaacagagactacagcttccccgccggcctggaggaccacatcctgggcgagaacatcagccccaacaccagcatcagcggcctggtgcccagcgagctgacccagagcaacaccagcctgggcagcagcagcagcagcggcgacgtgggcaagctgcactaccccaccggcgaggtgcccttccccagaggcatgaagggccaggacttcgagaagagcgaccacggcagcagccagaacaccagcatgagcagcatctaccagaactgcgccatggaggtgctgatgagcagctgcagccagtgcagagcctgcggcgccctggtgtacgacgaggagatcatggccggctggaccgccgacgacagcaacctgaacaccgcctgccccttctgcaagagcaacttcctgcccctgctgaacatcgagttcaaggacctgagaggcagcgccagcttcttcctgaagcccagcaccagcggcgacagcctgcagagcggcagcatccccctggccaacgagagcctggagcacaagcccgtgagcagcctggccgagcccgacctgatcaacttcatggacttccccaagcacaaccagatcatcaccgaggagaccggcagcgccgtggagcccagcgacgagatcaagagagccagcggcgacgtgcagaccatgaagatcagcagcgtgcccaacagcctgagcaagagaaacgtgagcctgaccagaagccacagcgtgggcggccccctgcagaacatcgacttcacccagagacccttccacggcatcagcaccgtgagcctgcccaacagcctgcaggaggtggtggaccccctgggcaagagacccaaccccccccccgtgagcgtgccctacctgagccccctggtgctgagaaaggagctggagagcctgctggagaacgagggcgaccaggtgatccacaccagcagcttcatcaaccagcaccccatcatcttctggaacctggtgtggtacttcagaagactggacctgcccagcaacctgcccggcctgatcctgaccagcgagcactgcaacgagggcgtgcagctgcccctgagcagcctgagccaggacagcaagctggtgtacatccagctgctgtgggacaacatcaacctgcaccaggagcccagagagcccctgtacgtgagctggagaaacttcaacagcgagaagaagagcagcctgctgagcgaggagcagcaggagaccagcaccctggtggagaccatcagacagagcatccagcacaacaacgtgctgaagcccatcaacctgctgagccagcagatgaagcccggcatgaagagacagagaagcctgtacagagagatcctgttcctgagcctggtgagcctgggcagagagaacatcgacatcgaggccttcgacaacgagtacggcatcgcctacaacagcctgagcagcgagatcctggagagactgcagaagatcgacgccccccccagcgccagcgtggagtggtgcagaaagtgcttcggcgcccccctgatctag

SEQ ID NO: 17833 - DNA, 2376 bp, Artificial Sequence
  Description of Artificial Sequence: Synthetic coding sequence
atgctgctgaagaagagcagcctggacagcaacagcagcgagatggccatcatgatgggcgccgacgccaagatcctgaccgccgccctgacctgccccaagaccagcctgctgcacatcgccagaacccacagcttcgagaacgtgagctgccacctgcccgacagcagaacctgcatgagcgagagcacctggaaccccgagcacagaagcagccccgtgcccgagatgctggaggagagccaggagctgctggagcccgtggtggacgacgtgcccaagaccaccgccaccgtggacacctacgagagcctgctgagcgacagcaacagcaaccagagcagagacctgaagaccgtgagcaaggacctgagaaacaagagaagcagcctgtacggcatcgccaaggtggtgcagagagaggacgtggagaccggcctggaccccctgagcctgctggccaccgagtgcaccggcggcaagacccccgacagcgaggacaagctgttcagccccgtgatcgccagaaacctggccgacgagatcgagagctacatgaacctgaagagccccctgggcagcaagagcagcagcatggagctgcacagagaggagaacagagagagcggcatgaccaccgccttcatccacgccctggagagaagaagcagcctgcccctggaccacggcagccccgcccaggagaaccccgagagcgagaagagcagccccgccgtgagcagaagcaagaccttcaccggcagattcaagcagcagacccccagcagaacccacaaggagagaagcaccagcctgagcgccctggtgagaagcagcccccacggcagcctgggcagcgtggtgaacagcctgagcggcctgaagctggacaacatcctgagcggccccaagatcgacgtgctgaagagcggcatgaagcaggccgccaccgtggccagcaagatgtgggtggccgtggccagcgcctacagctacagcgacgacgaggaggagaccaacagagactacagcttccccgccggcctggaggaccacatcctgggcgagaacatcagccccaacaccagcatcagcggcctggtgcccagcgagctgacccagagcaacaccagcctgggcagcagcagcagcagcggcgacgtgggcaagctgcactaccccaccggcgaggtgcccttccccagaggcatgaagggccaggacttcgagaagagcgaccacggcagcagccagaacaccagcatgagcagcatctaccagaactgcgccatggaggtgctgatgagcagctgcagccagtgcagagcctgcggcgccctggtgtacgacgaggagatcatggccggctggaccgccgacgacagcaacctgaacaccgcctgccccttctgcaagagcaacttcctgcccctgctgaacatcgagttcaaggacctgagaggcagcgccagcttcttcctgaagcccagcaccagcggcgacagcctgcagagcggcagcatccccctggccaacgagagcctggagcacaagcccgtgagcagcctggccgagcccgacctgatcaacttcatggacttccccaagcacaaccagatcatcaccgaggagaccggcagcgccgtggagcccagcgacgagatcaagagagccagcggcgacgtgcagaccatgaagatcagcagcgtgcccaacagcctgagcaagagaaacgtgagcctgaccagaagccacagcgtgggcggccccctgcagaacatcgacttcacccagagacccttccacggcatcagcaccgtgagcctgcccaacagcctgcaggaggtggtggaccccctgggcaagagacccaaccccccccccgtgagcgtgccctacctgagccccctggtgctgagaaaggagctggagagcctgctggagaacgagggcgaccaggtgatccacaccagcagcttcatcaaccagcaccccatcatcttctggaacctggtgtggtacttcagaagactggacctgcccagcaacctgcccggcctgatcctgaccagcgagcactgcaacgagggcgtgcagctgcccctgagcagcctgagccaggacagcaagctggtgtacatccagctgctgtgggacaacatcaacctgcaccaggagcccagagagcccctgtacgtgagctggagaaacttcaacagcgagaagaagagcagcctgctgagcgaggagcagcaggagaccagcaccctggtggagaccatcagacagagcatccagcacaacaacgtgctgaagcccatcaacctgctgagccagcagatgaagcccggcatgaagagacagagaaacatctag

SEQ ID NO: 17834 - DNA, 3012 bp, Artificial Sequence
  Description of Artificial Sequence: Synthetic coding sequence
atgctgaccaccagcggcggccagagcgaccagggctacggcagcaaggacgagctgatcaaggacgacgccgagatccacgtgcccgaggagcaggccgccagagagctgatcaccaagaccaagatgcagaccgaggaggtgtgcgacgccagcgccatcgtggccaagcacagccagcccagccccgagccccacagccccaccgagccccccgcctggggcagcagcatcgtgaaggtgcccagcggcatcttcgacgtgaacagcagaaagagcagcaccggcagcatcagcaacgtgctgttcagcacccaggaccccgtggaggacgccgtgttcggcgaggccaccaacctgaagaagaacggcgacagaggcgagaagagacagaagcacttccccgagagaagctgcagcttcagcagcgagagcagagccggcatgctgctgaagaagagcagcctggacagcaacagcagcgagatggccatcatgatgggcgccgacgccaagatcctgaccgccgccctgacctgccccaagaccagcctgctgcacatcgccagaacccacagcttcgagaacgtgagctgccacctgcccgacagcagaacctgcatgagcgagagcacctggaaccccgagcacagaagcagccccgtgcccgagatgctggaggagagccaggagctgctggagcccgtggtggacgacgtgcccaagaccaccgccaccgtggacacctacgagagcctgctgagcgacagcaacagcaaccagagcagagacctgaagaccgtgagcaaggacctgagaaacaagagaagcagcctgtacggcatcgccaaggtggtgcagagagaggacgtggagaccggcctggaccccctgagcctgctggccaccgagtgcaccggcggcaagacccccgacagcgaggacaagctgttcagccccgtgatcgccagaaacctggccgacgagatcgagagctacatgaacctgaagagccccctgggcagcaagagcagcagcatggagctgcacagagaggagaacagagagagcggcatgaccaccgccttcatccacgccctggagagaagaagcagcctgcccctggaccacggcagccccgcccaggagaaccccgagagcgagaagagcagccccgccgtgagcagaagcaagaccttcaccggcagattcaagcagcagacccccagcagaacccacaaggagagaagcaccagcctgagcgccctggtgagaagcagcccccacggcagcctgggcagcgtggtgaacagcctgagcggcctgaagctggacaacatcctgagcggccccaagatcgacgtgctgaagagcggcatgaagcaggccgccaccgtggccagcaagatgtgggtggccgtggccagcgcctacagctacagcgacgacgaggaggagaccaacagagactacagcttccccgccggcctggaggaccacatcctgggcgagaacatcagccccaacaccagcatcagcggcctggtgcccagcgagctgacccagagcaacaccagcctgggcagcagcagcagcagcggcgacgtgggcaagctgcactaccccaccggcgaggtgcccttccccagaggcatgaagggccaggacttcgagaagagcgaccacggcagcagccagaacaccagcatgagcagcatctaccagaactgcgccatggaggtgctgatgagcagctgcagccagtgcagagcctgcggcgccctggtgtacgacgaggagatcatggccggctggaccgccgacgacagcaacctgaacaccgcctgccccttctgcaagagcaacttcctgcccctgctgaacatcgagttcaaggacctgagaggcagcgccagcttcttcctgaagcccagcaccagcggcgacagcctgcagagcggcagcatccccctggccaacgagagcctggagcacaagcccgtgagcagcctggccgagcccgacctgatcaacttcatggacttccccaagcacaaccagatcatcaccgaggagaccggcagcgccgtggagcccagcgacgagatcaagagagccagcggcgacgtgcagaccatgaagatcagcagcgtgcccaacagcctgagcaagagaaacgtgagcctgaccagaagccacagcgtgggcggccccctgcagaacatcgacttcacccagagacccttccacggcatcagcaccgtgagcctgcccaacagcctgcaggaggtggtggaccccctgggcaagagacccaaccccccccccgtgagcgtgccctacctgagccccctggtgctgagaaaggagctggagagcctgctggagaacgagggcgaccaggtgatccacaccagcagcttcatcaaccagcaccccatcatcttctggaacctggtgtggtacttcagaagactggacctgcccagcaacctgcccggcctgatcctgaccagcgagcactgcaacgagggcgtgcagctgcccctgagcagcctgagccaggacagcaagctggtgtacatccagctgctgtgggacaacatcaacctgcaccaggagcccagagagcccctgtacgtgagctggagaaacttcaacagcgagaagaagagcagcctgctgagcgaggagcagcaggagaccagcaccctggtggagaccatcagacagagcatccagcacaacaacgtgctgaagcccatcaacctgctgagccagcagatgaagcccggcatgaagagacagagaagcctgtacagagagatcctgttcctgagcctggtgagcctgggcagagagaacatcgacatcgaggccttcgacaacgagtacggcatcgcctacaacagcctgagcagcgagatcctggagagactgcagaagatcgacgccccccccagcgccagcgtggagtggtgcagaaagtgcttcggcgcccccctgatctag

SEQ ID NO: 17835 - DNA, 3864 bp, Artificial Sequence
  Description of Artificial Sequence: Synthetic coding sequence
atgagcggcggcggcggcggcggcggcagcgcccccagcagattcgccgactacttcgtgatctgcggcctggacaccgagaccggcctggagcccgacgagctgagcgccctgtgccagtacatccaggccagcaaggccagagacggcgccagccccttcatcagcagcaccaccgagggcgagaacttcgagcagacccccctgagaagaaccttcaagagcaaggtgctggccagataccccgagaacgtggagtggaaccccttcgaccaggacgccgtgggcatgctgtgcatgcccaagggcctggccttcaagacccaggccgaccccagagagccccagttccacgccttcatcatcaccagagaggacggcagcagaaccttcggcttcgccctgaccttctacgaggaggtgaccagcaagcagatctgcagcgccatgcagaccctgtaccacatgcacaacgccgagtacgacgtgctgcacgccccccccgccgacgacagagaccagagcagcatggaggacggcgaggacacccccgtgaccaagctgcagagattcaacagctacgacatcagcagagacaccctgtacgtgagcaagtgcatctgcctgatcacccccatgagcttcatgaaggcctgcagaagcgtgctggagcagctgcaccaggccgtgaccagcccccagcccccccccctgcccctggagagctacatctacaacgtgctgtacgaggtgcccctgcccccccccggcagaagcctgaagttcagcggcgtgtacggccccatcatctgccagagacccagcaccaacgagctgcccctgttcgacttccccgtgaaggaggtgttcgagctgctgggcgtggagaacgtgttccagctgttcacctgcgccctgctggagttccagatcctgctgtacagccagcactaccagagactgatgaccgtggccgagaccatcaccgccctgatgttccccttccagtggcagcacgtgtacgtgcccatcctgcccgccagcctgctgcacttcctggacgcccccgtgccctacctgatgggcctgcacagcaacggcctggacgacagaagcaagctggagctgccccaggaggccaacctgtgcttcgtggacatcgacaaccacttcatcgagctgcccgaggacctgccccagttccccaacaagctggagttcgtgcaggaggtgagcgagatcctgatggccttcggcatcccccccgagggcaacctgcactgcagcgagagcgccagcaagctgaagagactgagagccagcgagctggtgagcgacaagagaaacggcaacatcgccggcagccccctgcacagctacgagctgctgaaggagaacgagaccatcgccagactgcaggccctggtgaagagaaccggcgtgagcctggagaagctggaggtgagagaggaccccagcagcaacaaggacctgaaggtgcagtgcgacgaggaggagctgagaatctaccagctgaacatccagatcagagaggtgttcgccaacagattcacccagatgttcgccgactacgaggtgttcgtgatccagcccagccaggacaaggagagctggttcaccaacagagagcagatgcagaacttcgacaaggccagcttcctgagcgaccagcccgagccctacctgcccttcctgagcagattcctggagacccagatgttcgccagcttcatcgacaacaagatcatgtgccacgacgacgacgacaaggaccccgtgctgagagtgttcgacagcagagtggacaagatcagactgctgaacgtgagaacccccaccctgagaaccagcatgtaccagaagtgcaccaccgtggacgaggccgagaaggccatcgagctgagactggccaagatcgaccacaccgccatccacccccacctgctggacatgaagatcggccagggcaagtacgagcccggcttcttccccaagctgcagagcgacgtgctgagcaccggccccgccagcaacaagtggaccaagagaaacgcccccgcccagtggagaagaaaggacagacagaagcagcacaccgagcacctgagactggacaacgaccagagagagaagtacatccaggaggccagaaccatgggcagcaccatcagacagcccaagctgagcaacctgagccccagcgtgatcgcccagaccaactggaagttcgtggagggcctgctgaaggagtgcagaaacaagaccaagagaatgctggtggagaagatgggcagagaggccgtggagctgggccacggcgaggtgaacatcaccggcgtggaggagaacaccctgatcgccagcctgtgcgacctgctggagagaatctggagccacggcctgcaggtgaagcagggcaagagcgccctgtggagccacctgctgcactaccaggacaacagacagagaaagctgaccagcggcagcctgagcaccagcggcatcctgctggacagcgagagaagaaagagcgacgccagcagcctgatgccccccctgagaatcagcctgatccaggacatgagacacatccagaacatcggcgagatcaagaccgacgtgggcaaggccagagcctgggtgagactgagcatggagaagaagctgctgagcagacacctgaagcagctgctgagcgaccacgagctgaccaagaagctgtacaagagatacgccttcctgagatgcgacgacgagaaggagcagttcctgtaccacctgctgagcttcaacgccgtggactacttctgcttcaccaacgtgttcaccaccatcctgatcccctaccacatcctgatcgtgcccagcaagaagctgggcggcagcatgttcaccgccaacccctggatctgcatcagcggcgagctgggcgagacccagatcatgcagatccccagaaacgtgctggagatgaccttcgagtgccagaacctgggcaagctgaccaccgtgcagatcggccacgacaacagcggcctgtacgccaagtggctggtggagtacgtgatggtgagaaacgagatcaccggccacacctacaagttcccctgcggcagatggctgggcaagggcatggacgacggcagcctggagagaatcctggtgggcgagctgctgaccagccagcccgaggtggacgagagaccctgcagaaccccccccctgcagcagagccccagcgtgatcagaagactggtgaccatcagccccaacaacaagcccaagctgaacaccggccagatccaggagagcatcggcgaggccgtgaacggcatcgtgaagcacttccacaagcccgagaaggagagaggcagcctgaccctgctgctgtgcggcgagtgcggcctggtgagcgccctggagcaggccttccagcacggcttcaagagccccagactgttcaagaacgtgttcatctgggacttcctggagaaggcccagacctactacgagaccctggagaagaacgaggtggtgcccgaggagaactggcacaccagagccagaaacttctgcagattcgtgaccgccatcaacaacacccccagaaacatcggcaaggacggcaagttccagatgctggtgtgcctgggcgccagagaccacctgctgcaccactggatcgccctgctggccgactgccccatcaccgcccacatgtacgaggacgtggccctgatcaaggaccacaccctggtgaacagcctgatcagagtgctgcagaccctgcaggagttcaacatcaccctggagaccagcctggtgaagggcatcgacatctag

SEQ ID NO: 17836 - DNA, 1893 bp, Artificial Sequence
  Description of Artificial Sequence: Synthetic coding sequence
atgaagatcggccagggcaagtacgagcccggcttcttccccaagctgcagagcgacgtgctgagcaccggccccgccagcaacaagtggaccaagagaaacgcccccgcccagtggagaagaaaggacagacagaagcagcacaccgagcacctgagactggacaacgaccagagagagaagtacatccaggaggccagaaccatgggcagcaccatcagacagcccaagctgagcaacctgagccccagcgtgatcgcccagaccaactggaagttcgtggagggcctgctgaaggagtgcagaaacaagaccaagagaatgctggtggagaagatgggcagagaggccgtggagctgggccacggcgaggtgaacatcaccggcgtggaggagaacaccctgatcgccagcctgtgcgacctgctggagagaatctggagccacggcctgcaggtgaagcagggcaagagcgccctgtggagccacctgctgcactaccaggacaacagacagagaaagctgaccagcggcagcctgagcaccagcggcatcctgctggacagcgagagaagaaagagcgacgccagcagcctgatgccccccctgagaatcagcctgatccaggacatgagacacatccagaacatcggcgagatcaagaccgacgtgggcaaggccagagcctgggtgagactgagcatggagaagaagctgctgagcagacacctgaagcagctgctgagcgaccacgagctgaccaagaagctgtacaagagatacgccttcctgagatgcgacgacgagaaggagcagttcctgtaccacctgctgagcttcaacgccgtggactacttctgcttcaccaacgtgttcaccaccatcctgatcccctaccacatcctgatcgtgcccagcaagaagctgggcggcagcatgttcaccgccaacccctggatctgcatcagcggcgagctgggcgagacccagatcatgcagatccccagaaacgtgctggagatgaccttcgagtgccagaacctgggcaagctgaccaccgtgcagatcggccacgacaacagcggcctgtacgccaagtggctggtggagtacgtgatggtgagaaacgagatcaccggccacacctacaagttcccctgcggcagatggctgggcaagggcatggacgacggcagcctggagagaatcctggtgggcgagctgctgaccagccagcccgaggtggacgagagaccctgcagaaccccccccctgcagcagagccccagcgtgatcagaagactggtgaccatcagccccaacaacaagcccaagctgaacaccggccagatccaggagagcatcggcgaggccgtgaacggcatcgtgaagcacttccacaagcccgagaaggagagaggcagcctgaccctgctgctgtgcggcgagtgcggcctggtgagcgccctggagcaggccttccagcacggcttcaagagccccagactgttcaagaacgtgttcatctgggacttcctggagaaggcccagacctactacgagaccctggagaagaacgaggtggtgcccgaggagaactggcacaccagagccagaaacttctgcagattcgtgaccgccatcaacaacacccccagaaacatcggcaaggacggcaagttccagatgctggtgtgcctgggcgccagagaccacctgctgcaccactggatcgccctgctggccgactgccccatcaccgcccacatgtacgaggacgtggccctgatcaaggaccacaccctggtgaacagcctgatcagagtgctgcagaccctgcaggagttcaacatcaccctggagaccagcctggtgaagggcatcgacatctag

SEQ ID NO: 17837 - DNA, 3726 bp, Artificial Sequence
  Description of Artificial Sequence: Synthetic coding sequence
atgagcggcggcggcggcggcggcggcagcgcccccagcagattcgccgactacttcgtgatctgcggcctggacaccgagaccggcctggagcccgacgagctgagcgccctgtgccagtacatccaggccagcaaggccagagacggcgccagccccttcatcagcagcaccaccgagggcgagaacttcgagcagacccccctgagaagaaccttcaagagcaaggtgctggccagataccccgagaacgtggagtggaaccccttcgaccaggacgccgtgggcatgctgtgcatgcccaagggcctggccttcaagacccaggccgaccccagagagccccagttccacgccttcatcatcaccagagaggacggcagcagaaccttcggcttcgccctgaccttctacgaggaggtgaccagcaagcagatctgcagcgccatgcagaccctgtaccacatgcacaacgccgagtacgacgtgctgcacgccccccccgccgacgacagagaccagagcagcatggaggacggcgaggacacccccgtgaccaagctgcagagattcaacagctacgacatcagcagagacaccctgtacgtgagcaagtgcatctgcctgatcacccccatgagcttcatgaaggcctgcagaagcgtgctggagcagctgcaccaggccgtgaccagcccccagcccccccccctgcccctggagagctacatctacaacgtgctgtacgaggtgcccctgcccccccccggcagaagcctgaagttcagcggcgtgtacggccccatcatctgccagagacccagcaccaacgagctgcccctgttcgacttccccgtgaaggaggtgttcgagctgctgggcgtggagaacgtgttccagctgttcacctgcgccctgctggagttccagatcctgctgtacagccagcactaccagagactgatgaccgtggccgagaccatcaccgccctgatgttccccttccagtggcagcacgtgtacgtgcccatcctgcccgccagcctgctgcacttcctggacgcccccgtgccctacctgatgggcctgcacagcaacggcctggacgacagaagcaagctggagctgccccaggaggccaacctgtgcttcgtggacatcgacaaccacttcatcgagctgcccgaggacctgccccagttccccaacaagctggagttcgtgcaggaggtgagcgagatcctgatggccttcggcatcccccccgagggcaacctgcactgcagcgagagcgccagcaagctgaagagactgagagccagcgagctggtgagcgacaagagaaacggcaacatcgccggcagccccctgcacagctacgagctgctgaaggagaacgagaccatcgccagactgcaggccctggtgaagagaaccggcgtgagcctggagaagctggaggtgagagaggaccccagcagcaacaaggacctgaaggtgcagtgcgacgaggaggagctgagaatctaccagctgaacatccagatcagagaggtgttcgccaacagattcacccagatgttcgccgactacgaggtgttcgtgatccagcccagccaggacaaggagagctggttcaccaacagagagcagatgcagaacttcgacaaggccagcttcctgagcgaccagcccgagccctacctgcccttcctgagcagattcctggagacccagatgttcgccagcttcatcgacaacaagatcatgtgccacgacgacgacgacaaggaccccgtgctgagagtgttcgacagcagagtggacaagatcagactgctgaacgtgagaacccccaccctgagaaccagcatgtaccagaagtgcaccaccgtggacgaggccgagaaggccatcgagctgagactggccaagatcgaccacaccgccatccacccccacctgctggacatgaagatcggccagggcaagtacgagcccggcttcttccccaagctgcagagcgacgtgctgagcaccggccccgccagcaacaagtggaccaagagaaacgcccccgcccagtggagaagaaaggacagacagaagcagcacaccgagcacctgagactggacaacgaccagagagagaagtacatccaggaggccagaaccatgggcagcaccatcagacagcccaagctgagcaacctgagccccagcgtgatcgcccagaccaactggaagttcgtggagggcctgctgaaggagtgcagaaacaagaccaagagaatgctggtggagaagatgggcagagaggccgtggagctgggccacggcgaggtgaacatcaccggcgtggaggagaacaccctgatcgccagcctgtgcgacctgctggagagaatctggagccacggcctgcaggtgaagcagggcaagagcgccctgtggagccacctgctgcactaccaggacaacagacagagaaagctgaccagcggcagcctgagcaccagcggcatcctgctggacagcgagagaagaaagagcgacgccagcagcctgatgccccccctgagaatcagcctgatccaggacatgagacacatccagaacatcggcgagatcaagaccgacgtgggcaaggccagagcctgggtgagactgagcatggagaagaagctgctgagcagacacctgaagcagctgctgagcgaccacgagctgaccaagaagctgtacaagagatacgccttcctgagatgcgacgacgagaaggagcagttcctgtaccacctgctgagcttcaacgccgtggactacttctgcttcaccaacgtgttcaccaccatcctgatcccctaccacatcctgatcgtgcccagcaagaagctgggcggcagcatgttcaccgccaacccctggatctgcatcagcggcgagctgggcgagacccagatcatgcagatccccagaaacgtgctggagatgaccttcgagtgccagaacctgggcaagctgaccaccgtgcagatcggccacgacaacagcggcctgtacgccaagtggctggtggagtacgtgatggtgagaaacgagatcaccggccacacctacaagttcccctgcggcagatggctgggcaagggcatggacgacggcagcctggagagaatcctggtgggcgagctgctgaccagccagcccgaggtggacgagagaccctgcagaaccccccccctgcagcagagccccagcgtgatcagaagactggtgaccatcagccccaacaacaagcccaagctgaacaccggccagatccaggagagcatcggcgaggccgtgaacggcatcgtgaagcacttccacaagcccgagaaggagagaggcagcctgaccctgctgctgtgcggcgagtgcggcctggtgagcgccctggagcaggccttccagcacggcttcaagagccccagactgttcaagaacgtgttcatctgggacttcctggagaaggcccagacctactacgagaccctggagaagaacgaggtggtgcccgaggagaactggcacaccagagccagaaacttctgcagattcgtgaccgccatcaacaacacccccagaaacatcggcaaggacgagatcaccagctacaccaccggcctgccctgctggctgaccgcccccagcctgcacacctgcatgagaatgtggcactag

SEQ ID NO: 17838 - DNA, 3930 bp, Artificial Sequence
  Description of Artificial Sequence: Synthetic coding sequence
atgggcacccaccaccacgcccagctgatcttcgtgttcctggtggagatgagattccaccacgtggaccaggccggcctggagctgctgaccagcagcaacagccccgccagcgccagcagaagcgccgagatcaccgtggtgagccagcacgcccagcccggcttcctgtaccagtggctggaggccgacagacacggcaagagccagggcgccgccaacaccaccagcggcgagaacttcgaccagagccccctgagaagaaccttcaagagcaaggtgctggcccactacccccagaacatcgagtggaaccccttcgaccaggacgccgtgaacatgctgtgcatgcccaagggcctgagcttcagaacccagaccgacaacaaggacccccagttccacagcttcatcatcaccagagaggacggcagcagaacctacggcttcgtgctgaccttctacgaggaggtgaccagcaagcagatctgcaccgccatgcagaccctgtaccagatgcacaacgccgagcactacagcagcgtgtacgccagcagcagctgcagcatggacagcctggccagcagcctggacgagggcgacaccaccagcctgctgaagctgcagagatacaacagctacgacatcagcagagacaccctgtacgtgagcaagagcatctgcctgatcacccccctgcccttcatgcaggcctgcaagaagttcctgatccagctgtacaaggccgtgaccagccagcagcccccccccctgcccctggagagctacatccacaacatcctgtacgaggtgcccctgcccccccccggcagaagcctgaagttctacggcgtgtacgagcccgtgatctgccagagacccggccccagcgagctgcccctgagcgactaccccctgagagaggccttcgagctgctgggcctggagaacctggtgcaggtgttcacctgcgtgctgctggagatgcagatcctgctgtacagccaggactaccagagactgatgaccgtggccgagggcatcaccaccctgctgttccccttccagtggcagcacgtgtacgtgcccatcctgcccgccagcctgctgcacttcctggacgcccccgtgccctacctgatgggcctgcagagcaaggagggcaccgacagaagcaagctggagctgccccaggaggccaacctgtgcttcgtggacatcgacaaccacttcatcgagctgcccgaggagttcccccagttccccaacaaggtggacttcatccaggagctgagcgaggtgctggtgcagttcggcatcccccccgagggcagcctgcactgcagcgagagcaccagcaagctgaagaacatggtgctgaaggacctggtgaacgacaagaagaacggcaacgtgtgcaccaacaacatcagcatgtacgagctgctgaagggcaacgagaccatcgccagactgcaggccctggccaagagaaccggcgtggccgtggagaagatggacctgagcgccagcctgggcgagaaggacaaggacctgaagctgcactgcgaggaggccgagctgagagactaccagctgaacgtgcagctgagagaggtgttcgccaacagattcacccagatgttcgccgactacgaggccttcgtgatccagaccgcccaggacatggagagctggctgaccaacagagagcagatgcagaacttcgacaaggccagcttcctgagcgaccagcccgagccctacctgcccttcctgagcagattcatcgagacccagatgttcgccaccttcatcgacaacaagatcatgagccagtgggaggagaaggaccccctgctgagagtgttcgacaccagaatcgacaagatcagactgtacaacgtgagagcccccaccctgagaaccagcatctaccagaagtgcagcaccctgaaggaggccgcccagagcatcgagcagagactgatgaagatggaccacaccgccatccacccccacctgctggacatgaagatcggccagggcaagtacgagcagggcttcttccccaagctgcagagcgacgtgctggccaccggccccaccagcaacaacagatgggtgagcagaagcgccaccgcccagagaagaaaggagagactgagacagcacagcgagcacgtgggcctggacaacgacctgagagagaagtacatgcaggaggccagaagcctgggcaagaacctgagacagcccaagctgagcgacctgagccccgccgtgatcgcccagaccaactgcaagttcgtggagggcctgctgaaggagtgcagaatgaagaccaagagaatgctggtggagaagatgggccacgaggccgtggagctgggccacggcgaggccaacatcaccggcctggaggagaacaccctgatcgccagcctgtgcgacctgctggagagaatctggagccacggcctgcaggtgaagcagggcaagagcgccctgtggagccacctgatccagttccaggacagagaggagaagcaggagcacctggccgagagccccgtggccctgggccccgagagaagaaagagcgacagcggcgtgatgctgcccaccctgagagtgagcctgatccaggacatgagacacatccagaacatgagcgagatcaagaccgacgtgggcagagccagagcctggatcagactgagcctggagaagaagctgctgagccagcacctgaagcagctgctgagcaaccagcccctgaccaagaagctgtacaagagatacgccttcctgagatgcgaggaggagagagagcagttcctgtaccacctgctgagcctgaacgccgtggactacttctgcttcaccagcgtgttcaccaccatcatgatcccctacagaagcgtgatcatccccatcaagaagctgagcaacgccatcatcaccagcaacccctggatctgcgtgagcggcgagctgggcgacaccggcgtgatgcagatccccaagaacctgctggagatgaccttcgagtgccagaacctgggcaagctgaccaccgtgcagatcggccacgacaacagcggcctgctggccaagtggctggtggactgcgtgatggtgagaaacgagatcaccggccacacctacagattcccctgcggcagatggctgggcaagggcatcgacgacggcagcctggagagaatcctgatcggcgagctgatgaccagcgccagcgacgaggacctggtgaagcagtgcagaacccccccccagcagaagagccccaccaccgccagaagactgagcatcaccagcctgaccggcaagaacaacaagcccaacgccggccagatccaggagggcatcggcgaggccgtgaacaacatcgtgaagcacttccacaagcccgagaaggagagaggcagcctgaccgtgctgctgtgcggcgagaacggcctggtggccgccctggagcaggtgttccaccacggcttcaagagcgccagaatcttccacaagaacgtgttcatctgggacttcatcgagaaggtggtggcctacttcgagaccaccgaccagatcctggacaacgaggacgacgtgctgatccagaagagcagctgcaagaccttctgccactacgtgaacgccatcaacaccgcccccagaaacatcggcaaggacggcaagttccagatcctggtgtgcctgggcaccagagacagactgctgccccagtggatccccctgctggccgagtgccccgccatcaccagaatgtacgaggagagcgccctgctgagagacagaatgaccgtgaacagcctgatcagaatcctgcagaccatccaggacttcaccatcgtgctggagggcagcctgatcaagggcgtggacgtgtag

SEQ ID NO: 17839 - DNA, 2217 bp, Artificial Sequence
  Description of Artificial Sequence: Synthetic coding sequence
atgagcggcagctgcgccgcccccggccccggcagcggcagcagccccgccgcctgcagattcgcccactacttcgtgctgtgcggcatcgacgccgacagcggcctggagcccgacgagctggccgtgctgtaccagtggctggaggccgacagacacggcaagagccagggcgccgccaacaccaccagcggcgagaacttcgaccagagccccctgagaagaaccttcaagagcaaggtgctggcccactacccccagaacatcgagtggaaccccttcgaccaggacgccgtgaacatgctgtgcatgcccaagggcctgagcttcagaacccagaccgacaacaaggacccccagttccacagcttcatcatcaccagagaggacggcagcagaacctacggcttcgtgctgaccttctacgaggaggtgaccagcaagcagatctgcaccgccatgcagaccctgtaccagatgcacaacgccgagcactacagcagcgtgtacgccagcagcagctgcagcatggacagcctggccagcagcctggacgagggcgacaccaccagcctgctgaagctgcagagatacaacagctacgacatcagcagagacaccctgtacgtgagcaagagcatctgcctgatcacccccctgcccttcatgcaggcctgcaagaagttcctgatccagctgtacaaggccgtgaccagccagcagcccccccccctgcccctggagagctacatccacaacatcctgtacgaggtgcccctgcccccccccggcagaagcctgaagttctacggcgtgtacgagcccgtgatctgccagagacccggccccagcgagctgcccctgagcgactaccccctgagagaggccttcgagctgctgggcctggagaacctggtgcaggtgttcacctgcgtgctgctggagatgcagatcctgctgtacagccaggactaccagagactgatgaccgtggccgagggcatcaccaccctgctgttccccttccagtggcagcacgtgtacgtgcccatcctgcccgccagcctgctgcacttcctggacgcccccgtgccctacctgatgggcctgcagagcaaggagggcaccgacagaagcaagctggagctgccccaggaggccaacctgtgcttcgtggacatcgacaaccacttcatcgagctgcccgaggagttcccccagttccccaacaaggtggacttcatccaggagctgagcgaggtgctggtgcagttcggcatcccccccgagggcagcctgcactgcagcgagagcaccagcaagctgaagaacatggtgctgaaggacctggtgaacgacaagaagaacggcaacgtgtgcaccaacaacatcagcatgtacgagctgctgaagggcaacgagaccatcgccagactgcaggccctggccaagagaaccggcgtggccgtggagaagatggacctgagcgccagcctgggcgagaaggacaaggacctgaagctgcactgcgaggaggccgagctgagagactaccagctgaacgtgcagctgagagaggtgttcgccaacagattcacccagatgttcgccgactacgaggccttcgtgatccagaccgcccaggacatggagagctggctgaccaacagagagcagatgcagaacttcgacaaggccagcttcctgagcgaccagcccgagccctacctgcccttcctgagcagattcatcgagacccagatgttcgccaccttcatcgacaacaagatcatgagccagtgggaggagaaggaccccctgctgagagtgttcgacaccagaatcgacaagatcagactgtacaacgtgagagcccccaccctgagaaccagcatctaccagaagtgcagcaccctgaaggaggccgcccagagcatcgagcagagactgatgaagatggaccacaccgccatccacccccacctgctggacatgaagatcggccagggcaagtacgagcagggcttcttccccaagctgcagagcgacgtgctggccaccggccccaccagcaacaacagatgggtgagcagaagcgccaccgcccagagaagaaaggagagactgagacagcacagcgagcacgtgggcctggacaacgacctgagagaggtgtgcggcctgcccagctggggcgccagccagcaggccccctag

SEQ ID NO: 17840 - DNA, 3825 bp, Artificial Sequence
  Description of Artificial Sequence: Synthetic coding sequence
atgagcggcagctgcgccgcccccggccccggcagcggcagcagccccgccgcctgcagattcgcccactacttcgtgctgtgcggcatcgacgccgacagcggcctggagcccgacgagctggccggcgagaacttcgaccagagccccctgagaagaaccttcaagagcaaggtgctggcccactacccccagaacatcgagtggaaccccttcgaccaggacgccgtgaacatgctgtgcatgcccaagggcctgagcttcagaacccagaccgacaacaaggacccccagttccacagcttcatcatcaccagagaggacggcagcagaacctacggcttcgtgctgaccttctacgaggaggtgaccagcaagcagatctgcaccgccatgcagaccctgtaccagatgcacaacgccgagcactacagcagcgtgtacgccagcagcagctgcagcatggacagcctggccagcagcctggacgagggcgacaccaccagcctgctgaagctgcagagatacaacagctacgacatcagcagagacaccctgtacgtgagcaagagcatctgcctgatcacccccctgcccttcatgcaggcctgcaagaagttcctgatccagctgtacaaggccgtgaccagccagcagcccccccccctgcccctggagagctacatccacaacatcctgtacgaggtgcccctgcccccccccggcagaagcctgaagttctacggcgtgtacgagcccgtgatctgccagagacccggccccagcgagctgcccctgagcgactaccccctgagagaggccttcgagctgctgggcctggagaacctggtgcaggtgttcacctgcgtgctgctggagatgcagatcctgctgtacagccaggactaccagagactgatgaccgtggccgagggcatcaccaccctgctgttccccttccagtggcagcacgtgtacgtgcccatcctgcccgccagcctgctgcacttcctggacgcccccgtgccctacctgatgggcctgcagagcaaggagggcaccgacagaagcaagctggagctgccccaggaggccaacctgtgcttcgtggacatcgacaaccacttcatcgagctgcccgaggagttcccccagttccccaacaaggtggacttcatccaggagctgagcgaggtgctggtgcagttcggcatcccccccgagggcagcctgcactgcagcgagagcaccagcaagctgaagaacatggtgctgaaggacctggtgaacgacaagaagaacggcaacgtgtgcaccaacaacatcagcatgtacgagctgctgaagggcaacgagaccatcgccagactgcaggccctggccaagagaaccggcgtggccgtggagaagatggacctgagcgccagcctgggcgagaaggacaaggacctgaagctgcactgcgaggaggccgagctgagagactaccagctgaacgtgcagctgagagaggtgttcgccaacagattcacccagatgttcgccgactacgaggccttcgtgatccagaccgcccaggacatggagagctggctgaccaacagagagcagatgcagaacttcgacaaggccagcttcctgagcgaccagcccgagccctacctgcccttcctgagcagattcatcgagacccagatgttcgccaccttcatcgacaacaagatcatgagccagtgggaggagaaggaccccctgctgagagtgttcgacaccagaatcgacaagatcagactgtacaacgtgagagcccccaccctgagaaccagcatctaccagaagtgcagcaccctgaaggaggccgcccagagcatcgagcagagactgatgaagatggaccacaccgccatccacccccacctgctggacatgaagatcggccagggcaagtacgagcagggcttcttccccaagctgcagagcgacgtgctggccaccggccccaccagcaacaacagatgggtgagcagaagcgccaccgcccagagaagaaaggagagactgagacagcacagcgagcacgtgggcctggacaacgacctgagagagaagtacatgcaggaggccagaagcctgggcaagaacctgagacagcccaagctgagcgacctgagccccgccgtgatcgcccagaccaactgcaagttcgtggagggcctgctgaaggagtgcagaatgaagaccaagagaatgctggtggagaagatgggccacgaggccgtggagctgggccacggcgaggccaacatcaccggcctggaggagaacaccctgatcgccagcctgtgcgacctgctggagagaatctggagccacggcctgcaggtgaagcagggcaagagcgccctgtggagccacctgatccagttccaggacagagaggagaagcaggagcacctggccgagagccccgtggccctgggccccgagagaagaaagagcgacagcggcgtgatgctgcccaccctgagagtgagcctgatccaggacatgagacacatccagaacatgagcgagatcaagaccgacgtgggcagagccagagcctggatcagactgagcctggagaagaagctgctgagccagcacctgaagcagctgctgagcaaccagcccctgaccaagaagctgtacaagagatacgccttcctgagatgcgaggaggagagagagcagttcctgtaccacctgctgagcctgaacgccgtggactacttctgcttcaccagcgtgttcaccaccatcatgatcccctacagaagcgtgatcatccccatcaagaagctgagcaacgccatcatcaccagcaacccctggatctgcgtgagcggcgagctgggcgacaccggcgtgatgcagatccccaagaacctgctggagatgaccttcgagtgccagaacctgggcaagctgaccaccgtgcagatcggccacgacaacagcggcctgctggccaagtggctggtggactgcgtgatggtgagaaacgagatcaccggccacacctacagattcccctgcggcagatggctgggcaagggcatcgacgacggcagcctggagagaatcctgatcggcgagctgatgaccagcgccagcgacgaggacctggtgaagcagtgcagaacccccccccagcagaagagccccaccaccgccagaagactgagcatcaccagcctgaccggcaagaacaacaagcccaacgccggccagatccaggagggcatcggcgaggccgtgaacaacatcgtgaagcacttccacaagcccgagaaggagagaggcagcctgaccgtgctgctgtgcggcgagaacggcctggtggccgccctggagcaggtgttccaccacggcttcaagagcgccagaatcttccacaagaacgtgttcatctgggacttcatcgagaaggtggtggcctacttcgagaccaccgaccagatcctggacaacgaggacgacgtgctgatccagaagagcagctgcaagaccttctgccactacgtgaacgccatcaacaccgcccccagaaacatcggcaaggacggcaagttccagatcctggtgtgcctgggcaccagagacagactgctgccccagtggatccccctgctggccgagtgccccgccatcaccagaatgtacgaggagagcgccctgctgagagacagaatgaccgtgaacagcctgatcagaatcctgcagaccatccaggacttcaccatcgtgctggagggcagcctgatcaagggcgtggacgtgtag

SEQ ID NO: 17841 - DNA, 3930 bp, Artificial Sequence; identical to SEQ ID NO: 17838
  Description of Artificial Sequence: Synthetic coding sequence

SEQ ID NO: 17842 - DNA, 399 bp, Artificial Sequence
  Description of Artificial Sequence: Synthetic coding sequence
atgttcctggtgggcctgaccggcggcatcgccagcggcaagagcagcgtgatccaggtgttccagcagctgggctgcgccgtgatcgacgtggacgtgatggccagacacgtggtgcagcccggctaccccgcccacagaagaatcgtggaggtgttcggcaccgaggtgctgctggagaacggcgacatcaacagaaaggtgctgggcgacctgatcttcaaccagcccgacagaagacagctgctgaacgccatcacccaccccgagatcagaaaggagatgatgaaggagaccttcaagtacttcctgagagagcccagaaccagccccagaggcaagaagcacgtgcccagcgccctgaaggaggccgacagcctgatgagaagagacacctag

SEQ ID NO: 17843 - DNA, 696 bp, Artificial Sequence
  Description of Artificial Sequence: Synthetic coding sequence
atgttcctggtgggcctgaccggcggcatcgccagcggcaagagcagcgtgatccaggtgttccagcagctgggctgcgccgtgatcgacgtggacgtgatggccagacacgtggtgcagcccggctaccccgcccacagaagaatcgtggaggtgttcggcaccgaggtgctgctggagaacggcgacatcaacagaaaggtgctgggcgacctgatcttcaaccagcccgacagaagacagctgctgaacgccatcacccaccccgagatcagaaaggagatgatgaaggagaccttcaagtacttcctgagaggctacagatacgtgatcctggacatccccctgctgttcgagaccaagaagctgctgaagtacatgaagcacaccgtggtggtgtactgcgacagagacacccagctggccagactgatgagaagaaacagcctgaacagaaaggacgccgaggccagaatcaacgcccagctgcccctgaccgacaaggccagaatggccagacacgtgctggacaacagcggcgagtggagcgtgaccaagagacaggtgatcctgctgcacaccgagctggagagaagcctggagtacctgcccctgagattcggcgtgctgaccggcctggccgccatcgccagcctgctgtacctgctgacccactacctgctgccctacgcctag

SEQ ID NO: 17844 - DNA, 696 bp, Artificial Sequence; identical to SEQ ID NO: 17843
  Description of Artificial Sequence: Synthetic coding sequence

SEQ ID NO: 17845 - DNA, 756 bp, Artificial Sequence
  Description of Artificial Sequence: Synthetic coding sequence
atgagcgacatcggcgactggttcagaagcatccccgccatcaccagatactggttcgccgccaccgtggccgtgcccctggtgggcaagctgggcctgatcagccccgcctacctgttcctgtggcccgaggccttcctgtacagattccagatctggagacccatcaccgccaccttctacttccccgtgggccccggcaccggcttcctgtacctggtgaacctgtacttcctgtaccagtacagcaccagactggagaccggcgccttcgacggcagacccgccgactacctgttcatgctgctgttcaactggatctgcatcgtgatcaccggcctggccatggacatgcagctgctgatgatccccctgatcatgagcgtgctgtacgtgtgggcccagctgaacagagacatgatcgtgagcttctggttcggcaccagattcaaggcctgctacctgccctgggtgatcctgggcttcaactacatcatcggcggcagcgtgatcaacgagctgatcggcaacctggtgggccacctgtacttcttcctgatgttcagataccccatggacctgggcggcagaaacttcctgagcaccccccagttcctgtacagatggctgcccagcagaagaggcggcgtgagcggcttcggcgtgccccccgccagcatgagaagagccgccgaccagaacggcggcggcggcagacacaactggggccagggcttcagactgggcgaccagtag

SEQ ID NO: 17846 - DNA, 696 bp, Artificial Sequence
  Description of Artificial Sequence: Synthetic coding sequence
atgagcgacatcggcgactggttcagaagcatccccgccatcaccagatactggttcgccgccaccgtggccgtgcccctggtgggcaagctgggcctgatcagccccgcctacctgttcctgtggcccgaggccttcctgtacagattccagatctggagacccatcaccgccaccttctacttccccgtgggccccggcaccggcttcctgtacctggtgaacctgtacttcctgtaccagtacagcaccagactggagaccggcgccttcgacggcagacccgccgactacctgttcatgctgctgttcaactggatctgcatcgtgatcaccggcctggccatggacatgcagctgctgatgatccccctgatcatgagcgtgctgtacgtgtgggcccagctgaacagagacatgatcgtgagcttctggttcggcaccagattcaaggcctgctacctgccctgggtgatcctgggcttcaactacatcatcggcggcagctaccccatggacctgggcggcagaaacttcctgagcaccccccagttcctgtacagatggctgcccagcagaagaggcggcgtgagcggcttcggcgtgccccccgccagcatgagaagagccgccgaccagaacggcggcggcggcagacacaactggggccagggcttcagactgggcgaccagtag

SEQ ID NO: 17847 - DNA, 456 bp, Artificial Sequence
  Description of Artificial Sequence: Synthetic coding sequence
atgagcgacatcggcgactggttcagaagcatccccgccatcaccagatactggttcgccgccaccgtggccgtgcccctggtgggcaagctgggcctgatcagccccgcctacctgttcctgtggcccgaggccttcctgtacagattccaggcctgctacctgccctgggtgatcctgggcttcaactacatcatcggcggcagcgtgatcaacgagctgatcggcaacctggtgggccacctgtacttcttcctgatgttcagataccccatggacctgggcggcagaaacttcctgagcaccccccagttcctgtacagatggctgcccagcagaagaggcggcgtgagcggcttcggcgtgccccccgccagcatgagaagagccgccgaccagaacggcggcggcggcagacacaactggggccagggcttcagactgggcgaccagtag

SEQ ID NO: 17848 - DNA, 720 bp, Artificial Sequence
  Description of Artificial Sequence: Synthetic coding sequence
atggcctaccagagcctgagactggagtacctgcagatcccccccgtgagcagagcctacaccaccgcctgcgtgctgaccaccgccgccgtgcagctggagctgatcacccccttccagctgtacttcaaccccgagctgatcttcaagcacttccagatctggagactgatcaccaacttcctgttcttcggccccgtgggcttcaacttcctgttcaacatgatcttcctgtacagatactgcagaatgctggaggagggcagcttcagaggcagaaccgccgacttcgtgttcatgttcctgttcggcggcttcctgatgaccctgttcggcctgttcgtgagcctggtgttcctgggccaggccttcaccatcatgctggtgtacgtgtggagcagaagaaacccctacgtgagaatgaacttcttcggcctgctgaacttccaggcccccttcctgccctgggtgctgatgggcttcagcctgctgctgggcaacagcatcatcgtggacctgctgggcatcgccgtgggccacatctacttcttcctggaggacgtgttccccaaccagcccggcggcatcagaatcctgaagacccccagcatcctgaaggccatcttcgacacccccgacgaggaccccaactacaaccccctgcccgaggagagacccggcggcttcgcctggggcgagggccagagactgggcggctag

SEQ ID NO: 17849 - DNA, 708 bp, Artificial Sequence
  Description of Artificial Sequence: Synthetic coding sequence
atggcctggcagggcctggccgccgagttcctgcaggtgcccgccgtgaccagagcctacaccgccgcctgcgtgctgaccaccgccgccgtgcagctggagctgctgagccccttccagctgtacttcaacccccacctggtgttcagaaagttccaggtgtggagactggtgaccaacttcctgttcttcggccccctgggcttcagcttcttcttcaacatgctgttcgtgttcagatactgcagaatgctggaggagggcagcttcagaggcagaaccgccgacttcgtgttcatgttcctgttcggcggcgtgctgatgaccctgctgggcctgctgggcagcctgttcttcctgggccaggccctgatggccatgctggtgtacgtgtggagcagaagaagccccagagtgagagtgaacttcttcggcctgctgaccttccaggcccccttcctgccctgggccctgatgggcttcagcctgctgctgggcaacagcatcctggtggacctgctgggcatcgccgtgggccacatctactacttcctggaggacgtgttccccaaccagcccggcggcaagagactgctgcagacccccggcttcctgaagctgctgctggacgcccccgccgaggaccccaactacctgcccctgcccgaggagcagcccggcccccacctgccccccccccagcagtag

SEQ ID NO: 17850 - DNA, 618 bp, Artificial Sequence
  Description of Artificial Sequence: Synthetic coding sequence
atggcctggcagggcctggccgccgagttcctgcaggtgcccgccgtgaccagagcctacaccgccgcctgcgtgctgaccaccgccgccgtgcagctggagctgctgagccccttccagctgtacttcaacccccacctggtgttcagaaagttccaggtgtggagactggtgaccaacttcctgttcttcggccccctgggcttcagcttcttcttcaacatgctgttcgtgttcagatactgcagaatgctggaggagggcagcttcagaggcagaaccgccgacttcgtgttcatgttcctgttcggcggcgtgctgatgaccctgctgggcctgctgggcagcctgttcttcctgggccaggccctgatggccatgctggtgtacgtgtggagcagaagaagccccagagtgagagtgaacttcttcggcctgctgaccttccaggcccccttcctgccctgggccctgatgggcttcagcctgctgctgggcaacagcatcctggtggacctgctgggcatcgccgtgggccacatctactacttcctggaggacgtgttccccaaccagcccggcggcaagagactgctgcagacccccggcttcctgtag

SEQ ID NO: 17851 - DNA, 720 bp, Artificial Sequence
  Description of Artificial Sequence: Synthetic coding sequence
atggcctggcagggcctggccgccgagttcctgcaggtgcccgccgtgaccagagcctacaccgccgcctgcgtgctgaccaccgccgccgtgcagctggagctgctgagccccttccagctgtacttcaacccccacctggtgttcagaaagttccaggtgtggagactggtgaccaacttcctgttcttcggccccctgggcttcagcttcttcttcaacatgctgttcgtgttcagatactgcagaatgctggaggagggcagcttcagaggcagaaccgccgacttcgtgttcatgttcctgttcggcggcgtgctgatgaccctgctgggcctgctgggcagcctgttcttcctgggccaggccctgatggccatgctggtgtacgtgtggagcagaagaagccccagagtgagagtgaacttcttcggcctgctgaccttccaggcccccttcctgccctgggccctgatgggcttcagcctgctgctgggcaacagcatcctggtggacctgctgggcatcgccgtgggccacatctactacttcctggaggacgtgttccccaaccagcccggcggcaagagactgctgcagacccccggcttcctgggcctgcagagcagcaaggcccccgccggcagcagcctgaccatctggacccagcagagccagggcggccccggcaccgccggcgagctggccgcccccagctag

SEQ ID NO: 17852 - DNA, 2838 bp, Artificial Sequence
  Description of Artificial Sequence: Synthetic coding sequence
atggccgagggccagggcggcggcggccagagatgggactgggccggcggcggcagagccgccgaggaggaggtggtgagaagaagatgcagaagaggcgaggaggcccaggtggcccagccctggcccgagggcagcagaggcaccgccgccggcccccccgtggaggagagattcagacagctgcacctgagaaagcaggtgagctacagaaaggccatcaccaagagcggcctgcagcacctggccccccccccccccacccccggcgccccctgcagcgagagcgagagacagatcagaagcaccgtggactggagcgagagcgccacctacggcgagcacatctggttcgagaccaacgtgagcggcgacttctgctacgtgggcgagcagtactgcgtggccagaatgctgaagagcgtgagcagaagaaagtgcgccgcctgcaagatcgtggtgcacaccccctgcatcgagcagctggagaagatcaacttcagatgcaagcccagcttcagagagagcggcagcagaaacgtgagagagcccaccttcgtgagacaccactgggtgcacagaagaagacaggacggcaagtgcagacactgcggcaagggcttccagcagaagttcaccttccacagcaaggagatcgtggccatcagctgcagctggtgcaagcaggcctaccacagcaaggtgagctgcttcatgctgcagcagatcgaggagccctgcagcctgggcgtgcacgccgccgtggtgatcccccccacctggatcctgagagccagaagaccccagaacaccctgaaggccagcaagaagaagaagagagccagcttcaagagaaagagcagcaagaagggccccgaggagggcagatggagacccttcatcatcagacccacccccagccccctgatgaagcccctgctggtgttcgtgaaccccaagagcggcggcaaccagggcgccaagatcatccagagcttcctgtggtacctgaaccccagacaggtgttcgacctgagccagggcggccccaaggaggccctggagatgtacagaaaggtgcacaacctgagaatcctggcctgcggcggcgacggcaccgtgggctggatcctgagcaccctggaccagctgagactgaagccccccccccccgtggccatcctgcccctgggcaccggcaacgacctggccagaaccctgaactggggcggcggctacaccgacgagcccgtgagcaagatcctgagccacgtggaggagggcaacgtggtgcagctggacagatgggacctgcacgccgagcccaaccccgaggccggccccgaggacagagacgagggcgccaccgacagactgcccctggacgtgttcaacaactacttcagcctgggcttcgacgcccacgtgaccctggagttccacgagagcagagaggccaaccccgagaagttcaacagcagattcagaaacaagatgttctacgccggcaccgccttcagcgacttcctgatgggcagcagcaaggacctggccaagcacatcagagtggtgtgcgacggcatggacctgacccccaagatccaggacctgaagccccagtgcgtggtgttcctgaacatccccagatactgcgccggcaccatgccctggggccaccccggcgagcaccacgacttcgagccccagagacacgacgacggctacctggaggtgatcggcttcaccatgaccagcctggccgccctgcaggtgggcggccacggcgagagactgacccagtgcagagaggtggtgctgaccaccagcaaggccatccccgtgcaggtggacggcgagccctgcaagctggccgccagcagaatcagaatcgccctgagaaaccaggccaccatggtgcagaaggccaagagaagaagcgccgcccccctgcacagcgaccagcagcccgtgcccgagcagctgagaatccaggtgagcagagtgagcatgcacgactacgaggccctgcactacgacaaggagcagctgaaggaggccagcgtgcccctgggcaccgtggtggtgcccggcgacagcgacctggagctgtgcagagcccacatcgagagactgcagcaggagcccgacggcgccggcgccaagagccccacctgccagaagctgagccccaagtggtgcttcctggacgccaccaccgccagcagattctacagaatcgacagagcccaggagcacctgaactacgtgaccgagatcgcccaggacgagatctacatcctggaccccgagctgctgggcgccagcgccagacccgacctgcccacccccaccagccccctgcccaccagcccctgcagccccacccccagaagcctgcagggcgacgccgcccccccccagggcgaggagctgatcgaggccgccaagagaaacgacttctgcaagctgcaggagctgcacagagccggcggcgacctgatgcacagagacgagcagagcagaaccctgctgcaccacgccgtgagcaccggcagcaaggacgtggtgagatacctgctggaccacgccccccccgagatcctggacgccgtggaggagaacggcgagacctgcctgcaccaggccgccgccctgggccagagaaccatctgccactacatcgtggaggccggcgccagcctgatgaagaccgaccagcagggcgacacccccagacagagagccgagaaggcccaggacaccgagctggccgcctacctggagaacagacagcactaccagatgatccagagagaggaccaggagaccgccgtgtag

SEQ ID NO: 17853 - DNA, 2805 bp, Artificial Sequence
  Description of Artificial Sequence: Synthetic coding sequence
atggagcccagagacggcagccccgaggccagaagcagcgacagcgagagcgccagcgccagcagcagcggcagcgagagagacgccggccccgagcccgacaaggcccccagaagactgaacaagagaagattccccggcctgagactgttcggccacagaaaggccatcaccaagagcggcctgcagcacctggccccccccccccccacccccggcgccccctgcagcgagagcgagagacagatcagaagcaccgtggactggagcgagagcgccacctacggcgagcacatctggttcgagaccaacgtgagcggcgacttctgctacgtgggcgagcagtactgcgtggccagaatgctgcagaagagcgtgagcagaagaaagtgcgccgcctgcaagatcgtggtgcacaccccctgcatcgagcagctggagaagatcaacttcagatgcaagcccagcttcagagagagcggcagcagaaacgtgagagagcccaccttcgtgagacaccactgggtgcacagaagaagacaggacggcaagtgcagacactgcggcaagggcttccagcagaagttcaccttccacagcaaggagatcgtggccatcagctgcagctggtgcaagcaggcctaccacagcaaggtgagctgcttcatgctgcagcagatcgaggagccctgcagcctgggcgtgcacgccgccgtggtgatcccccccacctggatcctgagagccagaagaccccagaacaccctgaaggccagcaagaagaagaagagagccagcttcaagagaaagagcagcaagaagggccccgaggagggcagatggagacccttcatcatcagacccacccccagccccctgatgaagcccctgctggtgttcgtgaaccccaagagcggcggcaaccagggcgccaagatcatccagagcttcctgtggtacctgaaccccagacaggtgttcgacctgagccagggcggccccaaggaggccctggagatgtacagaaaggtgcacaacctgagaatcctggcctgcggcggcgacggcaccgtgggctggatcctgagcaccctggaccagctgagactgaagccccccccccccgtggccatcctgcccctgggcaccggcaacgacctggccagaaccctgaactggggcggcggctacaccgacgagcccgtgagcaagatcctgagccacgtggaggagggcaacgtggtgcagctggacagatgggacctgcacgccgagcccaaccccgaggccggccccgaggacagagacgagggcgccaccgacagactgcccctggacgtgttcaacaactacttcagcctgggcttcgacgcccacgtgaccctggagttccacgagagcagagaggccaaccccgagaagttcaacagcagattcagaaacaagatgttctacgccggcaccgccttcagcgacttcctgatgggcagcagcaaggacctggccaagcacatcagagtggtgtgcgacggcatggacctgacccccaagatccaggacctgaagccccagtgcgtggtgttcctgaacatccccagatactgcgccggcaccatgccctggggccaccccggcgagcaccacgacttcgagccccagagacacgacgacggctacctggaggtgatcggcttcaccatgaccagcctggccgccctgcaggtgggcggccacggcgagagactgacccagtgcagagaggtggtgctgaccaccagcaaggccatccccgtgcaggtggacggcgagccctgcaagctggccgccagcagaatcagaatcgccctgagaaaccaggccaccatggtgcagaaggccaagagaagaagcgccgcccccctgcacagcgaccagcagcccgtgcccgagcagctgagaatccaggtgagcagagtgagcatgcacgactacgaggccctgcactacgacaaggagcagctgaaggaggccagcgtgcccctgggcaccgtggtggtgcccggcgacagcgacctggagctgtgcagagcccacatcgagagactgcagcaggagcccgacggcgccggcgccaagagccccacctgccagaagctgagccccaagtggtgcttcctggacgccaccaccgccagcagattctacagaatcgacagagcccaggagcacctgaactacgtgaccgagatcgcccaggacgagatctacatcctggaccccgagctgctgggcgccagcgccagacccgacctgcccacccccaccagccccctgcccaccagcccctgcagccccacccccagaagcctgcagggcgacgccgcccccccccagggcgaggagctgatcgaggccgccaagagaaacgacttctgcaagctgcaggagctgcacagagccggcggcgacctgatgcacagagacgagcagagcagaaccctgctgcaccacgccgtgagcaccggcagcaaggacgtggtgagatacctgctggaccacgccccccccgagatcctggacgccgtggaggagaacccctgcagccccagcggcgagacctgcctgcaccaggccgccgccctgggccagagaaccatctgccactacatcgtggaggccggcgccagcctgatgaagaccgaccagcagggcgacacccccagacagagagccgagaaggcccaggacaccgagctggccgcctacctggagaacagacagcactaccagatgatccagagagaggaccaggagaccgccgtgtag

SEQ ID NO: 17854 - DNA, 3495 bp, Artificial Sequence
  Description of Artificial Sequence: Synthetic coding sequence
atggccggcgccggcggccagcaccacccccccggcgccgccggcggcgccgccgccggcgccggcgccgccgtgaccagcgccgccgccagcgccggccccggcgaggacagcagcgacagcgaggccgagcaggagggcccccagaagctgatcagaaaggtgagcaccagcggccagatcagaaccaagaccagcatcaaggagggccagctgctgaagcagaccagcagcttccagagatggaagaagagatacttcaagctgagaggcagaaccctgtactacgccaaggacagcaagagcctgatcttcgacgaggtggacctgagcgacgccagcgtggccgaggccagcaccaagaacgccaacaacagcttcaccatcatcacccccttcagaagactgatgctgtgcgccgagaacagaaaggagatggaggactggatcagcagcctgaagagcgtgcagaccagagagccctacgaggtggcccagttcaacgtggagcacttcagcggcatgcacaactggtacgcctgcagccacgccagacccaccttctgcaacgtgtgcagagagagcctgagcggcgtgaccagccacggcctgagctgcgaggtgtgcaagttcaaggcccacaagagatgcgccgtgagagccaccaacaactgcaagtggaccaccctggccagcatcggcaaggacatcatcgaggacgaggacggcgtggccatgccccaccagtggctggagggcaacctgcccgtgagcgccaagtgcgccgtgtgcgacaagacctgcggcagcgtgctgagactgcaggactggaagtgcctgtggtgcaagaccatggtgcacaccgcctgcaaggacctgtaccaccccatctgccccctgggccagtgcaaggtgagcatcatcccccccatcgccctgaacagcaccgacagcgacggcttctgcagagccaccttcagcttctgcgtgagccccctgctggtgttcgtgaacagcaagagcggcgacaaccagggcgtgaagttcctgagaagattcaagcagctgctgaaccccgcccaggtgttcgacctgatgaacggcggcccccacctgggcctgagactgttccagaagttcgacaacttcagaatcctggtgtgcggcggcgacggcagcgtgggctgggtgctgagcgagatcgacaagctgaacctgaacaagcagtgccagctgggcgtgctgcccctgggcaccggcaacgacctggccagagtgctgggctggggcggcagctacgacgacgacacccagctgccccagatcctggagaagctggagagagccagcaccaagatgctggacagatggagcatcatgacctacgagctgaagctgccccccaaggccagcctgctgcccggcccccccgaggccagcgaggagttctacatgaccatctacgaggacagcgtggccacccacctgaccaagatcctgaacagcgacgagcacgccgtggtgatcagcagcgccaagaccctgtgcgagaccgtgaaggacttcgtggccaaggtggagaagacctacgacaagaccctggagaacgccgtggtggccgacgccgtggccagcaagtgcagcgtgctgaacgagaagctggagcagctgctgcaggccctgcacaccgacagccaggccgcccccgtgctgcccggcctgagccccctgatcgtggaggaggacgccgtggagagcagcagcgaggagagcctgggcgagagcaaggagcagctgggcgacgacgtgaccaagcccagcagccagaaggccgtgaagcccagagagatcatgctgagagccaacagcctgaagaaggccgtgagacaggtgatcgaggaggccggcaaggtgatggacgaccccaccgtgcacccctgcgagcccgccaaccagagcagcgactacgacagcaccgagaccgacgagagcaaggaggaggccaaggacgacggcgccaaggagagcatcaccgtgaagaccgcccccagaagccccgacgccagagccagctacggccacagccagaccgacagcgtgcccggccccgccgtggccgccagcaaggagaacctgcccgtgctgaacaccagaatcatctgccccggcctgagagccggcctggccgccagcatcgccggcagcagcatcatcaacaagatgctgctggccaacatcgaccccttcggcgccacccccttcatcgaccccgacctggacagcgtggacggctacagcgagaagtgcgtgatgaacaactacttcggcatcggcctggacgccaagatcagcctggagttcaacaacaagagagaggagcaccccgagaagtgcagaagcagaaccaagaacctgatgtggtacggcgtgctgggcaccagagagctgctgcagagaagctacaagaacctggagcagagagtgcagctggagtgcgacggccagtacatccccctgcccagcctgcagggcatcgccgtgctgaacatccccagctacgccggcggcaccaacttctggggcggcaccaaggaggacgacatcttcgccgcccccagcttcgacgacaagatcctggaggtggtggccatcttcgacagcatgcagatggccgtgagcagagtgatcaagctgcagcaccacagaatcgcccagtgcagaaccgtgaagatcaccatcttcggcgacgagggcgtgcccgtgcaggtggacggcgaggcctgggtgcagccccccggcatcatcaagatcgtgcacaagaacagagcccagatgctgaccagagacagagccttcgagagcaccctgaagagctgggaggacaagcagaagtgcgacagcggcaagcccgtgctgagaacccacctgtacatccaccacgccatcgacctggccaccgaggaggtgagccagatgcagctgtgcagccaggccgccgaggagctgatcaccagaatctgcgacgccgccaccatccactgcctgctggagcaggagctggcccacgccgtgaacgcctgcagccacgccctgaacaaggccaaccccagatgccccgagagcctgaccagagacaccgccaccgagatcgccatcaacgtgaaggccctgtacaacgagaccgagagcctgctggtgggcagagtgcccctgcagctggagagcccccacgaggagagagtgagcaacgccctgcacagcgtggaggtggagctgcagaagctgaccgagatcccctggctgtactacatcctgcaccccaacgaggacgaggagccccccatggactgcaccaagagaaacaacagaagcaccgtgttcagaatcgtgcccaagttcaagaaggagaaggtgcagaagcagaagaccagcagccagcccggcagcggcgacaccgagagcggcagctgcgaggccaacagccccggcaactag

SEQ ID NO: 17855 - DNA, 3663 bp, Artificial Sequence
  Description of Artificial Sequence: Synthetic coding sequence
atggccggcgccggcggccagcaccacccccccggcgccgccggcggcgccgccgccggcgccggcgccgccgtgaccagcgccgccgccagcgccggccccggcgaggacagcagcgacagcgaggccgagcaggagggcccccagaagctgatcagaaaggtgagcaccagcggccagatcagaaccaagaccagcatcaaggagggccagctgctgaagcagaccagcagcttccagagatggaagaagagatacttcaagctgagaggcagaaccctgtactacgccaaggacagcaagagcctgatcttcgacgaggtggacctgagcgacgccagcgtggccgaggccagcaccaagaacgccaacaacagcttcaccatcatcacccccttcagaagactgatgctgtgcgccgagaacagaaaggagatggaggactggatcagcagcctgaagagcgtgcagaccagagagccctacgaggtggcccagttcaacgtggagcacttcagcggcatgcacaactggtacgcctgcagccacgccagacccaccttctgcaacgtgtgcagagagagcctgagcggcgtgaccagccacggcctgagctgcgaggtgtgcaagttcaaggcccacaagagatgcgccgtgagagccaccaacaactgcaagtggaccaccctggccagcatcggcaaggacatcatcgaggacgaggacggcgtggccatgccccaccagtggctggagggcaacctgcccgtgagcgccaagtgcgccgtgtgcgacaagacctgcggcagcgtgctgagactgcaggactggaagtgcctgtggtgcaagaccatggtgcacaccgcctgcaaggacctgtaccaccccatctgccccctgggccagtgcaaggtgagcatcatcccccccatcgccctgaacagcaccgacagcgacggcttctgcagagccaccttcagcttctgcgtgagccccctgctggtgttcgtgaacagcaagagcggcgacaaccagggcgtgaagttcctgagaagattcaagcagctgctgaaccccgcccaggtgttcgacctgatgaacggcggcccccacctgggcctgagactgttccagaagttcgacaacttcagaatcctggtgtgcggcggcgacggcagcgtgggctgggtgctgagcgagatcgacaagctgaacctgaacaagcagtgccagctgggcgtgctgcccctgggcaccggcaacgacctggccagagtgctgggctggggcggcagctacgacgacgacacccagctgccccagatcctggagaagctggagagagccagcaccaagatgctggacagatggagcatcatgacctacgagctgaagctgccccccaaggccagcctgctgcccggcccccccgaggccagcgaggagttctacatgaccatctacgaggacagcgtggccacccacctgaccaagatcctgaacagcgacgagcacgccgtggtgatcagcagcgccaagaccctgtgcgagaccgtgaaggacttcgtggccaaggtggagaagacctacgacaagaccctggagaacgccgtggtggccgacgccgtggccagcaagtgcagcgtgctgaacgagaagctggagcagctgctgcaggccctgcacaccgacagccaggccgcccccgtgctgcccggcctgagccccctgatcgtggaggaggacgccgtggagagcagcagcgaggagagcctgggcgagagcaaggagcagctgggcgacgacgtgaccaagcccagcagccagaaggccgtgaagcccagagagatcatgctgagagccaacagcctgaagaaggccgtgagacaggtgatcgaggaggccggcaaggtgatggacgaccccaccgtgcacccctgcgagcccgccaaccagagcagcgactacgacagcaccgagaccgacgagagcaaggaggaggccaaggacgacggcgccaaggagagcatcaccgtgaagaccgcccccagaagccccgacgccagagccagctacggccacagccagaccgacagcgtgcccggccccgccgtggccgccagcaaggagaacctgcccgtgctgaacaccagaatcatctgccccggcctgagagccggcctggccgccagcatcgccggcagcagcatcatcaacaagatgctgctggccaacatcgaccccttcggcgccacccccttcatcgaccccgacctggacagcgtggacggctacagcgagaagtgcgtgatgaacaactacttcggcatcggcctggacgccaagatcagcctggagttcaacaacaagagagaggagcaccccgagaagtgcagaagcagaaccaagaacctgatgtggtacggcgtgctgggcaccagagagctgctgcagagaagctacaagaacctggagcagagagtgcagctggagtgcgacggccagtacatccccctgcccagcctgcagggcatcgccgtgctgaacatccccagctacgccggcggcaccaacttctggggcggcaccaaggaggacgacatcttcgccgcccccagcttcgacgacaagatcctggaggtggtggccatcttcgacagcatgcagatggccgtgagcagagtgatcaagctgcagcaccacagaatcgcccagtgcagaaccgtgaagatcaccatcttcggcgacgagggcgtgcccgtgcaggtggacggcgaggcctgggtgcagccccccggcatcatcaagatcgtgcacaagaacagagcccagatgctgaccagagacagagccttcgagagcaccctgaagagctgggaggacaagcagaagtgcgacagcggcaagcccgtgctgagaacccacctgtacatccaccacgccatcgacctggccaccgaggaggtgagccagatgcagctgtgcagccaggccgccgaggagctgatcaccagaatctgcgacgccgccaccatccactgcctgctggagcaggagctggcccacgccgtgaacgcctgcagccacgccctgaacaaggccaaccccagatgccccgagagcctgaccagagacaccgccaccgagatcgccatcaacgtgaaggccctgtacaacgagaccgagagcctgctggtgggcagagtgcccctgcagctggagagcccccacgaggagagagtgagcaacgccctgcacagcgtggaggtggagctgcagaagctgaccgagatcccctggctgtactacatcctgcaccccaacgaggacgaggagccccccatggactgcaccaagagaaacaacagaagcaccgtgttcagaatcgtgcccaagttcaagaaggagaaggtgcagaagcagaagaccagcagccagcccgtgcagaagtggggcaccgaggaggtggccgcctggctggacctgctgaacctgggcgagtacaaggacatcttcatcagacacgacatcagaggcgccgagctgctgcacctggagagaagagacctgaaggacctgggcatccccaaggtgggccacgtgaagagaatcctgcagggcatcaaggagctgggcagaagcaccccccagagcgaggtgtag

SEQ ID NO: 17856 - DNA, 3303 bp, Artificial Sequence
  Description of Artificial Sequence: Synthetic coding sequence
atgctgtgcgccgagaacagaaaggagatggaggactggatcagcagcctgaagagcgtgcagaccagagagccctacgaggtggcccagttcaacgtggagcacttcagcggcatgcacaactggtacgcctgcagccacgccagacccaccttctgcaacgtgtgcagagagagcctgagcggcgtgaccagccacggcctgagctgcgaggtgtgcaagttcaaggcccacaagagatgcgccgtgagagccaccaacaactgcaagtggaccaccctggccagcatcggcaaggacatcatcgaggacgaggacggcgtggccatgccccaccagtggctggagggcaacctgcccgtgagcgccaagtgcgccgtgtgcgacaagacctgcggcagcgtgctgagactgcaggactggaagtgcctgtggtgcaagaccatggtgcacaccgcctgcaaggacctgtaccaccccatctgccccctgggccagtgcaaggtgagcatcatcccccccatcgccctgaacagcaccgacagcgacggcttctgcagagccaccttcagcttctgcgtgagccccctgctggtgttcgtgaacagcaagagcggcgacaaccagggcgtgaagttcctgagaagattcaagcagctgctgaaccccgcccaggtgttcgacctgatgaacggcggcccccacctgggcctgagactgttccagaagttcgacaacttcagaatcctggtgtgcggcggcgacggcagcgtgggctgggtgctgagcgagatcgacaagctgaacctgaacaagcagtgccagctgggcgtgctgcccctgggcaccggcaacgacctggccagagtgctgggctggggcggcagctacgacgacgacacccagctgccccagatcctggagaagctggagagagccagcaccaagatgctggacagatggagcatcatgacctacgagctgaagctgccccccaaggccagcctgctgcccggcccccccgaggccagcgaggagttctacatgaccatctacgaggacagcgtggccacccacctgaccaagatcctgaacagcgacgagcacgccgtggtgatcagcagcgccaagaccctgtgcgagaccgtgaaggacttcgtggccaaggtggagaagacctacgacaagaccctggagaacgccgtggtggccgacgccgtggccagcaagtgcagcgtgctgaacgagaagctggagcagctgctgcaggccctgcacaccgacagccaggccgcccccgtgctgcccggcctgagccccctgatcgtggaggaggacgccgtggagagcagcagcgaggagagcctgggcgagagcaaggagcagctgggcgacgacgtgaccaagcccagcagccagaaggccgtgaagcccagagagatcatgctgagagccaacagcctgaagaaggccgtgagacaggtgatcgaggaggccggcaaggtgatggacgaccccaccgtgcacccctgcgagcccgccaaccagagcagcgactacgacagcaccgagaccgacgagagcaaggaggaggccaaggacgacggcgccaaggagagcatcaccgtgaagaccgcccccagaagccccgacgccagagccagctacggccacagccagaccgacagcgtgcccggccccgccgtggccgccagcaaggagaacctgcccgtgctgaacaccagaatcatctgccccggcctgagagccggcctggccgccagcatcgccggcagcagcatcatcaacaagatgctgctggccaacatcgaccccttcggcgccacccccttcatcgaccccgacctggacagcgtggacggctacagcgagaagtgcgtgatgaacaactacttcggcatcggcctggacgccaagatcagcctggagttcaacaacaagagagaggagcaccccgagaagtgcagaagcagaaccaagaacctgatgtggtacggcgtgctgggcaccagagagctgctgcagagaagctacaagaacctggagcagagagtgcagctggagtgcgacggccagtacatccccctgcccagcctgcagggcatcgccgtgctgaacatccccagctacgccggcggcaccaacttctggggcggcaccaaggaggacgacatcttcgccgcccccagcttcgacgacaagatcctggaggtggtggccatcttcgacagcatgcagatggccgtgagcagagtgatcaagctgcagcaccacagaatcgcccagtgcagaaccgtgaagatcaccatcttcggcgacgagggcgtgcccgtgcaggtggacggcgaggcctgggtgcagccccccggcatcatcaagatcgtgcacaagaacagagcccagatgctgaccagagacagagccttcgagagcaccctgaagagctgggaggacaagcagaagtgcgacagcggcaagcccgtgctgagaacccacctgtacatccaccacgccatcgacctggccaccgaggaggtgagccagatgcagctgtgcagccaggccgccgaggagctgatcaccagaatctgcgacgccgccaccatccactgcctgctggagcaggagctggcccacgccgtgaacgcctgcagccacgccctgaacaaggccaaccccagatgccccgagagcctgaccagagacaccgccaccgagatcgccatcaacgtgaaggccctgtacaacgagaccgagagcctgctggtgggcagagtgcccctgcagctggagagcccccacgaggagagagtgagcaacgccctgcacagcgtggaggtggagctgcagaagctgaccgagatcccctggctgtactacatcctgcaccccaacgaggacgaggagccccccatggactgcaccaagagaaacaacagaagcaccgtgttcagaatcgtgcccaagttcaagaaggagaaggtgcagaagcagaagaccagcagccagcccgtgcagaagtggggcaccgaggaggtggccgcctggctggacctgctgaacctgggcgagtacaaggacatcttcatcagacacgacatcagaggcgccgagctgctgcacctggagagaagagacctgaagaacaccgtgggcgagaagagagacaccaaggagaacggcaagcacatggacctgggcatccccaaggtgggccacgtgaagagaatcctgcagggcatcaaggagctgggcagaagcaccccccagagcgaggtgtag

SEQ ID NO: 17857 - DNA, 3255 bp, Artificial Sequence
  Description of Artificial Sequence: Synthetic coding sequence
atgctgtgcgccgagaacagaaaggagatggaggactggatcagcagcctgaagagcgtgcagaccagagagccctacgaggtggcccagttcaacgtggagcacttcagcggcatgcacaactggtacgcctgcagccacgccagacccaccttctgcaacgtgtgcagagagagcctgagcggcgtgaccagccacggcctgagctgcgaggtgtgcaagttcaaggcccacaagagatgcgccgtgagagccaccaacaactgcaagtggaccaccctggccagcatcggcaaggacatcatcgaggacgaggacggcgtggccatgccccaccagtggctggagggcaacctgcccgtgagcgccaagtgcgccgtgtgcgacaagacctgcggcagcgtgctgagactgcaggactggaagtgcctgtggtgcaagaccatggtgcacaccgcctgcaaggacctgtaccaccccatctgccccctgggccagtgcaaggtgagcatcatcccccccatcgccctgaacagcaccgacagcgacggcttctgcagagccaccttcagcttctgcgtgagccccctgctggtgttcgtgaacagcaagagcggcgacaaccagggcgtgaagttcctgagaagattcaagcagctgctgaaccccgcccaggtgttcgacctgatgaacggcggcccccacctgggcctgagactgttccagaagttcgacaacttcagaatcctggtgtgcggcggcgacggcagcgtgggctgggtgctgagcgagatcgacaagctgaacctgaacaagcagtgccagctgggcgtgctgcccctgggcaccggcaacgacctggccagagtgctgggctggggcggcagctacgacgacgacacccagctgccccagatcctggagaagctggagagagccagcaccaagatgctggacagatggagcatcatgacctacgagctgaagctgccccccaaggccagcctgctgcccggcccccccgaggccagcgaggagttctacatgaccatctacgaggacagcgtggccacccacctgaccaagatcctgaacagcgacgagcacgccgtggtgatcagcagcgccaagaccctgtgcgagaccgtgaaggacttcgtggccaaggtggagaagacctacgacaagaccctggagaacgccgtggtggccgacgccgtggccagcaagtgcagcgtgctgaacgagaagctggagcagctgctgcaggccctgcacaccgacagccaggccgcccccgtgctgcccggcctgagccccctgatcgtggaggaggacgccgtggagagcagcagcgaggagagcctgggcgagagcaaggagcagctgggcgacgacgtgaccaagcccagcagccagaaggccgtgaagcccagagagatcatgctgagagccaacagcctgaagaaggccgtgagacaggtgatcgaggaggccggcaaggtgatggacgaccccaccgtgcacccctgcgagcccgccaaccagagcagcgactacgacagcaccgagaccgacgagagcaaggaggaggccaaggacgacggcgccaaggagagcatcaccgtgaagaccgcccccagaagccccgacgccagagccagctacggccacagccagaccgacagcgtgcccggccccgccgtggccgccagcaaggagaacctgcccgtgctgaacaccagaatcatctgccccggcctgagagccggcctggccgccagcatcgccggcagcagcatcatcaacaagatgctgctggccaacatcgaccccttcggcgccacccccttcatcgaccccgacctggacagcgtggacggctacagcgagaagtgcgtgatgaacaactacttcggcatcggcctggacgccaagatcagcctggagttcaacaacaagagagaggagcaccccgagaagtgcagaagcagaaccaagaacctgatgtggtacggcgtgctgggcaccagagagctgctgcagagaagctacaagaacctggagcagagagtgcagctggagtgcgacggccagtacatccccctgcccagcctgcagggcatcgccgtgctgaacatccccagctacgccggcggcaccaacttctggggcggcaccaaggaggacgacatcttcgccgcccccagcttcgacgacaagatcctggaggtggtggccatcttcgacagcatgcagatggccgtgagcagagtgatcaagctgcagcaccacagaatcgcccagtgcagaaccgtgaagatcaccatcttcggcgacgagggcgtgcccgtgcaggtggacggcgaggcctgggtgcagccccccggcatcatcaagatcgtgcacaagaacagagcccagatgctgaccagagacagagccttcgagagcaccctgaagagctgggaggacaagcagaagtgcgacagcggcaagcccgtgctgagaacccacctgtacatccaccacgccatcgacctggccaccgaggaggtgagccagatgcagctgtgcagccaggccgccgaggagctgatcaccagaatctgcgacgccgccaccatccactgcctgctggagcaggagctggcccacgccgtgaacgcctgcagccacgccctgaacaaggccaaccccagatgccccgagagcctgaccagagacaccgccaccgagatcgccatcaacgtgaaggccctgtacaacgagaccgagagcctgctggtgggcagagtgcccctgcagctggagagcccccacgaggagagagtgagcaacgccctgcacagcgtggaggtggagctgcagaagctgaccgagatcccctggctgtactacatcctgcaccccaacgaggacgaggagccccccatggactgcaccaagagaaacaacagaagcaccgtgttcagaatcgtgcccaagttcaagaaggagaaggtgcagaagcagaagaccagcagccagcccgtgcagaagtggggcaccgaggaggtggccgcctggctggacctgctgaacctgggcgagtacaaggacatcttcatcagacacgacatcagaggcgccgagctgctgcacctggagagaagagacctgaaggacctgggcatccccaaggtgggccacgtgaagagaatcctgcagggcatcaaggagctgggcagaagcaccccccagagcgaggtgtag

SEQ ID NO: 17858 - DNA, 2760 bp, Artificial Sequence
  Description of Artificial Sequence: Synthetic coding sequence
atgtggaacatcagccagggctgcaccaccggcacccccgcccccacccccgacccccccagcgtgacctgcgccgagagagtgttcctggagagcccccccatggcctgccccgccaaggtgcacaccgcctgcaaggacctgtaccaccccatctgccccctgggccagtgcaaggtgagcatcatcccccccatcgccctgaacagcaccgacagcgacggcttctgcagagccaccttcagcttctgcgtgagccccctgctggtgttcgtgaacagcaagagcggcgacaaccagggcgtgaagttcctgagaagattcaagcagctgctgaaccccgcccaggtgttcgacctgatgaacggcggcccccacctgggcctgagactgttccagaagttcgacaacttcagaatcctggtgtgcggcggcgacggcagcgtgggctgggtgctgagcgagatcgacaagctgaacctgaacaagcagtgccagctgggcgtgctgcccctgggcaccggcaacgacctggccagagtgctgggctggggcggcagctacgacgacgacacccagctgccccagatcctggagaagctggagagagccagcaccaagatgctggacagatggagcatcatgacctacgagctgaagctgccccccaaggccagcctgctgcccggcccccccgaggccagcgaggagttctacatgaccatctacgaggacagcgtggccacccacctgaccaagatcctgaacagcgacgagcacgccgtggtgatcagcagcgccaagaccctgtgcgagaccgtgaaggacttcgtggccaaggtggagaagacctacgacaagaccctggagaacgccgtggtggccgacgccgtggccagcaagtgcagcgtgctgaacgagaagctggagcagctgctgcaggccctgcacaccgacagccaggccgcccccgtgctgcccggcctgagccccctgatcgtggaggaggacgccgtggagagcagcagcgaggagagcctgggcgagagcaaggagcagctgggcgacgacgtgaccaagcccagcagccagaaggccgtgaagcccagagagatcatgctgagagccaacagcctgaagaaggccgtgagacaggtgatcgaggaggccggcaaggtgatggacgaccccaccgtgcacccctgcgagcccgccaaccagagcagcgactacgacagcaccgagaccgacgagagcaaggaggaggccaaggacgacggcgccaaggagagcatcaccgtgaagaccgcccccagaagccccgacgccagagccagctacggccacagccagaccgacagcgtgcccggccccgccgtggccgccagcaaggagaacctgcccgtgctgaacaccagaatcatctgccccggcctgagagccggcctggccgccagcatcgccggcagcagcatcatcaacaagatgctgctggccaacatcgaccccttcggcgccacccccttcatcgaccccgacctggacagcgtggacggctacagcgagaagtgcgtgatgaacaactacttcggcatcggcctggacgccaagatcagcctggagttcaacaacaagagagaggagcaccccgagaagtgcagaagcagaaccaagaacctgatgtggtacggcgtgctgggcaccagagagctgctgcagagaagctacaagaacctggagcagagagtgcagctggagtgcgacggccagtacatccccctgcccagcctgcagggcatcgccgtgctgaacatccccagctacgccggcggcaccaacttctggggcggcaccaaggaggacgacatcttcgccgcccccagcttcgacgacaagatcctggaggtggtggccatcttcgacagcatgcagatggccgtgagcagagtgatcaagctgcagcaccacagaatcgcccagtgcagaaccgtgaagatcaccatcttcggcgacgagggcgtgcccgtgcaggtggacggcgaggcctgggtgcagccccccggcatcatcaagatcgtgcacaagaacagagcccagatgctgaccagagacagagccttcgagagcaccctgaagagctgggaggacaagcagaagtgcgacagcggcaagcccgtgctgagaacccacctgtacatccaccacgccatcgacctggccaccgaggaggtgagccagatgcagctgtgcagccaggccgccgaggagctgatcaccagaatctgcgacgccgccaccatccactgcctgctggagcaggagctggcccacgccgtgaacgcctgcagccacgccctgaacaaggccaaccccagatgccccgagagcctgaccagagacaccgccaccgagatcgccatcaacgtgaaggccctgtacaacgagaccgagagcctgctggtgggcagagtgcccctgcagctggagagcccccacgaggagagagtgagcaacgccctgcacagcgtggaggtggagctgcagaagctgaccgagatcccctggctgtactacatcctgcaccccaacgaggacgaggagccccccatggactgcaccaagagaaacaacagaagcaccgtgttcagaatcgtgcccaagttcaagaaggagaaggtgcagaagcagaagaccagcagccagcccggcagcggcgacaccgagagcggcagctgcgaggccaacagccccggcaactag

SEQ ID NO: 17859 - DNA, 3495 bp, Artificial Sequence; identical to SEQ ID NO: 17854
  Description of Artificial Sequence: Synthetic coding sequence

SEQ ID NO: 17860 - DNA, 2721 bp, Artificial Sequence
  Description of Artificial Sequence: Synthetic coding sequence
atggagcccagagacggcagccccgaggccagaagcagcgacagcgagagcgccagcgccagcagcagcggcagcgagagagacgccggccccgagcccgacaaggcccccagaagactgaacaagagaagattccccggcctgagactgttcggccacagaaaggccatcaccaagagcggcctgcagcacctggccccccccccccccacccccggcgccccctgcagcgagagcgagagacagatcagaagcaccgtggactggagcgagagcgccacctacggcgagcacatctggttcgagaccaacgtgagcggcgacttctgctacgtgggcgagcagtactgcgtggccagaatgctgcagaagagcgtgagcagaagaaagtgcgccgcctgcaagatcgtggtgcacaccccctgcatcgagcagctggagaagatcaacttcagatgcaagcccagcttcagagagagcggcagcagaaacgtgagagagggcttccagcagaagttcaccttccacagcaaggagatcgtggccatcagctgcagctggtgcaagcaggcctaccacagcaaggtgagctgcttcatgctgcagcagatcgaggagccctgcagcctgggcgtgcacgccgccgtggtgatcccccccacctggatcctgagagccagaagaccccagaacaccctgaaggccagcaagaagaagaagagagccagcttcaagagaaagagcagcaagaagggccccgaggagggcagatggagacccttcatcatcagacccacccccagccccctgatgaagcccctgctggtgttcgtgaaccccaagagcggcggcaaccagggcgccaagatcatccagagcttcctgtggtacctgaaccccagacaggtgttcgacctgagccagggcggccccaaggaggccctggagatgtacagaaaggtgcacaacctgagaatcctggcctgcggcggcgacggcaccgtgggctggatcctgagcaccctggaccagctgagactgaagccccccccccccgtggccatcctgcccctgggcaccggcaacgacctggccagaaccctgaactggggcggcggctacaccgacgagcccgtgagcaagatcctgagccacgtggaggagggcaacgtggtgcagctggacagatgggacctgcacgccgagcccaaccccgaggccggccccgaggacagagacgagggcgccaccgacagactgcccctggacgtgttcaacaactacttcagcctgggcttcgacgcccacgtgaccctggagttccacgagagcagagaggccaaccccgagaagttcaacagcagattcagaaacaagatgttctacgccggcaccgccttcagcgacttcctgatgggcagcagcaaggacctggccaagcacatcagagtggtgtgcgacggcatggacctgacccccaagatccaggacctgaagccccagtgcgtggtgttcctgaacatccccagatactgcgccggcaccatgccctggggccaccccggcgagcaccacgacttcgagccccagagacacgacgacggctacctggaggtgatcggcttcaccatgaccagcctggccgccctgcaggtgggcggccacggcgagagactgacccagtgcagagaggtggtgctgaccaccagcaaggccatccccgtgcaggtggacggcgagccctgcaagctggccgccagcagaatcagaatcgccctgagaaaccaggccaccatggtgcagaaggccaagagaagaagcgccgcccccctgcacagcgaccagcagcccgtgcccgagcagctgagaatccaggtgagcagagtgagcatgcacgactacgaggccctgcactacgacaaggagcagctgaaggaggccagcgtgcccctgggcaccgtggtggtgcccggcgacagcgacctggagctgtgcagagcccacatcgagagactgcagcaggagcccgacggcgccggcgccaagagccccacctgccagaagctgagccccaagtggtgcttcctggacgccaccaccgccagcagattctacagaatcgacagagcccaggagcacctgaactacgtgaccgagatcgcccaggacgagatctacatcctggaccccgagctgctgggcgccagcgccagacccgacctgcccacccccaccagccccctgcccaccagcccctgcagccccacccccagaagcctgcagggcgacgccgcccccccccagggcgaggagctgatcgaggccgccaagagaaacgacttctgcaagctgcaggagctgcacagagccggcggcgacctgatgcacagagacgagcagagcagaaccctgctgcaccacgccgtgagcaccggcagcaaggacgtggtgagatacctgctggaccacgccccccccgagatcctggacgccgtggaggagaacggcgagacctgcctgcaccaggccgccgccctgggccagagaaccatctgccactacatcgtggaggccggcgccagcctgatgaagaccgaccagcagggcgacacccccagacagagagccgagaaggcccaggacaccgagctggccgcctacctggagaacagacagcactaccagatgatccagagagaggaccaggagaccgccgtgtag

SEQ ID NO: 17861 - DNA, 2688 bp, Artificial Sequence
  Description of Artificial Sequence: Synthetic coding sequence
atgtggagatacagaagctgggacgtgccccagatccccagcgaggccccccagacccagaaggccatcaccaagagcggcctgcagcacctggccccccccccccccacccccggcgccccctgcagcgagagcgagagacagatcagaagcaccgtggactggagcgagagcgccacctacggcgagcacatctggttcgagaccaacgtgagcggcgacttctgctacgtgggcgagcagtactgcgtggccagaatgctgcagaagagcgtgagcagaagaaagtgcgccgcctgcaagatcgtggtgcacaccccctgcatcgagcagctggagaagatcaacttcagatgcaagcccagcttcagagagagcggcagcagaaacgtgagagagcccaccttcgtgagacaccactgggtgcacagaagaagacaggacggcaagtgcagacactgcggcaagggcttccagcagaagttcaccttccacagcaaggagatcgtggccatcagctgcagctggtgcaagcaggcctaccacagcaaggtgagctgcttcatgctgcagcagatcgaggagccctgcagcctgggcgtgcacgccgccgtggtgatcccccccacctggatcctgagagccagaagaccccagaacaccctgaaggccagcaagaagaagaagagagccagcttcaagagaaagagcagcaagaagggccccgaggagggcagatggagacccttcatcatcagacccacccccagccccctgatgaagcccctgctggtgttcgtgaaccccaagagcggcggcaaccagggcgccaagatcatccagagcttcctgtggtacctgaaccccagacaggtgttcgacctgagccagggcggccccaaggaggccctggagatgtacagaaaggtgcacaacctgagaatcctggcctgcggcggcgacggcaccgtgggctggatcctgagcaccctggaccagctgagactgaagccccccccccccgtggccatcctgcccctgggcaccggcaacgacctggccagaaccctgaactggggcggcggctacaccgacgagcccgtgagcaagatcctgagccacgtggaggagggcaacgtggtgcagctggacagatgggacctgcacgccgagcccaaccccgaggccggccccgaggacagagacgagggcgccaccgacagactgcccctggacgtgttcaacaactacttcagcctgggcttcgacgcccacgtgaccctggagttccacgagagcagagaggccaaccccgagaagttcaacagcagattcagaaacaagatgttctacgccggcaccgccttcagcgacttcctgatgggcagcagcaaggacctggccaagcacatcagagtggtgtgcgacggcatggacctgacccccaagatccaggacctgaagccccagtgcgtggtgttcctgaacatccccagatactgcgccggcaccatgccctggggccaccccggcgagcaccacgacttcgagccccagagacacgacgacggctacctggaggtgatcggcttcaccatgaccagcctggccgccctgcaggtgggcggccacggcgagagactgacccagtgcagagaggtggtgctgaccaccagcaaggccatccccgtgcaggtggacggcgagccctgcaagctggccgccagcagaatcagaatcgccctgagaaaccaggccaccatggtgcagaaggccaagagaagaagcgccgcccccctgcacagcgaccagcagcccgtgcccgagcagctgagaatccaggtgagcagagtgagcatgcacgactacgaggccctgcactacgacaaggagcagctgaaggaggccagcgtgcccctgggcaccgtggtggtgcccggcgacagcgacctggagctgtgcagagcccacatcgagagactgcagcaggagcccgacggcgccggcgccaagagccccacctgccagaagctgagccccaagtggtgcttcctggacgccaccaccgccagcagattctacagaatcgacagagcccaggagcacctgaactacgtgaccgagatcgcccaggacgagatctacatcctggaccccgagctgctgggcgccagcgccagacccgacctgcccacccccaccagccccctgcccaccagcccctgcagccccacccccagaagcctgcagggcgacgccgcccccccccagggcgaggagctgatcgaggccgccaagagaaacgacttctgcaagctgcaggagctgcacagagccggcggcgacctgatgcacagagacgagcagagcagaaccctgctgcaccacgccgtgagcaccggcagcaaggacgtggtgagatacctgctggaccacgccccccccgagatcctggacgccgtggaggagaacggcgagacctgcctgcaccaggccgccgccctgggccagagaaccatctgccactacatcgtggaggccggcgccagcctgatgaagaccgaccagcagggcgacacccccagacagagagccgagaaggcccaggacaccgagctggccgcctacctggagaacagacagcactaccagatgatccagagagaggaccaggagaccgccgtgtag

SEQ ID NO: 17862 - DNA, 2790 bp, Artificial Sequence
  Description of Artificial Sequence: Synthetic coding sequence
atggagcccagagacggcagccccgaggccagaagcagcgacagcgagagcgccagcgccagcagcagcggcagcgagagagacgccggccccgagcccgacaaggcccccagaagactgaacaagagaagattccccggcctgagactgttcggccacagaaaggccatcaccaagagcggcctgcagcacctggccccccccccccccacccccggcgccccctgcagcgagagcgagagacagatcagaagcaccgtggactggagcgagagcgccacctacggcgagcacatctggttcgagaccaacgtgagcggcgacttctgctacgtgggcgagcagtactgcgtggccagaatgctgcagaagagcgtgagcagaagaaagtgcgccgcctgcaagatcgtggtgcacaccccctgcatcgagcagctggagaagatcaacttcagatgcaagcccagcttcagagagagcggcagcagaaacgtgagagagcccaccttcgtgagacaccactgggtgcacagaagaagacaggacggcaagtgcagacactgcggcaagggcttccagcagaagttcaccttccacagcaaggagatcgtggccatcagctgcagctggtgcaagcaggcctaccacagcaaggtgagctgcttcatgctgcagcagatcgaggagccctgcagcctgggcgtgcacgccgccgtggtgatcccccccacctggatcctgagagccagaagaccccagaacaccctgaaggccagcaagaagaagaagagagccagcttcaagagaaagagcagcaagaagggccccgaggagggcagatggagacccttcatcatcagacccacccccagccccctgatgaagcccctgctggtgttcgtgaaccccaagagcggcggcaaccagggcgccaagatcatccagagcttcctgtggtacctgaaccccagacaggtgttcgacctgagccagggcggccccaaggaggccctggagatgtacagaaaggtgcacaacctgagaatcctggcctgcggcggcgacggcaccgtgggctggatcctgagcaccctggaccagctgagactgaagccccccccccccgtggccatcctgcccctgggcaccggcaacgacctggccagaaccctgaactggggcggcggctacaccgacgagcccgtgagcaagatcctgagccacgtggaggagggcaacgtggtgcagctggacagatgggacctgcacgccgagcccaaccccgaggccggccccgaggacagagacgagggcgccaccgacagactgcccctggacgtgttcaacaactacttcagcctgggcttcgacgcccacgtgaccctggagttccacgagagcagagaggccaaccccgagaagttcaacagcagattcagaaacaagatgttctacgccggcaccgccttcagcgacttcctgatgggcagcagcaaggacctggccaagcacatcagagtggtgtgcgacggcatggacctgacccccaagatccaggacctgaagccccagtgcgtggtgttcctgaacatccccagatactgcgccggcaccatgccctggggccaccccggcgagcaccacgacttcgagccccagagacacgacgacggctacctggaggtgatcggcttcaccatgaccagcctggccgccctgcaggtgggcggccacggcgagagactgacccagtgcagagaggtggtgctgaccaccagcaaggccatccccgtgcaggtggacggcgagccctgcaagctggccgccagcagaatcagaatcgccctgagaaaccaggccaccatggtgcagaaggccaagagaagaagcgccgcccccctgcacagcgaccagcagcccgtgcccgagcagctgagaatccaggtgagcagagtgagcatgcacgactacgaggccctgcactacgacaaggagcagctgaaggaggccagcgtgcccctgggcaccgtggtggtgcccggcgacagcgacctggagctgtgcagagcccacatcgagagactgcagcaggagcccgacggcgccggcgccaagagccccacctgccagaagctgagccccaagtggtgcttcctggacgccaccaccgccagcagattctacagaatcgacagagcccaggagcacctgaactacgtgaccgagatcgcccaggacgagatctacatcctggaccccgagctgctgggcgccagcgccagacccgacctgcccacccccaccagccccctgcccaccagcccctgcagccccacccccagaagcctgcagggcgacgccgcccccccccagggcgaggagctgatcgaggccgccaagagaaacgacttctgcaagctgcaggagctgcacagagccggcggcgacctgatgcacagagacgagcagagcagaaccctgctgcaccacgccgtgagcaccggcagcaaggacgtggtgagatacctgctggaccacgccccccccgagatcctggacgccgtggaggagaacggcgagacctgcctgcaccaggccgccgccctgggccagagaaccatctgccactacatcgtggaggccggcgccagcctgatgaagaccgaccagcagggcgacacccccagacagagagccgagaaggcccaggacaccgagctggccgcctacctggagaacagacagcactaccagatgatccagagagaggaccaggagaccgccgtgtag

SEQ ID NO: 17863 - DNA, 3354 bp, Artificial Sequence
  Description of Artificial Sequence: Synthetic coding sequence
atggagaccttcttcagaagacacttcagaggcaaggtgcccggccccggcgagggccagcagagacccagcagcgtgggcctgcccaccggcaaggccagaagaagaagccccgccggccaggccagcagcagcctggcccagagaagaagaagcagcgcccagctgcagggctgcctgctgagctgcggcgtgagagcccagggcagcagcagaagaagaagcagcaccgtgccccccagctgcaaccccagattcatcgtggacaaggtgctgaccccccagcccaccaccgtgggcgcccagctgctgggcgcccccctgctgctgaccggcctggtgggcatgaacgaggaggagggcgtgcaggaggacgtggtggccgaggccagcagcgccatccagcccggcaccaagacccccggcccccccccccccagaggcgcccagcccctgctgcccctgcccagatacctgagaagagccagcagccacctgctgcccgccgacgccgtgtacgaccacgccctgtggggcctgcacggctactacagaagactgagccagagaagacccagcggccagcaccccggccccggcggcagaagagccagcggcaccaccgccggcaccatgctgcccaccagagtgagacccctgagcagaagaagacaggtggccctgagaagaaaggccgccggcccccaggcctggagcgccctgctggccaaggccatcaccaagagcggcctgcagcacctggccccccccccccccacccccggcgccccctgcagcgagagcgagagacagatcagaagcaccgtggactggagcgagagcgccacctacggcgagcacatctggttcgagaccaacgtgagcggcgacttctgctacgtgggcgagcagtactgcgtggccagaatgctgaagagcgtgagcagaagaaagtgcgccgcctgcaagatcgtggtgcacaccccctgcatcgagcagctggagaagatcaacttcagatgcaagcccagcttcagagagagcggcagcagaaacgtgagagagcccaccttcgtgagacaccactgggtgcacagaagaagacaggacggcaagtgcagacactgcggcaagggcttccagcagaagttcaccttccacagcaaggagatcgtggccatcagctgcagctggtgcaagcaggcctaccacagcaaggtgagctgcttcatgctgcagcagatcgaggagccctgcagcctgggcgtgcacgccgccgtggtgatcccccccacctggatcctgagagccagaagaccccagaacaccctgaaggccagcaagaagaagaagagagccagcttcaagagaaagagcagcaagaagggccccgaggagggcagatggagacccttcatcatcagacccacccccagccccctgatgaagcccctgctggtgttcgtgaaccccaagagcggcggcaaccagggcgccaagatcatccagagcttcctgtggtacctgaaccccagacaggtgttcgacctgagccagggcggccccaaggaggccctggagatgtacagaaaggtgcacaacctgagaatcctggcctgcggcggcgacggcaccgtgggctggatcctgagcaccctggaccagctgagactgaagccccccccccccgtggccatcctgcccctgggcaccggcaacgacctggccagaaccctgaactggggcggcggctacaccgacgagcccgtgagcaagatcctgagccacgtggaggagggcaacgtggtgcagctggacagatgggacctgcacgccgagcccaaccccgaggccggccccgaggacagagacgagggcgccaccgacagactgcccctggacgtgttcaacaactacttcagcctgggcttcgacgcccacgtgaccctggagttccacgagagcagagaggccaaccccgagaagttcaacagcagattcagaaacaagatgttctacgccggcaccgccttcagcgacttcctgatgggcagcagcaaggacctggccaagcacatcagagtggtgtgcgacggcatggacctgacccccaagatccaggacctgaagccccagtgcgtggtgttcctgaacatccccagatactgcgccggcaccatgccctggggccaccccggcgagcaccacgacttcgagccccagagacacgacgacggctacctggaggtgatcggcttcaccatgaccagcctggccgccctgcaggtgggcggccacggcgagagactgacccagtgcagagaggtggtgctgaccaccagcaaggccatccccgtgcaggtggacggcgagccctgcaagctggccgccagcagaatcagaatcgccctgagaaaccaggccaccatggtgcagaaggccaagagaagaagcgccgcccccctgcacagcgaccagcagcccgtgcccgagcagctgagaatccaggtgagcagagtgagcatgcacgactacgaggccctgcactacgacaaggagcagctgaaggaggccagcgtgcccctgggcaccgtggtggtgcccggcgacagcgacctggagctgtgcagagcccacatcgagagactgcagcaggagcccgacggcgccggcgccaagagccccacctgccagaagctgagccccaagtggtgcttcctggacgccaccaccgccagcagattctacagaatcgacagagcccaggagcacctgaactacgtgaccgagatcgcccaggacgagatctacatcctggaccccgagctgctgggcgccagcgccagacccgacctgcccacccccaccagccccctgcccaccagcccctgcagccccacccccagaagcctgcagggcgacgccgcccccccccagggcgaggagctgatcgaggccgccaagagaaacgacttctgcaagctgcaggagctgcacagagccggcggcgacctgatgcacagagacgagcagagcagaaccctgctgcaccacgccgtgagcaccggcagcaaggacgtggtgagatacctgctggaccacgccccccccgagatcctggacgccgtggaggagaacggcgagacctgcctgcaccaggccgccgccctgggccagagaaccatctgccactacatcgtggaggccggcgccagcctgatgaagaccgaccagcagggcgacacccccagacagagagccgagaaggcccaggacaccgagctggccgcctacctggagaacagacagcactaccagatgatccagagagaggaccaggagaccgccgtgtag

SEQ ID NO: 17864 - DNA, 2787 bp, Artificial Sequence
  Description of Artificial Sequence: Synthetic coding sequence
atggagcccagagacggcagccccgaggccagaagcagcgacagcgagagcgccagcgccagcagcagcggcagcgagagagacgccggccccgagcccgacaaggcccccagaagactgaacaagagaagattccccggcctgagactgttcggccacagaaaggccatcaccaagagcggcctgcagcacctggccccccccccccccacccccggcgccccctgcagcgagagcgagagacagatcagaagcaccgtggactggagcgagagcgccacctacggcgagcacatctggttcgagaccaacgtgagcggcgacttctgctacgtgggcgagcagtactgcgtggccagaatgctgaagagcgtgagcagaagaaagtgcgccgcctgcaagatcgtggtgcacaccccctgcatcgagcagctggagaagatcaacttcagatgcaagcccagcttcagagagagcggcagcagaaacgtgagagagcccaccttcgtgagacaccactgggtgcacagaagaagacaggacggcaagtgcagacactgcggcaagggcttccagcagaagttcaccttccacagcaaggagatcgtggccatcagctgcagctggtgcaagcaggcctaccacagcaaggtgagctgcttcatgctgcagcagatcgaggagccctgcagcctgggcgtgcacgccgccgtggtgatcccccccacctggatcctgagagccagaagaccccagaacaccctgaaggccagcaagaagaagaagagagccagcttcaagagaaagagcagcaagaagggccccgaggagggcagatggagacccttcatcatcagacccacccccagccccctgatgaagcccctgctggtgttcgtgaaccccaagagcggcggcaaccagggcgccaagatcatccagagcttcctgtggtacctgaaccccagacaggtgttcgacctgagccagggcggccccaaggaggccctggagatgtacagaaaggtgcacaacctgagaatcctggcctgcggcggcgacggcaccgtgggctggatcctgagcaccctggaccagctgagactgaagccccccccccccgtggccatcctgcccctgggcaccggcaacgacctggccagaaccctgaactggggcggcggctacaccgacgagcccgtgagcaagatcctgagccacgtggaggagggcaacgtggtgcagctggacagatgggacctgcacgccgagcccaaccccgaggccggccccgaggacagagacgagggcgccaccgacagactgcccctggacgtgttcaacaactacttcagcctgggcttcgacgcccacgtgaccctggagttccacgagagcagagaggccaaccccgagaagttcaacagcagattcagaaacaagatgttctacgccggcaccgccttcagcgacttcctgatgggcagcagcaaggacctggccaagcacatcagagtggtgtgcgacggcatggacctgacccccaagatccaggacctgaagccccagtgcgtggtgttcctgaacatccccagatactgcgccggcaccatgccctggggccaccccggcgagcaccacgacttcgagccccagagacacgacgacggctacctggaggtgatcggcttcaccatgaccagcctggccgccctgcaggtgggcggccacggcgagagactgacccagtgcagagaggtggtgctgaccaccagcaaggccatccccgtgcaggtggacggcgagccctgcaagctggccgccagcagaatcagaatcgccctgagaaaccaggccaccatggtgcagaaggccaagagaagaagcgccgcccccctgcacagcgaccagcagcccgtgcccgagcagctgagaatccaggtgagcagagtgagcatgcacgactacgaggccctgcactacgacaaggagcagctgaaggaggccagcgtgcccctgggcaccgtggtggtgcccggcgacagcgacctggagctgtgcagagcccacatcgagagactgcagcaggagcccgacggcgccggcgccaagagccccacctgccagaagctgagccccaagtggtgcttcctggacgccaccaccgccagcagattctacagaatcgacagagcccaggagcacctgaactacgtgaccgagatcgcccaggacgagatctacatcctggaccccgagctgctgggcgccagcgccagacccgacctgcccacccccaccagccccctgcccaccagcccctgcagccccacccccagaagcctgcagggcgacgccgcccccccccagggcgaggagctgatcgaggccgccaagagaaacgacttctgcaagctgcaggagctgcacagagccggcggcgacctgatgcacagagacgagcagagcagaaccctgctgcaccacgccgtgagcaccggcagcaaggacgtggtgagatacctgctggaccacgccccccccgagatcctggacgccgtggaggagaacggcgagacctgcctgcaccaggccgccgccctgggccagagaaccatctgccactacatcgtggaggccggcgccagcctgatgaagaccgaccagcagggcgacacccccagacagagagccgagaaggcccaggacaccgagctggccgcctacctggagaacagacagcactaccagatgatccagagagaggaccaggagaccgccgtgtag

SEQ ID NO: 17865 - DNA, 846 bp, Artificial Sequence
  Description of Artificial Sequence: Synthetic coding sequence
atggagcccagagacggcagccccgaggccagaagcagcgacagcgagagcgccagcgccagcagcagcggcagcgagagagacgccggccccgagcccgacaaggcccccagaagactgaacaagagaagattccccggcctgagactgttcggccacagcaagagcaagagccccacctgccagaagctgagccccaagtggtgcttcctggacgccaccaccgccagcagattctacagaatcgacagagcccaggagcacctgaactacgtgaccgagatcgcccaggacgagatctacatcctggaccccgagctgctgggcgccagcgccagacccgacctgcccacccccaccagccccctgcccaccagcccctgcagccccacccccagaagcctgcagggcgacgccgcccccccccagggcgaggagctgatcgaggccgccaagagaaacgacttctgcaagctgcaggagctgcacagagccggcggcgacctgatgcacagagacgagcagagcagaaccctgctgcaccacgccgtgagcaccggcagcaaggacgtggtgagatacctgctggaccacgccccccccgagatcctggacgccgtggaggagaacggcgagacctgcctgcaccaggccgccgccctgggccagagaaccatctgccactacatcgtggaggccggcgccagcctgatgaagaccgaccagcagggcgacacccccagacagagagccgagaaggcccaggacaccgagctggccgcctacctggagaacagacagcactaccagatgatccagagagaggaccaggagaccgccgtgtag

SEQ ID NO: 17866 - DNA, 1014 bp, Artificial Sequence
  Description of Artificial Sequence: Synthetic coding sequence
atggccttcttcagcagactgaacctgcaggagggcctgcagaccttcttcgtgctgcagtggatccccgtgtacatcttcctgggcgccatccccatcctgctgatcccctacttcctgctgttcagcaagttctggcccctggccgtgctgagcctggcctggctgacctacgactggaacacccacagccagggcggcagaagaagcgcctgggtgagaaactggaccctgtggaagtacttcagaaactacttccccgtgaagctggtgaagacccacgacctgagccccaagcacaactacatcatcgccaaccacccccacggcatcctgagcttcggcgtgttcatcaacttcgccaccgaggccaccggcatcgccagaatcttccccagcatcacccccttcgtgggcaccctggagagaatcttctggatccccatcgtgagagagtacgtgatgagcatgggcgtgtgccccgtgagcagcagcgccctgaagtacctgctgacccagaagggcagcggcaacgccgtggtgatcgtggtgggcggcgccgccgaggccctgctgtgcagacccggcgccagcaccctgttcctgaagcagagaaagggcttcgtgaagatggccctgcagaccggcgcctacctggtgcccagctacagcttcggcgagaacgaggtgttcaaccaggagaccttccccgagggcacctggctgagactgttccagaagaccttccaggacaccttcaagaagatcctgggcctgaacttctgcaccttccacggcagaggcttcaccagaggcagctggggcttcctgcccttcaacagacccatcaccaccgtggtgggcgagcccctgcccatccccagaatcaagagacccaaccagaagaccgtggacaagtaccacgccctgtacatcagcgccctgagaaagctgttcgaccagcacaaggtggagtacggcctgcccgagacccaggagctgaccatcacctag

SEQ ID NO: 17867 - DNA, 267 bp, Artificial Sequence
  Description of Artificial Sequence: Synthetic coding sequence
atgcccgccttcgccgagttcgagaaggccgccgaggaggtgagacacctgaagaccaagcccagcgacgaggagatgctgttcatctacggccactacaagcaggccaccgtgggcgacatcaacaccgagagacccggcatgctggacttcaccggcaaggccaagtgggacgcctggaacgagctgaagggcaccagcaaggaggacgccatgaaggcctacatcaacaaggtggaggagctgaagaagaagtacggcatctag

SEQ ID NO: 17868 - DNA, 315 bp, Artificial Sequence
  Description of Artificial Sequence: Synthetic coding sequence
atgtggggcgacctgtggctgctgccccccgccagcgccaaccccggcaccggcaccgaggccgagttcgagaaggccgccgaggaggtgagacacctgaagaccaagcccagcgacgaggagatgctgttcatctacggccactacaagcaggccaccgtgggcgacatcaacaccgagagacccggcatgctggacttcaccggcaaggccaagtgggacgcctggaacgagctgaagggcaccagcaaggaggacgccatgaaggcctacatcaacaaggtggaggagctgaagaagaagtacggcatctag

SEQ ID NO: 17869 - DNA, 264 bp, Artificial Sequence
  Description of Artificial Sequence: Synthetic coding sequence
atgagccaggccgagttcgagaaggccgccgaggaggtgagacacctgaagaccaagcccagcgacgaggagatgctgttcatctacggccactacaagcaggccaccgtgggcgacatcaacaccgagagacccggcatgctggacttcaccggcaaggccaagtgggacgcctggaacgagctgaagggcaccagcaaggaggacgccatgaaggcctacatcaacaaggtggaggagctgaagaagaagtacggcatctag

SEQ ID NO: 17870 - DNA, 315 bp, Artificial Sequence; identical to SEQ ID NO: 17868
  Description of Artificial Sequence: Synthetic coding sequence

SEQ ID NO: 17871 - DNA, 390 bp, Artificial Sequence
  Description of Artificial Sequence: Synthetic coding sequence
atgagccagcacagagccggcagaagaggcggcgtgggcaagagaggcgtgagaggcagagagctgggcggccagggcaagtacggcgccggctgcagcgagtgcggcaccagaagaatcgccgccagaggcgaggccgagttcgagaaggccgccgaggaggtgagacacctgaagaccaagcccagcgacgaggagatgctgttcatctacggccactacaagcaggccaccgtgggcgacatcaacaccgagagacccggcatgctggacttcaccggcaaggccaagtgggacgcctggaacgagctgaagggcaccagcaaggaggacgccatgaaggcctacatcaacaaggtggaggagctgaagaagaagtacggcatctag

SEQ ID NO: 17872 - DNA, 315 bp, Artificial Sequence; identical to SEQ ID NO: 17868
  Description of Artificial Sequence: Synthetic coding sequence

SEQ ID NO: 17873 - DNA, 447 bp, Artificial Sequence
  Description of Artificial Sequence: Synthetic coding sequence
atggagagatggggcaagggcctgcacggcctggaggagagaggcgacagcgtgcccatccccaagcacagagccggcagaagaggcggcgtgggcaagagaggcgtgagaggcagagagctgggcggccagggcaagtacggcgccggctgcagcgagtgcggcaccagaagaatcgccgccagaggcgaggccgagttcgagaaggccgccgaggaggtgagacacctgaagaccaagcccagcgacgaggagatgctgttcatctacggccactacaagcaggccaccgtgggcgacatcaacaccgagagacccggcatgctggacttcaccggcaaggccaagtgggacgcctggaacgagctgaagggcaccagcaaggaggacgccatgaaggcctacatcaacaaggtggaggagctgaagaagaagtacggcatctag

SEQ ID NO: 17874 - DNA, 564 bp, Artificial Sequence
  Description of Artificial Sequence: Synthetic coding sequence
atgttcctgctgctgaactgcatcgtggccgtgagccagaacatgggcatcggcaagaacggcgacctgcccagaccccccctgagaaacgagttcagatacttccagagaatgaccaccaccagcagcgtggagggcaagcagaacctggtgatcatgggcagaaagacctggttcagcatccccgagaagaacagacccctgaaggacagaatcaacctggtgctgagcagagagctgaaggagcccccccagggcgcccacttcctggccagaagcctggacgacgccctgaagctgaccgagagacccgagctggccaacaaggtggacatgatctggatcgtgggcggcagcagcgtgtacaaggaggccatgaaccacctgggccacctgaagctgttcgtgaccagaatcatgcaggacttcgagagcgacaccttcttcagcgagatcgacctggagaagtacaagctgctgcccgagtaccccggcgtgctgagcgacgtgcaggagggcaagcacatcaagtacaagttcgaggtgtgcgagaaggacgactag

SEQ ID NO: 17875 - DNA, 564 bp, Artificial Sequence; identical to SEQ ID NO: 17874
  Description of Artificial Sequence: Synthetic coding sequence

SEQ ID NO: 17876 - DNA, 564 bp, Artificial Sequence; identical to SEQ ID NO: 17874
  Description of Artificial Sequence: Synthetic coding sequence

SEQ ID NO: 17877 - DNA, 345 bp, Artificial Sequence
  Description of Artificial Sequence: Synthetic coding sequence
atgttcctgctgctgaactgcatcgtggccgtgagccagaacatgggcatcggcaagaacggcgacctgcccagaccccccctgagaaacgagttcagatacttccagagaatgaccaccaccagcagcgtggagggcaagcagaacctggtgatcatgggcagaaagacctggttcagcatccccgagaagaacagacccctgaaggacagaatcaacctggtgctgagcagagagctgaaggagcccccccagggcgcccacttcctggccagaagcctggacgacgccctgaagctgaccgagagacccgagctggccaacaaggtggacatgatctggtag

SEQ ID NO: 17878 - DNA, 597 bp, Artificial Sequence
  Description of Artificial Sequence: Synthetic coding sequence
atgcccgagcagagcaacgactacagagtggtggtgttcggcgccggcggcgtgggcaagagcagcctggtgctgagattcgtgaagggcaccttcagagacacctacatccccaccatcgaggacacctacagacaggtgatcagctgcgacaagagcgtgtgcaccctgcagatcaccgacaccaccggcagccaccagttccccgccatgcagagactgagcatcagcaagggccacgccttcatcctggtgttcagcgtgaccagcaagcagagcctggaggagctgggccccatctacaagctgatcgtgcagatcaagggcagcgtggaggacatccccgtgatgctggtgggcaacaagtgcgacgagacccagagagaggtggacaccagagaggcccaggccgtggcccaggagtggaagtgcgccttcatggagaccagcgccaagatgaactacaacgtgaaggagctgttccaggagctgctgaccctggagaccagaagaaacatgagcctgaacatcgacggcaagagaagcggcaagcagaagagaaccgacagagtgaagggcaagtgcaccctgatgtag

SEQ ID NO: 17879 - DNA, 600 bp, Artificial Sequence
  Description of Artificial Sequence: Synthetic coding sequence
atgcccgagcagagcaacgactacagagtggccgtgttcggcgccggcggcgtgggcaagagcagcctggtgctgagattcgtgaagggcaccttcagagagagctacatccccaccgtggaggacacctacagacaggtgatcagctgcgacaagagcatctgcaccctgcagatcaccgacaccaccggcagccaccagttccccgccatgcagagactgagcatcagcaagggccacgccttcatcctggtgtacagcatcaccagcagacagagcctggaggagctgaagcccatctacgagcagatctgcgagatcaagggcgacgtggagagcatccccatcatgctggtgggcaacaagtgcgacgagagccccagcagagaggtgcagagcagcgaggccgaggccctggccagaacctggaagtgcgccttcatggagaccagcgccaagctgaaccacaacgtgaaggagctgttccaggagctgctgaacctggagaagagaagaaccgtgagcctgcagatcgacggcaagaagagcaagcagcagaagagaaaggagaagctgaagggcaagtgcgtgatcatgtag

SEQ ID NO: 17880 - DNA, 690 bp, Artificial Sequence
  Description of Artificial Sequence: Synthetic coding sequence
atgggcaacgccagcttcggcagcaaggagcagaagctgctgaagagactgagactgctgcccgccctgctgatcctgagagccttcaagccccacagaaagatcagagactacagagtggtggtggtgggcaccgccggcgtgggcaagagcaccctgctgcacaagtgggccagcggcaacttcagacacgagtacctgcccaccatcgagaacacctactgccagctgctgggctgcagccacggcgtgctgagcctgcacatcaccgacagcaagagcggcgacggcaacagagccctgcagagacacgtgatcgccagaggccacgccttcgtgctggtgtacagcgtgaccaagaaggagaccctggaggagctgaaggccttctacgagctgatctgcaagatcaagggcaacaacctgcacaagttccccatcgtgctggtgggcaacaagagcgacgacacccacagagaggtggccctgaacgacggcgccacctgcgccatggagtggaactgcgccttcatggagatcagcgccaagaccgacgtgaacgtgcaggagctgttccacatgctgctgaactacaagaagaagcccaccaccggcctgcaggagcccgagaagaagagccagatgcccaacaccaccgagaagctgctggacaagtgcatcatcatgtag

SEQ ID NO: 17881 - DNA, 690 bp, Artificial Sequence; identical to SEQ ID NO: 17880
  Description of Artificial Sequence: Synthetic coding sequence

SEQ ID NO: 17882 - DNA, 501 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctag

SEQ ID NO: 17883 - DNA, 420 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggagtag

SEQ ID NO: 17884 - DNA, 756 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagccgacagagtgatgagcgtgtgcctgagagtggagctgtacggctgcctgtggagagacggcctgctgagctacaccgcccccgtgggccagaccatgtacctgagcgaggccgtgtacctgaacgacagcacctacgacggccacaccgtgggcggcctgcagtacggcggcctgggccagctggccgacggcgtggtgggcctggacgacttcagaaagagccaggagctgagagtgtggccctag

SEQ ID NO: 17885 - DNA, 420 bp, Artificial Sequence; identical to SEQ ID NO: 17883
  Description of Artificial Sequence: Synthetic coding sequence

SEQ ID NO: 17886 - DNA, 756 bp, Artificial Sequence; identical to SEQ ID NO: 17884
  Description of Artificial Sequence: Synthetic coding sequence

SEQ ID NO: 17887 - DNA, 420 bp, Artificial Sequence; identical to SEQ ID NO: 17883
  Description of Artificial Sequence: Synthetic coding sequence

SEQ ID NO: 17888 - DNA, 756 bp, Artificial Sequence; identical to SEQ ID NO: 17884
  Description of Artificial Sequence: Synthetic coding sequence

SEQ ID NO: 17889 - DNA, 756 bp, Artificial Sequence; identical to SEQ ID NO: 17884
  Description of Artificial Sequence: Synthetic coding sequence

SEQ ID NO: 17890 - DNA, 420 bp, Artificial Sequence; identical to SEQ ID NO: 17883
  Description of Artificial Sequence: Synthetic coding sequence

SEQ ID NO: 17891 - DNA, 192 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagatag

SEQ ID NO: 17892 - DNA, 756 bp, Artificial Sequence; identical to SEQ ID NO: 17884
  Description of Artificial Sequence: Synthetic coding sequence

SEQ ID NO: 17893 - DNA, 420 bp, Artificial Sequence; identical to SEQ ID NO: 17883
  Description of Artificial Sequence: Synthetic coding sequence

SEQ ID NO: 17894 - DNA, 420 bp, Artificial Sequence; identical to SEQ ID NO: 17883
  Description of Artificial Sequence: Synthetic coding sequence

SEQ ID NO: 17895 - DNA, 192 bp, Artificial Sequence; identical to SEQ ID NO: 17891
  Description of Artificial Sequence: Synthetic coding sequence

SEQ ID NO: 17896 - DNA, 630 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagccgacagagtgatgagcgtgtgcctgagagtggagctgtacggctgcctgtggagagacggcctgctgagctacaccgcccccgtgggccagaccatgtacctgagcgaggccgtgtactag

SEQ ID NO: 17897 - DNA, 420 bp, Artificial Sequence; identical to SEQ ID NO: 17883
  Description of Artificial Sequence: Synthetic coding sequence

SEQ ID NO: 17898 - DNA, 420 bp, Artificial Sequence; identical to SEQ ID NO: 17883
  Description of Artificial Sequence: Synthetic coding sequence

SEQ ID NO: 17899 - DNA, 420 bp, Artificial Sequence; identical to SEQ ID NO: 17883
  Description of Artificial Sequence: Synthetic coding sequence

SEQ ID NO: 17900 - DNA, 144 bp, Artificial Sequence
  Description of Artificial Sequence: Synthetic coding sequence
agcgaggccgtgtacctgaacgacagcacctacgacggccacaccgtgggcggcctgcagtacggcggcctgggccagctggccgacggcgtggtgggcctggacgacttcagaaagagccaggagctgagagtgtggccctag

SEQ ID NO: 17901 - DNA, 444 bp, Artificial Sequence
  Description of Artificial Sequence: Synthetic coding sequence
atgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggacccctag

SEQ ID NO: 17902 - DNA, 420 bp, Artificial Sequence; identical to SEQ ID NO: 17883
  Description of Artificial Sequence: Synthetic coding sequence

SEQ ID NO: 17903 - DNA, 756 bp, Artificial Sequence
  Description of Artificial Sequence: Synthetic coding sequence
atgccccacctggccagcctgttcaccgccagcagcagatgctgcccccaccccctgagacccgagggcagcggcgccatgggccccgaggccctgagcagcctgctgctgctgctgctggtggccagcggcgacgccgacatgaagggccacttcgaccccgccaagtgcagatacgccctgggcatgcaggacagaaccatccccgacagcgacatcagcgccagcagcagctggagcgacagcaccgccgccagacacagcagactggagagcagcgacggcgacggcgcctggtgccccgccggcagcgtgttccccaaggaggaggagtacctgcaggtggacctgcagagactgcacctggtggccctggtgggcacccagggcagacacgccggcggcctgggcaaggagttcagcagaagctacagactgagatacagcagagacggcagaagatggatgggctggaaggacagatggggccaggaggtgatcagcggcaacgaggaccccgagggcgtggtgctgaaggacctgggcccccccatggtggccagactggtgagattctaccccagagccgacagagtgatgagcgtgtgcctgagagtggagctgtacggctgcctgtggagaggcgagtggctgagcttcctgggcatctgcttcctgagcagaggcctggagggcggcgagtgcggcgagtgggccagcagaatccccagccccgccggcaagctgagcctgtag

SEQ ID NO: 17904 - DNA, 1620 bp, Artificial Sequence
  Description of Artificial Sequence: Synthetic coding sequence
atggtgcccggcgccagaggcggcggcgccctggccagagccgccggcagaggcctgctggccctgctgctggccgtgagcgcccccctgagactgcaggccgaggagctgggcgacggctgcggccacctggtgacctaccaggacagcggcaccatgaccagcaagaactaccccggcacctaccccaaccacaccgtgtgcgagaagaccatcaccgtgcccaagggcaagagactgatcctgagactgggcgacctggacatcgagagccagacctgcgccagcgactacctgctgttcaccagcagcagcgaccagtacggcccctactgcggcagcatgaccgtgcccaaggagctgctgctgaacaccagcgaggtgaccgtgagattcgagagcggcagccacatcagcggcagaggcttcctgctgacctacgccagcagcgaccaccccgacctgatcacctgcctggagagagccagccactacctgaagaccgagtacagcaagttctgccccgccggctgcagagacgtggccggcgacatcagcggcaacatggtggacggctacagagacaccagcctgctgtgcaaggccgccatccacgccggcatcatcgccgacgagctgggcggccagatcagcgtgctgcagagaaagggcatcagcagatacgagggcatcctggccaacggcgtgctgagcagagacggcagcctgagcgacaagagattcctgttcaccagcaacggctgcagcagaagcctgagcttcgagcccgacggccagatcagagccagcagcagctggcagagcgtgaacgagagcggcgaccaggtgcactggagccccggccaggccagactgcaggaccagggccccagctgggccagcggcgacagcagcaacaaccacaagcccagagagtggctggagatcgacctgggcgagaagaagaagatcaccggcatcagaaccaccggcagcacccagagcaacttcaacttctacgtgaagagcttcgtgatgaacttcaagaacaacaacagcaagtggaagacctacaagggcatcgtgaacaacgaggagaaggtgttccagggcaacagcaacttcagagaccccgtgcagaacaacttcatcccccccatcgtggccagatacgtgagagtggtgccccagacctggcaccagagaatcgccctgaaggtggagctgatcggctgccagatcacccagggcaacgacagcctggtgtggagaaagaccagccagagcaccagcgtgagcaccaagaaggaggacgagaccatcaccagacccatccccagcgaggagaccagcaccggcatcaacatcaccaccgtggccatccccctggtgctgctggtggtgctggtgttcgccggcatgggcatcttcgccgccttcagaaagaagaagaagaagggcagcccctacggcagcgccgaggcccagaagaccgactgctggaagcagatcaagtaccccttcgccagacaccagagcgccgagttcaccatcagctacgacaacgagaaggagatgacccagaagctggacctgatcaccagcgacatggccggctag

SEQ ID NO: 17905 - DNA, 2148 bp, Artificial Sequence
  Description of Artificial Sequence: Synthetic coding sequence
atggtgcccggcgccagaggcggcggcgccctggccagagccgccggcagaggcctgctggccctgctgctggccgtgagcgcccccctgagactgcaggccgaggagctgggcgacggctgcggccacctggtgacctaccaggacagcggcaccatgaccagcaagaactaccccggcacctaccccaaccacaccgtgtgcgagaagaccatcaccgtgcccaagggcaagagactgatcctgagactgggcgacctggacatcgagagccagacctgcgccagcgactacctgctgttcaccagcagcagcgaccagtacggcccctactgcggcagcatgaccgtgcccaaggagctgctgctgaacaccagcgaggtgaccgtgagattcgagagcggcagccacatcagcggcagaggcttcctgctgacctacgccagcagcgaccaccccgacctgatcacctgcctggagagagccagccactacctgaagaccgagtacagcaagttctgccccgccggctgcagagacgtggccggcgacatcagcggcaacatggtggacggctacagagacaccagcctgctgtgcaaggccgccatccacgccggcatcatcgccgacgagctgggcggccagatcagcgtgctgcagagaaagggcatcagcagatacgagggcatcctggccaacggcgtgctgagcagagacggcagcctgagcgacaagagattcctgttcaccagcaacggctgcagcagaagcctgagcttcgagcccgacggccagatcagagccagcagcagctggcagagcgtgaacgagagcggcgaccaggtgcactggagccccggccaggccagactgcaggaccagggccccagctgggccagcggcgacagcagcaacaaccacaagcccagagagtggctggagatcgacctgggcgagaagaagaagatcaccggcatcagaaccaccggcagcacccagagcaacttcaacttctacgtgaagagcttcgtgatgaacttcaagaacaacaacagcaagtggaagacctacaagggcatcgtgaacaacgaggagaaggtgttccagggcaacagcaacttcagagaccccgtgcagaacaacttcatcccccccatcgtggccagatacgtgagagtggtgccccagacctggcaccagagaatcgccctgaaggtggagctgatcggctgccagatcacccagggcaacgacagcctggtgtggagaaagaccagccagagcaccagcgtgagcaccaagaaggaggacgagaccatcaccagacccatccccagcgaggagaccagcaccggcatcaacatcaccaccgtggccatccccctggtgctgctggtggtgctggtgttcgccggcatgggcatcttcgccgccttcagaaagaagaagaagaagggcagcccctacggcagcgccgaggcccagaagaccgactgctggaagcagatcaagtaccccttcgccagacaccagagcgccgagttcaccatcagctacgacaacgagaaggagatgacccagaagctggacctgatcaccagcgacatggccgactaccagcagcccctgatgatcggcaccggcaccgtgaccagaaagggcagcaccttcagacccatggacaccgacgccgaggaggccggcgtgagcaccgacgccggcggccactacgactgcccccagagagccggcagacacgagtacgccctgcccctggccccccccgagcccgagtacgccacccccatcgtggagagacacgtgctgagagcccacaccttcagcgcccagagcggctacagagtgcccggcccccagcccggccacaagcacagcctgagcagcggcggcttcagccccgtggccggcgtgggcgcccaggacggcgactaccagagaccccacagcgcccagcccgccgacagaggctacgacagacccaaggccgtgagcgccctggccaccgagagcggccaccccgacagccagaagccccccacccaccccggcaccagcgacagctacagcgcccccagagactgcctgacccccctgaaccagaccgccatgaccgccctgctgtag

SEQ ID NO: 17906 - DNA, 1551 bp, Artificial Sequence
  Description of Artificial Sequence: Synthetic coding sequence
atggtgcccggcgccagaggcggcggcgccctggccagagccgccggcagaggcctgctggccctgctgctggccgtgagcgcccccctgagactgcaggccgaggagctgggcgacggctgcggccacctggtgacctaccaggacagcggcaccatgaccagcaagaactaccccggcacctaccccaaccacaccgtgtgcgagaagaccatcaccgtgcccaagggcaagagactgatcctgagactgggcgacctggacatcgagagccagacctgcgccagcgactacctgctgttcaccagcagcagcgaccagtacggcccctactgcggcagcatgaccgtgcccaaggagctgctgctgaacaccagcgaggtgaccgtgagattcgagagcggcagccacatcagcggcagaggcttcctgctgacctacgccagcagcgaccaccccgacctgatcacctgcctggagagagccagccactacctgaagaccgagtacagcaagttctgccccgccggctgcagagacgtggccggcgacatcagcggcaacatggtggacggctacagagacaccagcctgctgtgcaaggccgccatccacgccggcatcatcgccgacgagctgggcggccagatcagcgtgctgcagagaaagggcatcagcagatacgagggcatcctggccaacggcgtgctgagcagagacggcagcctgagcgacaagagattcctgttcaccagcaacggcatcaacatcaccaccgtggccatccccctggtgctgctggtggtgctggtgttcgccggcatgggcatcttcgccgccttcagaaagaagaagaagaagggcagcccctacggcagcgccgaggcccagaagaccgactgctggaagcagatcaagtaccccttcgccagacaccagagcgccgagttcaccatcagctacgacaacgagaaggagatgacccagaagctggacctgatcaccagcgacatggccgactaccagcagcccctgatgatcggcaccggcaccgtgaccagaaagggcagcaccttcagacccatggacaccgacgccgaggaggccggcgtgagcaccgacgccggcggccactacgactgcccccagagagccggcagacacgagtacgccctgcccctggccccccccgagcccgagtacgccacccccatcgtggagagacacgtgctgagagcccacaccttcagcgcccagagcggctacagagtgcccggcccccagcccggccacaagcacagcctgagcagcggcggcttcagccccgtggccggcgtgggcgcccaggacggcgactaccagagaccccacagcgcccagcccgccgacagaggctacgacagacccaaggccgtgagcgccctggccaccgagagcggccaccccgacagccagaagccccccacccaccccggcaccagcgacagctacagcgcccccagagactgcctgacccccctgaaccagaccgccatgaccgccctgctgtag

SEQ ID NO: 17907 - DNA, 618 bp, Artificial Sequence
  Description of Artificial Sequence: Synthetic coding sequence
atgaacttcaagaacaacaacagcaagtggaagacctacaagggcatcgtgaacaacgaggagaaggtgttccagggcaacagcaacttcagagaccccgtgcagaacaacttcatcccccccatcgtggccagatacgtgagagtggtgccccagacctggcaccagagaatcgccctgaaggtggagctgatcggctgccagatcacccagggcaacgacagcctggtgtggagaaagaccagccagagcaccagcgtgagcaccaagaaggaggacgagaccatcaccagacccatccccagcgaggagaccagcaccggcatcaacatcaccaccgtggccatccccctggtgctgctggtggtgctggtgttcgccggcatgggcatcttcgccgccttcagaaagaagaagaagaagggcagcccctacggcagcgccgaggcccagaagaccgactgctggaagcagatcaagtaccccttcgccagacaccagagcgccgagttcaccatcagctacgacaacgagaaggagatgacccagaagctggacctgatcaccagcgacatggccgccagccccgagcccgtgagcgagcccctgcccccctag

SEQ ID NO: 17908 - DNA, 2328 bp, Artificial Sequence
  Description of Artificial Sequence: Synthetic coding sequence
atggccagcagagccgtggtgagagccagaagatgcccccagtgcccccaggtgagagccgccgccgccgcccccgcctgggccgccctgcccctgagcagaagcctgcccccctgcagcaacagcagcagcttcagcatgcccctgttcctgctgctgctgctggtgctgctgctgctgctggaggacgccggcgcccagcagggcgacggctgcggccacaccgtgctgggccccgagagcggcaccctgaccagcatcaactacccccagacctaccccaacagcaccgtgtgcgagtgggagatcagagtgaagatgggcgagagagtgagaatcaagttcggcgacttcgacatcgaggacagcgacagctgccacttcaactacctgagaatctacaacggcatcggcgtgagcagaaccgagatcggcaagtactgcggcctgggcctgcagatgaaccacagcatcgagagcaagggcaacgagatcaccctgctgttcatgagcggcatccacgtgagcggcagaggcttcctggccagctacagcgtgatcgacaagcaggacctgatcacctgcctggacaccgccagcaacttcctggagcccgagttcagcaagtactgccccgccggctgcctgctgcccttcgccgagatcagcggcaccatcccccacggctacagagacagcagccccctgtgcatggccggcgtgcacgccggcgtggtgagcaacaccctgggcggccagatcagcgtggtgatcagcaagggcatcccctactacgagagcagcctggccaacaacgtgaccagcgtggtgggccacctgagcaccagcctgttcaccttcaagaccagcggctgctacggcaccctgggcatggagagcggcgtgatcgccgacccccagatcaccgccagcagcgtgctggagtggaccgaccacaccggccaggagaacagctggaagcccaagaaggccagactgaagaagcccggccccccctgggccgccttcgccaccgacgagtaccagtggctgcagatcgacctgaacaaggagaagaagatcaccggcatcatcaccaccggcagcaccatggtggagcacaactactacgtgagcgcctacagaatcctgtacagcgacgacggccagaagtggaccgtgtacagagagcccggcgtggagcaggacaagatcttccagggcaacaaggactaccaccaggacgtgagaaacaacttcctgccccccatcatcgccagattcatcagagtgaaccccacccagtggcagcagaagatcgccatgaagatggagctgctgggctgccagttcatccccaagggcagaccccccaagctgacccagccccccccccccagaaacagcaacgacctgaagaacaccaccgccccccccaagatcgccaagggcagagcccccaagttcacccagcccctgcagcccagaagcagcaacgagttccccgcccagaccgagcagaccaccgccagccccgacatcagaaacaccaccgtgacccccaacgtgaccaaggacgtggccctggccgccgtgctggtgcccgtgctggtgatggtgctgaccaccctgatcctgatcctggtgtgcgcctggcactggagaaacagaaagaagaagaccgagggcacctacgacctgccctactgggacagagccggctggtggaagggcatgaagcagttcctgcccgccaaggccgtggaccacgaggagacccccgtgagatacagcagcagcgaggtgaaccacctgagccccagagaggtgaccaccgtgctgcaggccgacagcgccgagtacgcccagcccctggtgggcggcatcgtgggcaccctgcaccagagaagcaccttcaagcccgaggagggcaaggaggccggctacgccgacctggacccctacaacagccccggccaggaggtgtaccacgcctacgccgagcccctgcccatcaccggccccgagtacgccacccccatcatcatggacatgagcggccaccccaccaccagcgtgggccagcccagcaccagcaccttcaaggccaccggcaaccagcccccccccctggtgggcacctacaacaccctgctgagcagaaccgacagctgcagcagcgcccaggcccagtacgacacccccaaggccggcaagcccggcctgcccgcccccgacgagctggtgtaccaggtgccccagagcacccaggaggtgagcggcgccggcagagacggcgagtgcgacgtgttcaaggagatcctgtag

SEQ ID NO: 17909 - DNA, 2370 bp, Artificial Sequence
  Description of Artificial Sequence: Synthetic coding sequence
atggccagcagagccgtggtgagagccagaagatgcccccagtgcccccaggtgagagccgccgccgccgcccccgcctgggccgccctgcccctgagcagaagcctgcccccctgcagcaacagcagcagcttcagcatgcccctgttcctgctgctgctgctggtgctgctgctgctgctggaggacgccggcgcccagcagggcgacggctgcggccacaccgtgctgggccccgagagcggcaccctgaccagcatcaactacccccagacctaccccaacagcaccgtgtgcgagtgggagatcagagtgaagatgggcgagagagtgagaatcaagttcggcgacttcgacatcgaggacagcgacagctgccacttcaactacctgagaatctacaacggcatcggcgtgagcagaaccgagatcggcaagtactgcggcctgggcctgcagatgaaccacagcatcgagagcaagggcaacgagatcaccctgctgttcatgagcggcatccacgtgagcggcagaggcttcctggccagctacagcgtgatcgacaagcaggacctgatcacctgcctggacaccgccagcaacttcctggagcccgagttcagcaagtactgccccgccggctgcctgctgcccttcgccgagatcagcggcaccatcccccacggctacagagacagcagccccctgtgcatggccggcgtgcacgccggcgtggtgagcaacaccctgggcggccagatcagcgtggtgatcagcaagggcatcccctactacgagagcagcctggccaacaacgtgaccagcgtggtgggccacctgagcaccagcctgttcaccttcaagaccagcggctgctacggcaccctgggcatggagagcggcgtgatcgccgacccccagatcaccgccagcagcgtgctggagtggaccgaccacaccggccaggagaacagctggaagcccaagaaggccagactgaagaagcccggccccccctgggccgccttcgccaccgacgagtaccagtggctgcagatcgacctgaacaaggagaagaagatcaccggcatcatcaccaccggcagcaccatggtggagcacaactactacgtgagcgcctacagaatcctgtacagcgacgacggccagaagtggaccgtgtacagagagcccggcgtggagcaggacaagatcttccagggcaacaaggactaccaccaggacgtgagaaacaacttcctgccccccatcatcgccagattcatcagagtgaaccccacccagtggcagcagaagatcgccatgaagatggagctgctgggctgccagttcatccccaagggcagaccccccaagctgacccagccccccccccccagaaacagcaacgacctgaagaacaccaccgccccccccaagatcgccaagggcagagcccccaagttcacccagcccctgcagcccagaagcagcaacgagttccccgcccagaccgagcagaccaccgccagccccgacatcagaaacaccaccgtgacccccaacgtgaccaaggacgtggccctggccgccgtgctggtgcccgtgctggtgatggtgctgaccaccctgatcctgatcctggtgtgcgcctggcactggagaaacagaaagaagaagaccgagggcacctacgacctgccctactgggacagagccggcttctacctgatggtgagcctggcctgcagacacaacgagggctggtggaagggcatgaagcagttcctgcccgccaaggccgtggaccacgaggagacccccgtgagatacagcagcagcgaggtgaaccacctgagccccagagaggtgaccaccgtgctgcaggccgacagcgccgagtacgcccagcccctggtgggcggcatcgtgggcaccctgcaccagagaagcaccttcaagcccgaggagggcaaggaggccggctacgccgacctggacccctacaacagccccggccaggaggtgtaccacgcctacgccgagcccctgcccatcaccggccccgagtacgccacccccatcatcatggacatgagcggccaccccaccaccagcgtgggccagcccagcaccagcaccttcaaggccaccggcaaccagcccccccccctggtgggcacctacaacaccctgctgagcagaaccgacagctgcagcagcgcccaggcccagtacgacacccccaaggccggcaagcccggcctgcccgcccccgacgagctggtgtaccaggtgccccagagcacccaggaggtgagcggcgccggcagagacggcgagtgcgacgtgttcaaggagatcctgtag

SEQ ID NO: 17910 - DNA, 1140 bp, Artificial Sequence
  Description of Artificial Sequence: Synthetic coding sequence
atgcccctgttcctgctgctgctgctggtgctgctgctgctgctggaggacgccggcgcccagcagggcgacggctgcggccacaccgtgctgggccccgagagcggcaccctgaccagcatcaactacccccagacctaccccaacagcaccgtgtgcgagtgggagatcagagtgaagatgggcgagagagtgagaatcaagttcggcgacttcgacatcgaggacagcgacagctgccacttcaactacctgagaatctacaacggcatcggcgtgagcagaaccgagatcggcaagtactgcggcctgggcctgcagatgaaccacagcatcgagagcaagggcaacgagatcaccctgctgttcatgagcggcatccacgtgagcggcagaggcttcctggccagctacagcgtgatcgacaagcagggcagcaactacctgttcggccactgcatccagttctggaacctgagcagcggcaagtactgccccgccggctgcctgctgcccttcgccgagatcagcggcaccatcccccacggctacagagacagcagccccctgtgcatggccggcgtgcacgccggcgtggtgagcaacaccctgggcggccagatcagcgtggtgatcagcaagggcatcccctactacgagagcagcctggccaacaacgtgaccagcgtggtgagcgtgagcctgctgatggtgttcatcctgttcttcgtgagcggctgctacggcaccctgggcatggagagcggcgacagaggcagcagcaacaacagcatcgtgctggagtggaccgaccacaccggccaggagaacagctggaagcccaagaagcaggccgagaagacctggaccgccctgggcttcgccaccgacgagtaccagtggctgcagatcgacctgaacaaggagaagaagatcaccggcatcatcaccaccggcagcaccatggtgaccatcaccatgtgcctgcccaccgagagctgcaccgtgatgatgggcagaaacggcctgtgcaccgagagcctggtggagcaggacaagatcttccagggcaacaaggactaccaccaggacgtgagaaacaacttcctgccccccatcatcgccagattcatcagatag

SEQ ID NO: 17911 - DNA, 1884 bp, Artificial Sequence
  Description of Artificial Sequence: Synthetic coding sequence
atgaacctgatcttccacaaggacatcctgttcggcatccccgccaacaaggtgccccaggacgagtggaccggctacacccccagaggcaaggacgacgagatcccctgcagaagaatgagaagcggcagctacatcaaggccatgggcgacgaggacagcggcgacagcgacaccagccccaagcccagccccaaggtggccgccagaagagagagctacctgaaggccacccagcccagcctgaccgagctgaccaccctgaagatcagcaacgagcacagccccaagctgcagatcagaagccacagctacctgagagccgtgagcgaggtgagcatcaacagaagcctggacagcctggaccccgccggcctgctgaccagccccaagttcagaagcagaaacgagagctacatgagagccatgagcaccatcagccaggtgagcgagatggaggtgaacggccagttcgagagcgtgtgcgagagcgtgttcagcgagctggagagccaggccgtggaggccctggacctgcccatgcccggctgcttcagaatgagaagccacagctacgtgagagccatcgagaagggctgcagccaggacgacgagtgcgtgagcctgagaagcagcagcccccccagaaccaccaccaccgtgagaaccatccagagcagcaccgtgagcagctgcatcaccacctacaagaagacccccccccccgtgccccccagaaccaccaccaagcccttcatcagcatcaccgcccagagcagcaccgagagcgcccaggacgcctacatggacggccagggccagagaggcgacatcatcagccagagcggcctgagcaacagcaccgagagcctggacagcatgaaggccctgaccgccgccatcgaggccgccaacgcccagatccacggccccgccagccagcacatgggcaacaacaccgccaccgtgaccaccaccaccaccatcgccaccgtgaccaccgaggacagaaagaaggaccacttcaagaagaacagatgcctgagcatcggcatccaggtggacgacgccgaggagcccgacaagaccggcgagaacaaggcccccagcaagttccagagcgtgggcgtgcaggtggaggaggagaagtgcttcagaagattcaccagaagcaacagcgtgaccaccgccgtgcaggccgacctggacttccacgacaacctggagaacagcctggagagcatcgaggacaacagctgccccggccccatggccagacagttcagcagagacgccagcaccagcaccgtgagcatccagggcagcggcaaccactaccacgcctgcgccgccgacgacgacttcgacaccgacttcgaccccagcatcctgcccccccccgacccctggatcgacagcatcaccgaggaccccctggaggccgtgcagagaagcgtgtgccacagagacggccactggttcctgaagctgctgcaggccgagagagacagaatggagggctggtgccagcagatggagagagaggagagagagaacaacctgcccgaggacatcctgggcaagatcagaaccgccgtgggcagcgcccagctgctgatggcccagaagttctaccagttcagagagctgtgcgaggagaacctgaaccccaacgcccaccccagacccaccagccaggacctggccggcttctgggacatgctgcagctgagcatcgagaacatcagcatgaagttcgacgagctgcaccagctgaaggccaacaactggaagcagatggaccccctggacaagaaggtggagcagtgcagattctgcatggtgcacctgaagacctgcaccaacaccggccagagcaagtag

SEQ ID NO: 17912 - DNA, 2082 bp, Artificial Sequence
  Description of Artificial Sequence: Synthetic coding sequence
atgatcgacctgttcaaggccgagtgggtgagcagcgtgtgcgtgcaggtgagcagaaacggcagaaccgaccaggtgccccaggacgagtggaccggctacacccccagaggcaaggacgacgagatcccctgcagaagaatgagaagcggcagctacatcaaggccatgggcgacgaggacagcggcgacagcgacaccagccccaagcccagccccaaggtggccgccagaagagagagctacctgaaggccacccagcccagcctgaccgagctgaccaccctgaagatcagcaacgagcacagccccaagctgcagatcagaagccacagctacctgagagccgtgagcgaggtgagcatcaacagaagcctggacagcctggaccccgccggcctgctgaccagccccaagttcagaagcagaaacgagagctacatgagagccatgagcaccatcagccaggtgagcgagatggaggtgaacggccagttcgagagcgtgtgcgagagcgtgttcagcgagctggagagccaggccgtggaggccctggacctgcccatgcccggctgcttcagaatgagaagccacagctacgtgagagccatcgagaagggctgcagccaggacgacgagtgcgtgagcctgagaagcagcagcccccccagaaccaccaccaccgtgagaaccatccagagcagcaccggcgtgatcaagctgagcagcgccgtggaggtgagcagctgcatcaccacctacaagaagacccccccccccgtgccccccagaaccaccaccaagcccttcatcagcatcaccgcccagagcagcaccgagagcgcccaggacgcctacatggacggccagggccagagaggcgacatcatcagccagagcggcctgagcaacagcaccgagagcctggacagcatgaaggccctgaccgccgccatcgaggccgccaacgcccagatccacggccccgccagccagcacatgggcaacaacaccgccaccgtgaccaccaccaccaccatcgccaccgtgaccaccgaggacagaaagaaggaccacttcaagaagaacagatgcctgagcatcggcatccaggtggacgacgccgaggagcccgacaagaccggcgagaacaaggcccccagcaagttccagagcgtgggcgtgcaggtggaggaggagaagtgcttcagaagattcaccagaagcaacagcgtgaccaccgccgtgcaggccgacctggacttccacgacaacctggagaacagcctggagagcatcgaggacaacagctgccccggccccatggccagacagttcagcagagacgccagcaccagcaccgtgagcatccagggcagcggcaaccactaccacgcctgcgccgccgacgacgacttcgacaccgacttcgaccccagcatcctgcccccccccgacccctggatcgacagcatcaccgaggaccccctggaggccgtgcagagaagcgtgtgccacagagacggccactggttcctgaagctgctgcaggccgagagagacagaatggagggctggtgccagcagatggagagagaggagagagagaacaacctgcccgaggacatcctgggcaagatcagaaccgccgtgggcagcgcccagctgctgatggcccagaagttctaccagttcagagagctgtgcgaggagaacctgaaccccaacgcccaccccagacccaccagccaggacctggccggcttctgggacatgctgcagctgagcatcgagaacatcagcatgaagttcgacgagctgcaccagctgaaggccaacaactggaagcagatggaccccctggacaagaaggagagaagagcccccccccccgtgcccaagaagcccgccaagggccccgcccccctgatcagagagagaagcctggagagcagccagagacaggaggccagaaagagactgatggccgccaagagagccgccagcgtgagacagaacagcgccaccgagagcgccgagagcatcgagatctacatccccgaggcccagaccagactgtag

SEQ ID NO: 17913 - DNA, 2052 bp, Artificial Sequence
  Description of Artificial Sequence: Synthetic coding sequence
atgatcgacctgttcaaggccgagtgggtgagcagcgtgtgcgtgcaggtgagcagaaacggcagaaccgaccaggtgccccaggacgagtggaccggctacacccccagaggcaaggacgacgagatcccctgcagaagaatgagaagcggcagctacatcaaggccatgggcgacgaggacagcggcgacagcgacaccagccccaagcccagccccaaggtggccgccagaagagagagctacctgaaggccacccagcccagcctgaccgagctgaccaccctgaagatcagcaacgagcacagccccaagctgcagatcagaagccacagctacctgagagccgtgagcgaggtgagcatcaacagaagcctggacagcctggaccccgccggcctgctgaccagccccaagttcagaagcagaaacgagagctacatgagagccatgagcaccatcagccaggtgagcgagatggaggtgaacggccagttcgagagcgtgtgcgagagcgtgttcagcgagctggagagccaggccgtggaggccctggacctgcccatgcccggctgcttcagaatgagaagccacagctacgtgagagccatcgagaagggctgcagccaggacgacgagtgcgtgagcctgagaagcagcagcccccccagaaccaccaccaccgtgagaaccatccagagcagcaccgtgagcagctgcatcaccacctacaagaagacccccccccccgtgccccccagaaccaccaccaagcccttcatcagcatcaccgcccagagcagcaccgagagcgcccaggacgcctacatggacggccagggccagagaggcgacatcatcagccagagcggcctgagcaacagcaccgagagcctggacagcatgaaggccctgaccgccgccatcgaggccgccaacgcccagatccacggccccgccagccagcacatgggcaacaacaccgccaccgtgaccaccaccaccaccatcgccaccgtgaccaccgaggacagaaagaaggaccacttcaagaagaacagatgcctgagcatcggcatccaggtggacgacgccgaggagcccgacaagaccggcgagaacaaggcccccagcaagttccagagcgtgggcgtgcaggtggaggaggagaagtgcttcagaagattcaccagaagcaacagcgtgaccaccgccgtgcaggccgacctggacttccacgacaacctggagaacagcctggagagcatcgaggacaacagctgccccggccccatggccagacagttcagcagagacgccagcaccagcaccgtgagcatccagggcagcggcaaccactaccacgcctgcgccgccgacgacgacttcgacaccgacttcgaccccagcatcctgcccccccccgacccctggatcgacagcatcaccgaggaccccctggaggccgtgcagagaagcgtgtgccacagagacggccactggttcctgaagctgctgcaggccgagagagacagaatggagggctggtgccagcagatggagagagaggagagagagaacaacctgcccgaggacatcctgggcaagatcagaaccgccgtgggcagcgcccagctgctgatggcccagaagttctaccagttcagagagctgtgcgaggagaacctgaaccccaacgcccaccccagacccaccagccaggacctggccggcttctgggacatgctgcagctgagcatcgagaacatcagcatgaagttcgacgagctgcaccagctgaaggccaacaactggaagcagatggaccccctggacaagaaggagagaagagcccccccccccgtgcccaagaagcccgccaagggccccgcccccctgatcagagagagaagcctggagagcagccagagacaggaggccagaaagagactgatggccgccaagagagccgccagcgtgagacagaacagcgccaccgagagcgccgagagcatcgagatctacatccccgaggcccagaccagactgtag

SEQ ID NO: 17914 - DNA, 2790 bp, Artificial Sequence
  Description of Artificial Sequence: Synthetic coding sequence
atgaagggcctgagcggcagcagaagccaccaccacggcgtgacctgcgacagcgcctgcgacagcctgagccaccacagcgacagaaagccctacctgctgagccccgtggagcaccaccccgccgaccacccctactacacccagagaaacagcttccaggccgagtgcgtgggccccttcagcgaccccctggccagcagcaccttccccagaagacactacaccagccagcaggagctgaaggacgagtgcgccctggtgcccagaaccctggccaccaaggccaacagaatccccgccaacctgctggaccagttcgagagacagctgcccctgagcagagacggctaccacaccctgcagtacaagagaaccgccgtggagcacagaagcgacagccccggcagaatcagacacctggtgcacagcgtgcagaagctgttcaccaagagccacagcctggagggccccagcaagggcagcgtgaacggcggcaaggccagccccgacgaggcccaggccgccagatacggcaagagaagcaagagcaaggagagaagagccgagcccaaggccagacccagcaccagccccggctggtggagcagcgacgacaacctggacggcgacatgtgcatctaccacgcccccagcggcgtgatgaccatgggcagatgccccgacagaagcgccagccagtacttcctggaggcctacaacaccatcagcgagcaggccgtgaaggccagcagaagcaacaacgacgtgaagtgcagcacctgcgccaacctgcccgtgagcctggacacccccctgctgaagaagagcgcctggagcagcaccctgaccgtgagcagagccagagaggtgtaccagaaggccagcgtgaacatggaccaggccatggtgaagagcgagagctgccagcaggagagaagctgccagtacctgcaggtgccccaggacgagtggaccggctacacccccagaggcaaggacgacgagatcccctgcagaagaatgagaagcggcagctacatcaaggccatgggcgacgaggacagcggcgacagcgacaccagccccaagcccagccccaaggtggccgccagaagagagagctacctgaaggccacccagcccagcctgaccgagctgaccaccctgaagatcagcaacgagcacagccccaagctgcagatcagaagccacagctacctgagagccgtgagcgaggtgagcatcaacagaagcctggacagcctggaccccgccggcctgctgaccagccccaagttcagaagcagaaacgagagctacatgagagccatgagcaccatcagccaggtgagcgagatggaggtgaacggccagttcgagagcgtgtgcgagagcgtgttcagcgagctggagagccaggccgtggaggccctggacctgcccatgcccggctgcttcagaatgagaagccacagctacgtgagagccatcgagaagggctgcagccaggacgacgagtgcgtgagcctgagaagcagcagcccccccagaaccaccaccaccgtgagaaccatccagagcagcaccgtgagcagctgcatcaccacctacaagaagacccccccccccgtgccccccagaaccaccaccaagcccttcatcagcatcaccgcccagagcagcaccgagagcgcccaggacgcctacatggacggccagggccagagaggcgacatcatcagccagagcggcctgagcaacagcaccgagagcctggacagcatgaaggccctgaccgccgccatcgaggccgccaacgcccagatccacggccccgccagccagcacatgggcaacaacaccgccaccgtgaccaccaccaccaccatcgccaccgtgaccaccgaggacagaaagaaggaccacttcaagaagaacagatgcctgagcatcggcatccaggtggacgacgccgaggagcccgacaagaccggcgagaacaaggcccccagcaagttccagagcgtgggcgtgcaggtggaggaggagaagtgcttcagaagattcaccagaagcaacagcgtgaccaccgccgtgcaggccgacctggacttccacgacaacctggagaacagcctggagagcatcgaggacaacagctgccccggccccatggccagacagttcagcagagacgccagcaccagcaccgtgagcatccagggcagcggcaaccactaccacgcctgcgccgccgacgacgacttcgacaccgacttcgaccccagcatcctgcccccccccgacccctggatcgacagcatcaccgaggaccccctggaggccgtgcagagaagcgtgtgccacagagacggccactggttcctgaagctgctgcaggccgagagagacagaatggagggctggtgccagcagatggagagagaggagagagagaacaacctgcccgaggacatcctgggcaagatcagaaccgccgtgggcagcgcccagctgctgatggcccagaagttctaccagttcagagagctgtgcgaggagaacctgaaccccaacgcccaccccagacccaccagccaggacctggccggcttctgggacatgctgcagctgagcatcgagaacatcagcatgaagttcgacgagctgcaccagctgaaggccaacaactggaagcagatggaccccctggacaagaaggtggagcagtgcagattctgcatggtgcacctgaagacctgcaccaacaccggccagagcaagtag

SEQ ID NO: 17915 - DNA, 2934 bp, Artificial Sequence
  Description of Artificial Sequence: Synthetic coding sequence
atgaagggcctgagcggcagcagaagccaccaccacggcgtgacctgcgacagcgcctgcgacagcctgagccaccacagcgacagaaagccctacctgctgagccccgtggagcaccaccccgccgaccacccctactacacccagagaaacagcttccaggccgagtgcgtgggccccttcagcgaccccctggccagcagcaccttccccagaagacactacaccagccagcaggagctgaaggacgagtgcgccctggtgcccagaaccctggccaccaaggccaacagaatccccgccaacctgctggaccagttcgagagacagctgcccctgagcagagacggctaccacaccctgcagtacaagagaaccgccgtggagcacagaagcgacagccccggcagaatcagacacctggtgcacagcgtgcagaagctgttcaccaagagccacagcctggagggccccagcaagggcagcgtgaacggcggcaaggccagccccgacgaggcccaggccgccagatacggcaagagaagcaagagcaaggagagaagagccgagcccaaggccagacccagcaccagccccggctggtggagcagcgacgacaacctggacggcgacatgtgcatctaccacgcccccagcggcgtgatgaccatgggcagatgccccgacagaagcgccagccagtacttcctggaggcctacaacaccatcagcgagcaggccgtgaaggccagcagaagcaacaacgacgtgaagtgcagcacctgcgccaacctgcccgtgagcctggacacccccctgctgaagaagagcgcctggagcagcaccctgaccgtgagcagagccagagaggtgtaccagaaggccagcgtgaacatggaccaggccatggtgaagagcgagagctgccagcaggagagaagctgccagtacctgcaggtgccccaggacgagtggaccggctacacccccagaggcaaggacgacgagatcccctgcagaagaatgagaagcggcagctacatcaaggccatgggcgacgaggacagcggcgacagcgacaccagccccaagcccagccccaaggtggccgccagaagagagagctacctgaaggccacccagcccagcctgaccgagctgaccaccctgaagatcagcaacgagcacagccccaagctgcagatcagaagccacagctacctgagagccgtgagcgaggtgagcatcaacagaagcctggacagcctggaccccgccggcctgctgaccagccccaagttcagaagcagaaacgagagctacatgagagccatgagcaccatcagccaggtgagcgagatggaggtgaacggccagttcgagagcgtgtgcgagagcgtgttcagcgagctggagagccaggccgtggaggccctggacctgcccatgcccggctgcttcagaatgagaagccacagctacgtgagagccatcgagaagggctgcagccaggacgacgagtgcgtgagcctgagaagcagcagcccccccagaaccaccaccaccgtgagaaccatccagagcagcaccgtgagcagctgcatcaccacctacaagaagacccccccccccgtgccccccagaaccaccaccaagcccttcatcagcatcaccgcccagagcagcaccgagagcgcccaggacgcctacatggacggccagggccagagaggcgacatcatcagccagagcggcctgagcaacagcaccgagagcctggacagcatgaaggccctgaccgccgccatcgaggccgccaacgcccagatccacggccccgccagccagcacatgggcaacaacaccgccaccgtgaccaccaccaccaccatcgccaccgtgaccaccgaggacagaaagaaggaccacttcaagaagaacagatgcctgagcatcggcatccaggtggacgacgccgaggagcccgacaagaccggcgagaacaaggcccccagcaagttccagagcgtgggcgtgcaggtggaggaggagaagtgcttcagaagattcaccagaagcaacagcgtgaccaccgccgtgcaggccgacctggacttccacgacaacctggagaacagcctggagagcatcgaggacaacagctgccccggccccatggccagacagttcagcagagacgccagcaccagcaccgtgagcatccagggcagcggcaaccactaccacgcctgcgccgccgacgacgacttcgacaccgacttcgaccccagcatcctgcccccccccgacccctggatcgacagcatcaccgaggaccccctggaggccgtgcagagaagcgtgtgccacagagacggccactggttcctgaagctgctgcaggccgagagagacagaatggagggctggtgccagcagatggagagagaggagagagagaacaacctgcccgaggacatcctgggcaagatcagaaccgccgtgggcagcgcccagctgctgatggcccagaagttctaccagttcagagagctgtgcgaggagaacctgaaccccaacgcccaccccagacccaccagccaggacctggccggcttctgggacatgctgcagctgagcatcgagaacatcagcatgaagttcgacgagctgcaccagctgaaggccaacaactggaagcagatggaccccctggacaagaaggagagaagagcccccccccccgtgcccaagaagcccgccaagggccccgcccccctgatcagagagagaagcctggagagcagccagagacaggaggccagaaagagactgatggccgccaagagagccgccagcgtgagacagaacagcgccaccgagagcgccgagagcatcgagatctacatccccgaggcccagaccagactgtag

SEQ ID NO: 17916 - DNA, 2028 bp, Artificial Sequence
  Description of Artificial Sequence: Synthetic coding sequence
atgaacctgatcttccacaaggacatcctgttcggcatccccgccaacaaggtgccccaggacgagtggaccggctacacccccagaggcaaggacgacgagatcccctgcagaagaatgagaagcggcagctacatcaaggccatgggcgacgaggacagcggcgacagcgacaccagccccaagcccagccccaaggtggccgccagaagagagagctacctgaaggccacccagcccagcctgaccgagctgaccaccctgaagatcagcaacgagcacagccccaagctgcagatcagaagccacagctacctgagagccgtgagcgaggtgagcatcaacagaagcctggacagcctggaccccgccggcctgctgaccagccccaagttcagaagcagaaacgagagctacatgagagccatgagcaccatcagccaggtgagcgagatggaggtgaacggccagttcgagagcgtgtgcgagagcgtgttcagcgagctggagagccaggccgtggaggccctggacctgcccatgcccggctgcttcagaatgagaagccacagctacgtgagagccatcgagaagggctgcagccaggacgacgagtgcgtgagcctgagaagcagcagcccccccagaaccaccaccaccgtgagaaccatccagagcagcaccgtgagcagctgcatcaccacctacaagaagacccccccccccgtgccccccagaaccaccaccaagcccttcatcagcatcaccgcccagagcagcaccgagagcgcccaggacgcctacatggacggccagggccagagaggcgacatcatcagccagagcggcctgagcaacagcaccgagagcctggacagcatgaaggccctgaccgccgccatcgaggccgccaacgcccagatccacggccccgccagccagcacatgggcaacaacaccgccaccgtgaccaccaccaccaccatcgccaccgtgaccaccgaggacagaaagaaggaccacttcaagaagaacagatgcctgagcatcggcatccaggtggacgacgccgaggagcccgacaagaccggcgagaacaaggcccccagcaagttccagagcgtgggcgtgcaggtggaggaggagaagtgcttcagaagattcaccagaagcaacagcgtgaccaccgccgtgcaggccgacctggacttccacgacaacctggagaacagcctggagagcatcgaggacaacagctgccccggccccatggccagacagttcagcagagacgccagcaccagcaccgtgagcatccagggcagcggcaaccactaccacgcctgcgccgccgacgacgacttcgacaccgacttcgaccccagcatcctgcccccccccgacccctggatcgacagcatcaccgaggaccccctggaggccgtgcagagaagcgtgtgccacagagacggccactggttcctgaagctgctgcaggccgagagagacagaatggagggctggtgccagcagatggagagagaggagagagagaacaacctgcccgaggacatcctgggcaagatcagaaccgccgtgggcagcgcccagctgctgatggcccagaagttctaccagttcagagagctgtgcgaggagaacctgaaccccaacgcccaccccagacccaccagccaggacctggccggcttctgggacatgctgcagctgagcatcgagaacatcagcatgaagttcgacgagctgcaccagctgaaggccaacaactggaagcagatggaccccctggacaagaaggagagaagagcccccccccccgtgcccaagaagcccgccaagggccccgcccccctgatcagagagagaagcctggagagcagccagagacaggaggccagaaagagactgatggccgccaagagagccgccagcgtgagacagaacagcgccaccgagagcgccgagagcatcgagatctacatccccgaggcccagaccagactgtag

SEQ ID NO: 17917 - DNA, 2790 bp, Artificial Sequence; identical to SEQ ID NO: 17914
  Description of Artificial Sequence: Synthetic coding sequence

SEQ ID NO: 17918 - DNA, 1986 bp, Artificial Sequence
  Description of Artificial Sequence: Synthetic coding sequence
atggacctgaagaccctgaagctgttcaacagccagctgagatgcggctggctgctgtacatctggaacaaggccttcatggcccacctgagagtgccccaggacgagtggaccggctacacccccagaggcaaggacgacgagatcccctgcagaagaatgagaagcggcagctacatcaaggccatgggcgacgaggacagcggcgacagcgacaccagccccaagcccagccccaaggtggccgccagaagagagagctacctgaaggccacccagcccagcctgaccgagctgaccaccctgaagatcagcaacgagcacagccccaagctgcagatcagaagccacagctacctgagagccgtgagcgaggtgagcatcaacagaagcctggacagcctggaccccgccggcctgctgaccagccccaagttcagaagcagaaacgagagctacatgagagccatgagcaccatcagccaggtgagcgagatggaggtgaacggccagttcgagagcgtgtgcgagagcgtgttcagcgagctggagagccaggccgtggaggccctggacctgcccatgcccggctgcttcagaatgagaagccacagctacgtgagagccatcgagaagggctgcagccaggacgacgagtgcgtgagcctgagaagcagcagcccccccagaaccaccaccaccgtgagaaccatccagagcagcaccgcccagagcagcaccgagagcgcccaggacgcctacatggacggccagggccagagaggcgacatcatcagccagagcggcctgagcaacagcaccgagagcctggacagcatgaaggccctgaccgccgccatcgaggccgccaacgcccagatccacggccccgccagccagcacatgggcaacaacaccgccaccgtgaccaccaccaccaccatcgccaccgtgaccaccgaggacagaaagaaggaccacttcaagaagaacagatgcctgagcatcggcatccaggtggacgacgccgaggagcccgacaagaccggcgagaacaaggcccccagcaagttccagagcgtgggcgtgcaggtggaggaggagaagtgcttcagaagattcaccagaagcaacagcgtgaccaccgccgtgcaggccgacctggacttccacgacaacctggagaacagcctggagagcatcgaggacaacagctgccccggccccatggccagacagttcagcagagacgccagcaccagcaccgtgagcatccagggcagcggcaaccactaccacgcctgcgccgccgacgacgacttcgacaccgacttcgaccccagcatcctgcccccccccgacccctggatcgacagcatcaccgaggaccccctggaggccgtgcagagaagcgtgtgccacagagacggccactggttcctgaagctgctgcaggccgagagagacagaatggagggctggtgccagcagatggagagagaggagagagagaacaacctgcccgaggacatcctgggcaagatcagaaccgccgtgggcagcgcccagctgctgatggcccagaagttctaccagttcagagagctgtgcgaggagaacctgaaccccaacgcccaccccagacccaccagccaggacctggccggcttctgggacatgctgcagctgagcatcgagaacatcagcatgaagttcgacgagctgcaccagctgaaggccaacaactggaagcagatggaccccctggacaagaaggagagaagagcccccccccccgtgcccaagaagcccgccaagggccccgcccccctgatcagagagagaagcctggagagcagccagagacaggaggccagaaagagactgatggccgccaagagagccgccagcgtgagacagaacagcgccaccgagagcgccgagagcatcgagatctacatccccgaggcccagaccagactgtag

SEQ ID NO: 17919 - DNA, 2058 bp, Artificial Sequence
  Description of Artificial Sequence: Synthetic coding sequence
atgaacctgatcttccacaaggacatcctgttcggcatccccgccaacaaggtgccccaggacgagtggaccggctacacccccagaggcaaggacgacgagatcccctgcagaagaatgagaagcggcagctacatcaaggccatgggcgacgaggacagcggcgacagcgacaccagccccaagcccagccccaaggtggccgccagaagagagagctacctgaaggccacccagcccagcctgaccgagctgaccaccctgaagatcagcaacgagcacagccccaagctgcagatcagaagccacagctacctgagagccgtgagcgaggtgagcatcaacagaagcctggacagcctggaccccgccggcctgctgaccagccccaagttcagaagcagaaacgagagctacatgagagccatgagcaccatcagccaggtgagcgagatggaggtgaacggccagttcgagagcgtgtgcgagagcgtgttcagcgagctggagagccaggccgtggaggccctggacctgcccatgcccggctgcttcagaatgagaagccacagctacgtgagagccatcgagaagggctgcagccaggacgacgagtgcgtgagcctgagaagcagcagcccccccagaaccaccaccaccgtgagaaccatccagagcagcaccggcgtgatcaagctgagcagcgccgtggaggtgagcagctgcatcaccacctacaagaagacccccccccccgtgccccccagaaccaccaccaagcccttcatcagcatcaccgcccagagcagcaccgagagcgcccaggacgcctacatggacggccagggccagagaggcgacatcatcagccagagcggcctgagcaacagcaccgagagcctggacagcatgaaggccctgaccgccgccatcgaggccgccaacgcccagatccacggccccgccagccagcacatgggcaacaacaccgccaccgtgaccaccaccaccaccatcgccaccgtgaccaccgaggacagaaagaaggaccacttcaagaagaacagatgcctgagcatcggcatccaggtggacgacgccgaggagcccgacaagaccggcgagaacaaggcccccagcaagttccagagcgtgggcgtgcaggtggaggaggagaagtgcttcagaagattcaccagaagcaacagcgtgaccaccgccgtgcaggccgacctggacttccacgacaacctggagaacagcctggagagcatcgaggacaacagctgccccggccccatggccagacagttcagcagagacgccagcaccagcaccgtgagcatccagggcagcggcaaccactaccacgcctgcgccgccgacgacgacttcgacaccgacttcgaccccagcatcctgcccccccccgacccctggatcgacagcatcaccgaggaccccctggaggccgtgcagagaagcgtgtgccacagagacggccactggttcctgaagctgctgcaggccgagagagacagaatggagggctggtgccagcagatggagagagaggagagagagaacaacctgcccgaggacatcctgggcaagatcagaaccgccgtgggcagcgcccagctgctgatggcccagaagttctaccagttcagagagctgtgcgaggagaacctgaaccccaacgcccaccccagacccaccagccaggacctggccggcttctgggacatgctgcagctgagcatcgagaacatcagcatgaagttcgacgagctgcaccagctgaaggccaacaactggaagcagatggaccccctggacaagaaggagagaagagcccccccccccgtgcccaagaagcccgccaagggccccgcccccctgatcagagagagaagcctggagagcagccagagacaggaggccagaaagagactgatggccgccaagagagccgccagcgtgagacagaacagcgccaccgagagcgccgagagcatcgagatctacatccccgaggcccagaccagactgtag

SEQ ID NO: 17920 - DNA, 2196 bp, Artificial Sequence
  Description of Artificial Sequence: Synthetic coding sequence
atgggcagcgagaaggacagcgagagccccagaagcaccagcctgcacgccgccgcccccgaccccaagtgcagaagcggcggcagaagaagaagactgaccctgcacagcgtgttcagcgccagcgccagaggcagaagagccagagccaagccccaggccgagccccccccccccgccgcccagcccccccccgcccccgcccccgccgccgcccagggccccccccccgaggccctgcccgccgagcccgccgccgaggccgaggccgaggccgccgccgccgccgccgagcccggcttcgacgacgaggaggccgccgagggcggcggccccggcgccgaggaggtggagtgccccctgtgcctggtgagactgccccccgagagagcccccagactgctgagctgcccccacagaagctgcagagactgcctgagacactacctgagactggagatcagcgagagcagagtgcccatcagctgccccgagtgcagcgagagactgaacccccacgacatcagactgctgctggccgacccccccctgatgcacaagtacgaggagttcatgctgagaagatacctggccagcgaccccgactgcagatggtgccccgcccccgactgcggctacgccgtgatcgcctacggctgcgccagctgccccaagctgacctgcgagagagagggctgccagaccgagttctgctaccactgcaagcagatctggcaccccaaccagacctgcgacatggccagacagcagagagcccagaccctgagagtgagaaccaagcacaccagcggcctgagctacggccaggagagcggccccgacgacatcaagccctgccccagatgcagcgcctacatcatcaagatgaacgacggcagctgcaaccacatgacctgcgccgtgtgcggctgcgagttctgctggctgtgcatgaaggagatcagcgacctgcactacctgagccccagcggctgcaccttctggggcaagaagccctggagcagaaagaagaagatcctgtggcagctgggcaccctgatcggcgcccccgtgggcatcagcctgatcgccggcatcgccatccccgccatggtgatcggcatccccgtgtacgtgggcagaaagatccacagcagatacgagggcagaaagaccagcaagcacaagagaaacctggccatcaccggcggcgtgaccctgagcgtgatcgccagccccgtgatcgccgccgtgagcgtgggcatcggcgtgcccatcatgctggcctacgtgtacggcgtggtgcccatcagcctgtgcagaggcggcggctgcggcgtgagcaccgccaacggcaagggcgtgaagatcgagttcgacgaggacgacggccccatcaccgtggccgacgcctggagagccctgaagaaccccagcatcggcgagagcagcatcgagggcctgaccagcgtgctgagcaccagcggcagccccaccgacggcctgagcgtgatgcagggcccctacagcgagaccgccagcttcgccgccctgagcggcggcaccctgagcggcggcatcctgagcagcggcaagggcaagtacagcagactggaggtgcaggccgacgtgcagaaggagatcttccccaaggacaccgccagcctgggcgccatcagcgacaacgccagcaccagagccatggccggcagcatcatcagcagctacaacccccaggacagagagtgcaacaacatggagatccaggtggacatcgaggccaagcccagccactaccagctggtgagcggcagcagcaccgaggacagcctgcacgtgcacgcccagatggccgagaacgaggaggagggcagcggcggcggcggcagcgaggaggaccccccctgcagacaccagagctgcgagcagaaggactgcctggccagcaagccctgggacatcagcctggcccagcccgagagcatcagaagcgacctggagagcagcgacgcccagagcgacgacgtgcccgacatcaccagcgacgagtgcggcagccccagaagccacaccgccgcctgccccagcacccccagagcccagggcgcccccagccccagcgcccacatgaacctgagcgccctggccgagggccagaccgtgctgaagcccgagggcggcgaggccagagtgtag
